United States Patent 6,812,339 (POLYMORPHISMS IN KNOWN GENES ASSOCIATED WITH HUMAN DISEASE, METHODS OF DETECTION AND USES THEREOF) - sequence listing, part 75

SEQ ID NO: 17032 - DNA, 194937 bp, Human
agacctgtgggggcacagaaaaggaagcccatagctacccctgctggcttttggtgtccatttgcatgaagtgtctttttccacccctttactttaagtttacatgagtccttatgtgtcaggtgagtctcctgaaggcagcagatagttagttggtgagttcttatccattctgcagttctgtatcttttaagtgcagcatttaggccatttacattcagtgttaatattgaaatgtgaggtaccattgcattcatcgggctctttgttgcctgtgtacttctttgtttgttttttgcttttgttttttaacttgtatttttgttttataggtcctgtgtgatttatgctttaaagaggttctgttttgatgtgtttccaggatttgtttcaagatttagaactccttttaccagttcttgtagtggtggcttggtaatgacgaattctctcaggatttgtttgtctgaaaatgactgtatctttccttcatatatggtgcttagtttcactggatacaaaattcttggctgataattggtttgttgaggagccggaagacagggccccaatcccttccagcttgtaggttttctgctgagaaatctgctgttcatctgattggttttcctttacaggttacctggttcttctgtctcacagctcttaagattctttcctttgtctcaactctggataacctgatgacaatgtgctgaggcaaagatctttttacaatgaatttcccatgtgttctttgtacttcttgtatttggatgtctaggtctctagatggctgcagaagttttccttgattcttcccccaaatatgttttccaagcttttagaattctcttcttcctcaggaacaccaattattcttaggtttggtcatttaacataatcccagacttcttggaggctttgttcatattttcttattcttttttctttgtctttgttgaattgggttaatttgaagaccttgtctttgagctctgattttctttcttctacttgttcaattctattgctgagactttccagagcatttcacatttctaaaagtgtgtccaaagtttcctgaattttcaattattttttctttaagctatttcattgaatatttctcccattcaatattgggggattgtgttgggagaggagggtctccctttcccacttccgcaaatggggcactcacagtatttggagtgtcttctgggtcctgcaggagcagtctggttccttcagagagtctgtgggtccttttgggattgctggttttttcttgcagttgatctggagctaaaattcaccatggaagcctccagatgctgctctgtctgaagctgcaatctagtcctgccacccagccactatgatcccctccatctctctgtccactttagtcagataagctcaaagctagaacaaaggacccatatatgagcctacggatctgccttcaaacacttgagaagccctccaactcaccatgagaacactgaccccaatcgggatctttgctttgctccaacagccagacactcagacaggtcctcagacccagcaactaatggacttggtgggatggttgtcctcaaagcagccagcattttgatcaggctggcgtctggtcctgtatttttctgggatattcagaatctcttgacatgtatcttcacttaattgtgaatttaaaaaattatagatggatgtagatatagatatagatatagacatagagatagatatagatagacattttggagaagagtctctctttgaagacttcctctcagagtacaagtccgtggttacaaccattttgtttctcagcaaacatggggaagtttgcttttcttctctgaggaagttaatataaatgtttattgacagtgcagtcatcaaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtaagtgcagccagccctagggactgtgacagcgtcagccgtctcaccctggagccttgctggtgccatggcggggtatgtgggagtgtgtttttcttcttttctaatctagcgggagtgagtattaacacagcttcagaattaaaagcaaacagccaggttaatcttttgctaaaatgcatgagattgaagtgtcaggaaaggctggtgattcagtgactgagaacgctacacataattaagtttgaaagagatggaaaaagaaacaaattggaaaggcattaggtttgggtagaagcatttccttgaaccccgtcatatctcctcacctcatttttctaaaatcctctgtccttgttggatttacagtgaattcagcctcttggttcatattacattcaaaacaaaacaagacgtaggagctgtttggcaaatgtgggcctctttgcaggaagtcattgagggggatttctgtagggttaaggacaaagtggtagatctaatttctcatagttgatagagggagatggattctgatgaacatagtgtgtgcagctcctacaaaatttgagaccctgaaaggatctcaaacttgaactccgagttgctcccctgtggttttgttaattcaacagcaaattttcctaaggctgactctggtgtctgtaggtcgaaggcctcataatatgctacatttatgcatattcgccctgtcagttaaacttattagagttacccattcaatcaaaagcacctggatttagatggctctggcttttgagggcaaagtgagtggaaaaaataatggaggactggagtccgaacagaattttaatttatgttttcagtagtaataaagccttctctagattaataactgggaaagcactttgaaaagcatcaagcattatgcaaatgtgaggtattattcttttggaatttgcatagctgagagtggaattcacgtttgatgttctatgatgatgaaattacttcttggaaattggctctgaaacccagcctcagtcccagtgctgtttttctttttaactggtttaattttttttttgaacttttttatctcattgtagcttaccttggattgaaactggccacatgtaaaaccaagagcaaatggtagctccttccctacccccagcccccaataatccatctcaatgtgtttttatgctccgggaagcccgaagcacagtgtctgacatgcagaaagtgcttagtcgatgtcagccactataattaaccatctatcatctatgtaacctaaaagaaaataagtctttagtggtttaggtttatttttaatttcttactaatgtgcttattcatattaatctcatcaatagctatgctctgactgtggttctcaaagcggacacttttttacacttttgtttcagtctttgttgtgtctgagcctccagctcagtgcctgccatgtaggaacaccacaccattcagcagggcagctatgtgtttgctgtctattcttgggccatattaataacctggttcaaagatgcagagattaagataaatgtaccaagcagaagtggtaaacaggaagtgagagctgacttctatttgttattgcaaaaatatttattaacctgttaatgtgtgcccagtctggaggaggccctggtacaaggtcaggaagcaggagatctggagaaggtgcccaaggcaggggagacacagaggttctgggggtgagctggatgtctagagaggatactgcaggaggagcagaggcagcaggagagaggtcacggccctggctctggtgcttttgggtccatcccttgattcagtgcaaggggaaccacccttgggctttcaacccttctgttccgggtgagactctagtcagccactaagcaacagccaccagcttgaatgaggcaaggcccccttcctgcttcattgtcttgaaaggatatgtgtggaagagacaggggtgcttttcctccagtgagaggattcacaggcaaggaaagatggaggtgtagagacacttgcaggagaaactggcagggggagtggattaaacattgcagcacattagtctttgctttaagtgttacatgtgccatccagccaggtgagatggcagcagagaacctaaaccctgagaaggtgaaatcaaatgggctgggcgcggtggctcatgcctgtaatcccagcactttgggaggccaaggcagacagatcacttgaggtcagaagttcgagaccagcctggccaacatggtgaaactccatctctactaaaaatacaaaaattagctgggcatggcagcaggtgtctgtaatcccagctacttgggaggctgaggcaggagaatcgcttcaacctgggaggcacaggctgcagtgatctgagatcatgccacttccctccagcctgggtgacaaagaaagactctgtttcaaacaaaacaaaacaaaacaaaacagaaggatgggaggatggagggaatcatggtggacaggaggcaggactagactgcagctccagacaaagcagcatctggaagcttccatggtgaattttagctccagatcaactgcaagaataaatcagcaattctgaggggacccacagaccctctgaaggaagcggattgctcctgtagggcccagaagacaccccaaatactgtgagtgccccaactgcggaagtgggaaagggagaccctcctctcccaacacactcccccaatttgagtgggagaaatattcaatgaaatagatagcttaaagaaaaaacaatagaaaattcaggaaactttggacacacttttagaaatgtgaaatgctctggaaagtctcagcaatagaacaagtagaagaaggaaattcagagctcaaagacaaggtctttgaattaactgaatccaacaaagacaaagaaaaaaaataaaaaaatatgaacaaagcctccaagaagtctgggattatgttaaatgaccaaacctaagaataattggtgttcctgaggaagaagagaattctaaaagcttgcaaaacatatttgggggaataatcaaggaaaagttccccagtctagctagagacctagacatccaaatacaagaagcacaaagaacacgtgggaaattcatcgcaaaaagatctttgcctaggcacattgtcatcaggttatccagagttgagacaaaggaaagaatcttaagagttgtgagacagaagaaccaggtaacctataaaggaaaacctatcagatgaactgaagatttctcagctgaaaccctacaagctagaagggattggggccctgtcttccagcttctcaaacaaatcaattatcagccaagaatgttgtatccagtgaaactaagcatcatgtatgaaggaaagatacagtcgttttcagacaaacaaatgctgagagaattgccattactaggccaccactacaagaactggtaaaaggagctccaaatcttgaaacaaatcctggaaacacatcaaaacagaacctctttaaagcataaatcacacaggacccataaaacaaaaatacgagctaaaaagcaaaagcaaaaaacaacaacaacaaaaaaaaccaaagtacagaggcaacaaagagcccaatgaatgcaatggtacctcacatttcaatactaacactgaatgtaaatggcctaaatgctccacttaaaagatacagaactgcagaatggataagaactcaccaaccaactatctgctgccttcaggagactcacctaacacataaggactcacataaacttaaaggggtagaaaaaggcatttcatgcaaatggacaccaaaagcgagtagagcaacggtagctattctcatatcagacaaaacaaatcgtaaagcaacagcagttaaaagagacaaagaggggccgggcgtggtggctcatgcctgtaatctcagcactttggatcacaaggtcaggagttcgtgaccagtgtggccaacacagtgaaaccccgtctctactaaaaatacaaaaaaaaaaaaaaaaaaaaaaaaaattagaggggtgtggtggtaggtgcctgtagtcccagctacttgggaggctgaggcaggcgaatcacttaaatctgggaggtggaggttgcagtgagctgagattgcaccactgcactctagcctgtgtgacacagcaagactctttctcaaaaaaataaaaaaaagagagagacaaagagggacattatagaatggtaaaaggccttgtccaacagtaaaatatcacagtcttaaacatatatgcacctaaaactggagcttccaaatttacaaaacaattaaaataggcctaagaaatgtggtagacagcaacacaataatagtggcagatttcaatattccaccgacagcaccagacaggttagcaagacagaaagtcagcaaagaaacaatggatttaaactataccttggaacaaatggacctaacagatatatacagaacatttcatccaataaccgcagaatacacattctattcaacatcatatggaactttctccaagatcgaccatatgataggccataaaacaagcctcaataaatttaagaaaattgaaattgtatcaagcactctctcagaccacaacagaataaaactggaaatcatctccaaaaggaactttcaaaaccatgcaaacacatggaaattgttaaataacctgcttctgaatgagcattgggtaaaaaacaaaatcaagatggaaattaaaaaattcttctaactgaatgacaataatgacaaaacctatcaaaacctctgggatatagctaaggcagtgctaagaggaaagttcatagccctaaacacctacatcaaaaagtctgaaagagcacaaacggacaatctaaggtcacacctcaaggaactagagaaatagaaacaaactgaacccaaacccagtagaagaaaggaaataaccaagatcagagcagaactaaatgaaattgaaacacatacacacacacaaaataaaagataaattaaacaaaaaactggttctttgaaaagataaataaaattgatagaccattagcaagattaaccaagaaaggaagagagaaaacccaaataacgtcactgagaaatgcaacaggaggtattacaactgacaccactaaaatacaaaagatcattcaaggctactatgaacacctttacgcacataaactaaaaaacctagttgagatggataaattcctggaaaaatacaatcctcctagcttaaatcaggaagcattagataccctgaacagaccaatacaagcagtgagattgaaatggtaattaaaaaattaccaacaaaaaaaagtccaggaccataaggattcacagcagaatttaccagacattcaaagaagaattggtaccaatacttttgacactattccacaagacagagaaagaaggaaccctccctaactcattctatgaagccagtatcaccccaataccaaaactaggaaaggacacaaccaaaaaagaaaactacagaccaatatccttgatgaacatagatactaaaattctttttttttttttttttctgagacagagtcttgctctgtcgcccaggctggagtgcagtggcgcgatctcggctcactgcaagctctgcctcccgggttcatgccattctcctgcctcagcctccggagtagctggcactacaggtgcccgccaccacgctggctaattttttgtattttttttagtagagatggggtttcaccatgttagccaggattatcttgatctcctgacctcgtggtccacccacctcggcctcccaaagtgctgggatttcaggcgtgagccaacacgcctggccaatactaaaattcttaatgaaatactagctaaccaaatccaacaacatatcaaaaagataatccaccatgatcaagttggtttcataacagagatgaagggatggtttaacatacaaaagtcaataaatgtgatacgccacataaacaaaattaaaagcaaaaatcatgtgataatagatgcagaaaaagcatttgacaaaatctggcatccctttatgattaaaattcttagcaaagtcagcatacaagggacataccttaatgtaataaaagccatctatcacaaacccacagccaacctaatactgaatggggaaaagttgaaagcattccctctgagaattggaacaagacaaggatgtccactctcaccactcctcttcaacatagtactggaagtcctagccagagcaatcagacaagagaaagaaataaagggcatctgaattgctaaagaggaagtcaaactgtcactgtttgctgacaatacaatcgtttaccttgaaaaccctcaggcctcctccagaaagctcctagaactgataaaagaattcagtagtttccagatgcaagattaacatccacacatcagtagctctcctatacaccaacagtgaccaagcagagaatcaaatcaagaagtcaaccccttttacaatagctgcaaaaataaataaataaataaataaataaataaataaataaataaataaataaaatacttaggaacatacctaaccaaagagttgaaaagcctctacagggaaaactacaaaatgctgctgaaagaaatcatagatgacacaaacaaatggaaacacattccatgttcatggatgagtagaatcagtattgtgaaaatgatcatactgccaaaagcaatctacaaattcaatgcagtctgcatcaaaataccaccatcattcttcacagaattagaaaaaacaattctaaaattcatacagaactgaaaaagagcctgcatagctaaagcaagactaagcaaaaagaacaaatctggaggcctcacattaccttatttcaaactatactataagcccatcatcacccaaacagcatggtactggtataaaaataggcacatagaccaatggaaccaaatagagaaccacaaataaacccaaatacttagtcaactgatcttcaacaaagcaaacaaaaacataaagtgaggaaaggacacctttatcaacaaatggtactgggataattggctagccacatgtaggagaatgaaactggattctcatttctcactttattcaaaaatcaacccaagatgagttaaagacttaaacctaagacctgaaactatacaaattctaggtataacactgtaacaacccttctagacattggcttaggcaaggatttcatgaccaaaaacccgaaagcaaatgcaataaaaacaaagataaagagccgggacctaattaaactaaagagcttctgcatagcaaaaggaacagtcagcagagtaaacagacaacccagagtgggaagaaatcttcacaatctatacatctgaccaaggactcacattcagactctacaatgaactcaaacaaatcagtaagaaaaaaacaatcccatcaaaaagtgggctaagaacatgaatagacagttctcaaaagaagatatataaatgaccaacaaacatgaaaaaatgctcaacaacactaacgaccagggaaatgcaaatcaaaaccacaatgcaataccacattacttctgcaagaatggccataatcaaaaaataagaaaacagtagatgttggcgaggatgtggtgatcagggaacacttccaccctgctggtggggatgtaaactagtacagccactatggaaaacagtgtagggattccctaaagaaccaaaagtagaactacctaccatttgatccagcaattccgctactgggtatctacccaaaggaaaagaagtctttatttgaaaaagatacttgaatatgcatgttcatagcagcacaatccacaattgcaaaatcatggaaccaacccaaatgcccatcaatcaacaagtggataaagaaactgtggtatatgtatatgatggaatactatgcagccataaaaaggaacgacttaacagcatttgcagtgacctggatgagattggagactattattctaagtgaaataactcaggaatggaaaaccaaacaccgtatgttctcactgatacgtgggatctaagctatgaggatccaaaggcataagaatgatacaatggactttggggacttggagggaagtatgagaggtaggcaagggataaaagattgcaaatatggtgcagtgtgtactatttgggtgatgggtgcaccaaaatctcagaaatcaccactaaagaacttactcatgtaaccaaatgccacctgtgccccaacaacttatggaaaaataaaaaaacaaaaacaaaacaaaacaaaaaagcaaaaggcacaccaaggttgcttcttgtgctctcaaccagcctgtgagttctctaagggtgagggccaggtctcctatctcattacagttctggaatcttctgccaatggcagggatgctctgctagcatgtggttgaaggtggtaaagtcaagaagtccacaaccatcagccccgccccaggactcactgtgggtctcctgctccttcagcgggccccctgtcgctctctcccccacaaaccctaaggcctcctccagaaagctcctagaactgataaaagaattcagcagtttcttttatcctgggctggggtcagagcgacgctgtctgggtgctgtgaatggtcctttgttgctgcatgaggcctcctctttccttcaactccaagctcaggggtgcttcctcagggaagtgttttctgtttccaaaggcactgaggagccccctctcagcattgcttttatcccatctctgtccctcacaatgcctggcacatagttggtgcctaacaaatgctgactgaaggctaattccaacctctaagctctgcctggtgctttcttcctgtggttcttctcttggccttcacagttccatacagatctaaattctcttgcccatgtgacccactccctttcctgaaagcttgctgtgttttcagtttgtgtcaatttgccatgcactgttccagttgttgaagatggactgtttttgtatcctttcttatcctgtagagcagacaccatgccatgtacttaatgcacacttattaattattaggtgtatgcgtgaatttggaaaaaagacaaaaaaaatctttcatttaaaaagacactgttttaaactaggcacagtacactttgatcgttttcccgaaaccgcgttggacaccatttttccatgatgatcatttgatttaaaccgaccagtgtgtggctgagctctgtgaactggggcatcaggggatcagggctgcaccaccagggctggagatggagctggggatagagactgtattagctggaagtacatggagcacatgctaagacgattaacacacaagataacacattttaaaaactaattttttcccatataaaatggtttaaaattcttacttctggaggagatttgatggacaagaaatgagttgtacgagttgaacgttgctcgaggcaaccgtaagtcctagcgtatttaatctttcaagcaacacctaaggactggcagctgggttcctgtggggaggataaagattgctttattctttaagatccagtgtaaagaaatagcccagatagcaatagtggatttctttctgggatggggttgtgggtgatttcttttcccttcttttagtctttctgcatcttttgtatttctttaatgagtgtgaatatttagcaaaaaagagaaattttactaaaaagagtgggaaactgctcccttctagtggtgaaggggaaagcagtttcatgctttaggcgtgaggtttcaggactgtagtctaattatttcttccagtggagtagaatgtctgaaaggatttggagtaacagggctgatgaagcggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaaagtgggaggatcacttgagcccaggagtttgagaccagcctgggcaacaaagagagaccctgcttctaccaaaaaaaaaaaaaaaaaaacaaatcaaaaattagccaggtgtggtggtgcgagtctgtaatctcagctacttgggaggctgaggtcggaggatctcttgagcccaggaggttgaggatacaatgagctgtgattgcaccactacactcgcactccagcctgggtgacagggcaagatcctgtctgtagtcccagctacttgggaggctgaggcaggagaatcacttgaacccgggaggcagaggttgcaatgagccgagatcacaccactgcactccagcctgggcaacaagagtgaaactctgtctcaaaaaaaaaaaaaaaaaagagatttcagatagagagtgagttagtgttctgatcaagtctcattctaagaccagtttaaattgaaatgtgattggtgattattaagatttaagactatcacagattattaagacttaagtttaccactatgcgtggaagttcctttcccagagagtttcttctacatgtaagaactggactctaattctagacccacatctactccagactatatttagaaggcaccattgggatggaatatgggagccaagatgagaaatctgaagaggaagaagccatgtaggtattccctggcacaatgggaggtgagctccggaaaaggcatcccgcctccagcatgtggggactgaagatcaatttgcccaccatttcccaacttcggttcctaaaagtgtttaggaaattaagtctaaatcaagcccttcttggagattcatagaatatcaaaggccctgaaaggttctttaataaagaaacctgttcagctttatttaacccagtgttttcgcagcgtctttgctaaagtactgctgcatatggccgtggtgggttgggcaactagacccgctgagatggtcccttgaaaacggcggtcggatgcattggtagctgcacaaccagtggaaatggaggggccacaaaacggaggaataagacattcaaattgcccctttgcaagctctgaggttccagggttgacgtattgtttccttcagggcacagaaaatatggagtctagcgaacagaagcagggcccatgcgtaggggtggtccaggtttacaccaaagaaaatgagtactactcacagctgtctggcaaggtggcaagagagcgcctcggaggtcgtgagtgtccctcaccatccataggaatgccacaaaagcccttgctgccaggcatgagcagctggtacagaaggccaccgagtgccttcccgatctggactccgtgacttctatgcccactggcgctcttgcatgggtcagtctgtgctgccgctcaggaaaagcaagtcaggtgccataccagcgacccaatggcggctgctgcttcttctgcctgggcacctcatcatccccagcagtagttcctaggtgtgagcgtggcaaggagcccagaaatacagaagcagcgtttaggggcctcacggtagcttcatgcctgactcttttctctcctcttccggcctggcctctaggcctttctggatcgccagccagtcagactctacttcgagaagcagaaggtcttgggctgggtcttgaaatgcagggaagaattgacttggcagaggagaggaaagagaaaatttcaggtggggaagtaccccaggcaaagacaacattagtgtttgtaacatttgctggaacaaaacattaggagtgtgaataatggacacagtttagaaatacattttaaaggcatggataattttcagtgcctccaagcatctagagagggatacatctatttcccttttttttttttttatctttttgtatttttgtctaggatatgatgggtacttcgatttaataactcagtgatgagcttggagataaaattgagcctgctgtgaaaactaggtctgtggcttccttgaggaccatttctacagaatattattttttttgttttctctctcttaaatggttatacacaatatccctatccttctcctcactttattgattttccagaatgagagtacgaggtatgactataaagtaacgtgactgattattttagcatacactccaatacttatacagccaaatgaattttatgaccttcggaggcattttcctgataggctaaacccttactgcagatatgccactatcagaaaacacattcttagcactttttgtgggaatggcacttggtgcttagatgtggtcctttgaaagccctcaacgcaacacatctttgtggagaatagattgattttttttaaaaaacagtccatattttggcaaatagatgattaaacagagtaatattatttgcaattttaaaaatgtgattataaaacaatacacagcttgcagaagaggtgtatgaaccagttctggaagcctgggaattttgctgaggggccacgctcactggcatacgagttggtttttggttttggttttgttttttaaagaaaacaatagcaacagtcttaatatttatggtcataccttctctcgtctagtaaggaattcaggcttctggtagcatctgttttgggggcagagatgaaagaagaatcttatttgttgtataaacaaagcaaaacatcagattgatgtgtgtccattactgagctgcgtgagtgggtgctcagcgatgccttcccgggaaggaagtgactctcccagaaataaaatgattgaatgaactcttcccctaaccctagtgccataataacaacaaacctaacaactatcgcttgccactgaagggaagtacgcggtctatgggaaccctggtagccttatatggacttgttttttggttgccggaataacatgcatctggacatgggaatgagactggcgagaaagggagggggcagatgttcacactggtattcattggtgcttcaattactaagagccacatctttcctggtttaccagaaataggtgctgttgcacaacttcctggtggatagggtaggggggtgttagctgataggggagttccctggagccctcgactctctctgttgctttcagcctcagccctcagtgcagagtttggccctggcccgcgctgtggggccctcctaaacctcccctatgtccttgcaaaggtgtgcttcttaggtttcgcttgagcagtcagccagttcctcaacacaatctcagaaagaggccggccccttttttcccctcgaagatatctagaaaaaactgtgtcagagatgatctgaaagcaaagccaagctctaccaatagtggcttccaccaatgccttgtttccctgagcactgcacacagaccccctgggagagccagcgccataccccgaaaccagcagctgcctccacattctgatctgaaaggtgccctaaagtcctcgcatgtgcttccctccttcctgcactgacatgcctgttccctccaagctgcacagcgcagtccctgttgcctgaatgctctcccttcttggtttaactgaactcctgcctaaccttcaaaatcttgtctaaatgtcactcttccataaaggtctcctccatcaggccagccctcaaccagccctgcctcctgtggacttgcttcctatctctctggctatctcggcacttactactttactttatttatttatttatttatttatttatttatttatttatttagagatggagtctcactctgtcatccaggctggagtgcagtggcatagtctcagctcactgcaacctccgcctcccgggttcaagtgattctcctgcctcagcctcctgagtagctggggctacaggtgcgtgccaccacacccagctaatttttgtatctttagtagaggtggggtttcatcatgttggccagtctggtctcgaactcctgacctcaggtgatccgcccacctcggcctcacaaagtgctgggattacaggcatgagccacagtgcccggcccactttattttatagcttatgcatgtgacctatcttcttggcttgactgtaagtccctaagaggagggcccacatcttaagccagtgagtgccctctacatagtagctgctcagtaaatgctaatgatcatgattatgcctctggtaaccgagatagcagcactgtttccaaatgattactgtgacaatgtgtgtgtgtgtgtgcatgcctgtgtatggaagagggtagaatcagtctccccctaattgcacactagtggtagtgtgttcttagcacctggcagaatgccttgcacaaggcttattgaaaagggaaataaatcttgattcatgcaatcgtcgaatgctgaaggttttctaggctgtgagctggttctacctcattggtgtgctatggataacattcccatgaattcagatagatagaggaattgccccatttgaaattgaagagcaagactgtaaaaggaggggatgatggaatgcaggacccagccacttagaatacgtggtacatgggggtatatagagcactcaaagtctgagtggggtatcctgacaccagactaggggacaggaggcatccaacccccagcagaggcattgaagaacagacactttctccttcactgttctattgagcacaaatccccacagtttgaagcaatggtatctcaactcttccctaccatccactgttgatgtgatttttccccatagatcctatgttctgttgtcccagcaacaatgtatatttaagtaatgattgattaattttcccattttaattattcaaaggcaagctaattggaaaactctgccagttgagaatagctgatcaatgagataaccagcattagtgtaccaaattataattccactccaaagcaaagaaactcgacattttccttaacctgcaccaccatcgcgttgtcaataaatgcacgatttacattaggctctttgaaatattgaaaatatctcatgtaccctcttcctaccttcacaaatcagtaggcacctgggaaccccaggctgtaaagcagtgaagagggagtgtagtcagttgtacatttaaggattttaactccatccgtacacagagagtgagcaaaattggtagcatcatctcatgatctaagagcgtacctaaggagataattgggaggttctcaggagaagtgtggcattgtggaaatcagccaggcctttacagtgtagggacagacacacctctttccctgggtgtccttgggccagccactccctccttgctcatttcctcattggtgagagagggctgggacacctgcctctcagcattggcacattttcccccagccccccaggctatgctgggaatcagcctcacatctttcttggctctcaccctaatgttaaccctccacagtctggccagtcttgactcccaagtgttcctctctctatctgctttgcttctgctgcagttgaggacttcaaaatcactccttggctggaaatagccttcccacgggtctccctgccttctatcttgtgctcccctaatttgtcctgcaactgcagccaccggctcactgctcctctgcataaaaccctttcctggtcctcctgtctaaggaagtgagtgttcctggcctggctcctgaagccccctctgacctggtcccctgcccctctgcaggtttaactcccctcgcttctcacctggtgcctggctcccaggtgctcacagctcctcccacacaccatgcagttcagtgccaatttctttccttctacttgcatgtccttcccccttcatttgggtgagaacttctccaggagcctcttctgcatctcctaggttcttgccccaatgtacctggtaccttccctctctctcatcacttacctggctccccaagggcaggattggtccttcctcatctttagctgagcactcagcattgtgccaggggcactcaacacacttctgttgagtaataggcacgcagttacttgttgaaccaaactgcgttagaagagatgatctataggattttgtgtggcatatgcattgttctttgccgctatgggtatcatcatagagaatttccattaatttctggccgtgtgccactgcaaccagctttcaccctgacttgtcatataacaaaatatcattaaattgaactctagtttttttttttttttttttagacagggtcttactctgttgcccaggctggagtacagtggcacaatcacagctcactgcagcctcaacctccccaggctcggggaattctcccaccccagccccatgagtagctgggactacaagcgagcactaccaccccaggctattttttgtatttttttgtagagacggggtttctccatgttgcccaggctgggaactctggatcttaataaaatatttttttctttagaagtcaggctaggctgggctgtgggttgaagttcatctctgtgctatttatgaaggaagggattgctaaccaaaatcattgtgcaaaggtgacagctcaaccaatttaggaaaataaactactcccgagcacttcggcagcttgctagtttatcaacgatcccttgaaaacgcactaaaaacacttcactctttctgcctttccacactttctataatggcccagggcttaggctttggaatcagatctcctggattcaaactctggctagccttgtgaccttaagcaatagatgtcaggtctccgtgtctcagtttccccatgtgtaaaatagggatactaatagtacctacctcttagcatgttgggaggattacatgagtaagaacataaggtggacttagagcagtgcatggcacagctcagggtcaataaacattagctcttagtgttatctgataactgcacgcttatattcaacaaaaactgcatagacgctgggcagctagatcttggtttttattttgtttatctagttattttgtaaacctcattctgaattctcacctgatccccaggaatgcactgcagtgaaaagtgaggagaggcgtacttcaaacaagtgacctcattttgaataatcctggacttataccactaggtagcttttgaccttgaacaagtaaaattaggttttaaaaatgcgtatcagacttagtaagctgaagtgtcttcgggggtgttggggatggtcaccaatggtgtggtggggacagagccatagtgcggcaggtttagaaatgatggggaaggagggcagatgaaaagaagactgtgggcttttctttgaagaaggtcagagatgtcagccacctctctgggcttgatcacttttccatacggtcaagcggagatagtcattctctccctgtctccttgaaagggagtatgagggtttgtgagcaataacccttacaccaacatatattgctattagtccattgatggcatctgtttacctctcagttgtaggtgcttcaaaattaaagaaaatctatttcttgaaaagtgcacaataaatcaagctttaaactcaatttgttttccagaaatttttcaaattttcccatgacaaaatttacatttattttctgattttaacagtaagagtaccattctaattttcatctggtctttgcttcattggttgacatttgccttgcccttggacttgagaacttgaagtatcaatgaggcatagcacatcagtaaataagccccgctaagccatactctattctcgcctgttgaccagatcttttgtttcctgctcactctcatccaagcccttacccacatcattttcaatgatggtgtcactgcaaatgtttctttgcaggttcaattctctcctatcataaaacaaacaactgagccagccaactaaccaaccaaccaaccaaccaaccaatcaaccaaccaactcactaaccgcctcttctttgactccaccccaggcaccactccacttatccttctcttcccagcctagtgacttgaaagaggactttgtatttgctcactttctcacctcctatttacccccgacccctgcaataaggtctctgttccattctctactgaaacggctttcttcaaggccaccattaagtctctagtacctaaactgaattaacagtttctaatccttctctttctttggcactttgcaatatttgttgtttgtttgtttgtttgttttgaaataggatcttgctctgtcacccatgctgaagtgcagtggtgcaatcatagctcactgcagcctcaaacttctgacctcaagtgatcctttcacctcagcctctcaagtagctagaactatagacatgtgccaccatgcccagttaatttttaaattttttgtagagtgaggtcttgctatatttcccaggctggtctcaagctcttggcctcaagtgaccctcctacctcagcctcccaagtagctgggactataggtgcatgcaaccatccctggctaattttatgttttacttatttatttatttatttatttgtaaagacaggattttgctatgttgcccaggctggtcttaaacgcctgaggtcaaatgatcctcccacctcggccttccaaagtactgggattacaggcatgagccaccatgcctggccgctttgcaacatttgattctgttaattttgggtatatgtcaaagctgtcagttacgtaggggtagaaaaaaagttgtgcatcattgattataatgccagggccccattttacagatgtgaatatggaggtccagagaagttatgtgatctgatgtgtattagtcagctactgttgcaataatgctgtgtaacaaaccaccccaagctcattggcaaatgacaatgtttatttttctcatggtctgtatgttcactggagtagctctgttccagtctgacagtggggtttagatctgctccacatgtttgtaatgggacccaggctgaagagaatattagggaagtgctgctcctgacaggtcacagggatgcaagaaatgtaaaatgaaacagtaatatctcttgaggcctcaacctggaagctgctaagataatttctgcccacattctattggctaagcaatccacatgcccaaggttaacattaatggggcagggaagaagactctgtccactgtagcgggaggcactgcacagtcatggagcaaggggcattgatgtagaattttgatacagatggggcatgaagcatcaggagcagtgattcactctacctcatgctccaagattacacagctggattctgatctttggcaaaatagaatctaggggccacaagtcacaagacaaaataaaaccataacaaaaaaataaataaatgaacaaaaacttaacgtgaatggacatattaacttttattgtaagtgaaaacagtgactctctgggggaaaaaaaacaacaggccaggcatgatggcttacacctataattcttttgggaggctcactttgggaggctgaggtaggaggatcacttgagcacaggaattctcgagaccagcctgggcaatataggaagtctccgtctctacagaaaatacaacaattagccaggtgcggtgacatgcatctgtggtcccagctactcaagaggctggggtgagaggatcagttgagcccaggatgtggatgttgtagtgagccaagatcgcaccactgcacttccaacagcaaagaccctgttcccccaaaaaaaacacaaaaaacaaaaaacaacaaaaaaaaaacaacccaccaaaaaacagaaacaacagatagtgatgcagaattttcccactgagacactgacatggtgggtcatggtgatcttgcttatgaagtgataacctagcttcaagagtgttgaagcagggtccagagctcagtgtaggggccaggttggtcctgggccgaacctggggacgtacctaggaatttctagccaaataagcaatagagggaagggtctgactgatgacggagcatgagcacactctaggaagggcaaagaattgatctgggggatgggatggggcggggccctaagatttcaactccaccctggaaaagcaggacttaggggaggcatgtctgaagttcagaagaccaggggaaacctgaatgcagaaagcgcagcttgttcaccatgtcctgaaatacagcaaccaggggacactcttgtagattgtgagctgtattgcttaggacaaattcattgttctatgctgggcagtaaatttatggatgttgttatgccaagaaaggaatatggctgaaaacataaattgctccagaattgttttaaatattctcatgggtgctggaagtcctctgggttattaaggaaaaaatttgtttatttcttgcccttccggaaaccaccctttggtgctggctagtggctgtcagaagaaagggtgtatccatgtatcacaagggctattacacatcgtgaatttaacttgagttctcaaagataaaaagagacacttgtcttgcctccacgctccttctcgtcctgcacatttgtccactcacctccagtaagttgctctggaatctgaacagggaggtttcttgcaatccagaatcagccacaaaatcccatttccttttttcctataaaaaagatgtgctgactgaaacaactaaaatatagactagttagtgtaataacaataagtagcaaaaacaaaatagaaaaacaaagcacaacatgaaaaaagaagtttttgaattagtgtcttctttcatcaaggtcagtttctctccatctcacatcctctgtgaccctagggtggtgtggaagatccttccccacccacacccacacatggggtattatttgggccttttccagggacttctgtcagttctgatggtctttgcactgggctgagtagtgtcccctcgcccccaaattcatgtccattaaaacctctgaatgtgacctgatttggaaatagggtctttacagcggtaatcaagttaagatgaggtcctactggatgacggtggtccctaatccagtgactggcatccttataagaagagtgaaatttggatgctgagatggacagagggaggacgacatgtagatatagtcacacaggcgagaacactgtgatgaccaaggcggagattagagggatgcatctacaagccaaagaccatggattgccagcaactaccaggagatggacagaggcaaggaaggagctcccttcgtgtcttcagagggagcatggccctgctgatgtcttgacctcagaattctgaactccagaatgatgagaggataatttctgttgttttaagccacccggtttgtggcaatttgttagagaagccctgggtaactagtctggtctccttgctcccgttggtcttactgagccaaagcatcccattggccttactgagccaaagcatcccattgcatcatgtttgttactgtaaccctcaaatctttttcttgacctaactcttagcaagtttagccactggcctttgatcatctcttagctgcaataatcttcacttgacagacaagccagaggcctggctggaggctcaggcccttcattcagacagctcaggaggcctggactgtggctgggccagttcctgtggccgggctctaagtctcagtttccccatctgtataatgcacacaacagggatgttggtagagattacaggacatgatgtttataaagtgtgtttataattttattttgtgggtcagtacaatgcctgacccatagcaagtgcttaataataaatgttagctattattaaacatacagttttctgaaatctttaaatccatttttatccaccccagggtgaagtttccctgatttttcttttccagtaaaagcatggcagatcctatctactctcttagtgatgcacaatgacatctgggctagtgcctgacacagagtaggcactaaatatatttttatggaataaagaatggaacaactacattgtttcaatatctaatcaaaggaggaaatagcttacagattttatgaggcttagtaaccagcttgatacactcaaggtgaaactttggaaaaggatgtaatttcaccacatttgttcacaatagggcacaggtgatgtggtagacagcctccaagagggccctctggatccttgccctggaattcacacccttgcatagctccctcccccattgtaccagggtcagttagcatgaccagtggaatacagcagaggtgatggtgttatcacttccaagattagattattggagactggggtttccatcttgggctcgctctctcccttggattgcttactttggggaagtcagcagccatgttgagcagccctatagggagaggctcatatggcaaagccagctacagctccataagcaagcatggacaccattctccagcttgaccctgaacccaaagcacctagctgatctgctcgcagactcctgaccctcagaatctgtgagataatgaatgtttgttgtcttcagtcacttaggtctgggggcaatttgtgacacagcagtagataactaatataggtgctgagataggaatggctgggaccaggcagggtcaggactgaggactctaataatggaagggattataagttgcagggagcaggcaagaggccaaacccagaaaagtggtctgttcggaaggtcaggcaggttctgtgggtctccacctgtggctgtgttccagaacccagagaggtgagagccagaagcaaacacactgaggaacaacgggcactgagattcagggctcttggactagaactcttgccttttgactttgtcctgtacaatttccagctagacccacaattgatcattatagctaagagatgatcaaaggtcagtggctaaacttgctaagaattaggtcaagacaaagatctgggggattacaggaacaaacatgatgcaaggggattataaatatttttttgaaactcttaacaatattcttttgttactttgagttacccaagctctttaaactgtctgccaagctcaaaggcaaaattggtatttcccaggccttttggacgggtcatagtgcaatagaaaggtggaaatattggctgggtttatgaagacataacttcttatccaattggcaaacattttttaaatgcctactcggctgggtacaaaagaacctagaattattctgagcacccactaccagtactcaatgcccctgtgtaccaaccttggctactccaatacacacacacacacacacacacacacacacacacacacacacacacacacacagttggccaaagaagcaacctgtctgctctgcacaagccaggtcttcactttactgaagccccagctgacccctctgggctcaaactttactgaagtgaagacctggtctgtgcagaggagataatgacagatttatctgtccttatttcaagtcttgaagccctgttgacttagtggctaatctgatcaactgatttgaaccctggggatagcgtcctgtaagatggcatctgccttttcacaggggactcagagccctcaacccacagacttgaacaaacaggggcttttcgcatcccccgtcttacagataggttggattctgggcaactggctgctctgcaaatgtaaagtgagaaacagtagggcctggtaatggtgagcacagactccagagccagacagcctgggttcgaatctcagctgtgctactcactagcagtgtgaccttgggccagttacttaatctctctgagcctcagtgttcccatctgcaaaacggagataataataacagcatgttccacacagaatttggggaggagtaaatgagctcatgtgtgggaagcactcagccgggctcctggctcacaggaagcatcctgtaactgtttccttttattacgcaggatccagaggcaggggcagccccagctgacccctctgggctctaatttaactatctgttggggttcaccggaggcagatgtccctctttcaccacaagtctcaggggttctttaaggacttcataaaaacaaaggattaactgcagatgactaagcccacatgatggaaacagaatcaggtacagtaaataatgaacgtagacaggattagattcctacaaacaatacattgtgttctcctgctcttcattggcaatcatccccagtagggaatcagtggaactctttgagtggccaaggaaaacatctccatgtgcccaggatagcctgggtgggctcctggaggaggcaacccttgagcagaaagccgaagagcaatctggcctttgcaaatggagaaagagtggatgcatcagcagagaggagagtgggctgggacaagggtgagagaaggaagcaagcacctaggcccaaaatttaagaaggccctcactctcagggttgtacaagagcaggggtggcacttgtacagccctgagagtgaggacctccttaaattttgtaccctaggtttgttcttgcctctcctttgtcttggccctagagaaaagcctgggaaaaagcccagaacggtgaaacgacatggcgtaactaggaacgtgtgagtcatgcaagattgcccaagcctaatttagggacagagatgacttacagtgaggctagcagtcaagctgtggccggatcaccaaagaccctaggtgccaaataaaggaggttagtgcttgaactgaaagtgacagggagccaaggaagaattctgagcagggctgcaacatgatgagatttgcatatgagcaagcttcttctggcattggtgtggaggactgattggaggatgataggagaagctagaggctgggaggccagttcaggaccctactgaaaactctatgcccaagggagagacgacgacctgatatagggcagtgccagttaggagtaagaatgaagaactcactcaagacatgtgttgaaggcagagttgacagaacttggtgattgactgcagatgaggatcaaaggaaagacccaaagatagcatgaagtttcaaagatggtcatcaatttagaagccaagggggtttattagacaagataacaagcatgtgaaggcagtgatttcagcttccccaagtccaaggtaaacccttagttctcctgttttctgtaggataagctctctggaggctaggatgtatcttattcatttttgtatgatatctactctgtaagtatctttgaactgcattaagtggctttcacacctccgcatcctgctcattggctttcaagtggccttaggggtgttactattgtttgaatgtttgtctcctccaaaaatcatgttgaaatttaatccccgatgtggtagtgttgagaggtgaggcctgtaagaggtgactgggtcatgagggcaaagctatcataaatggactctgtgcagagtccccaccagcaagaaggccctcaccagatgcaactccttaaccttggacttctcagcttccataactgtaagaaataaattctttttctttataaattatctaggttcaggtattgtgttataagcaacagaaaacaaactaagacaggtatcaaagtccttttaaagatggctgtgtagctgggatcagaccaacacagcaatgtgttcaaactcccattctaaacacacagaacctggggctctgacttggccccacggtcttgagttgaagcctgaagtgtgactggatgtcaggcgtgggctgccctggggctttgggaagtagtgaaagggataaggtgaaggtcaagcagagtgggggatgtcaggaggctggggaggcttgggctgccaggtgaagtgggcctcatgaaagacaatttgagatcagaatgtcagacagagagcaggctagaaggcagctggcttctgagctgcagcctagaaaggctgattcagcagtgctaggaggaagtgggaggttttgtcgtcccagaagccatatctggagcaaggggaagtactaagaccacagggtagcatttggagccatacactgggactaacttcctctgacctaggcaacgacagactgcccctgtggtcaaccagagcccccagatccttttctgtgagctacaatgaagccaggcctcattcttcttgaacttgagaagtttagaaaatatctgctttgccttcactagcctccattttcataaaaataaagcgagtgaaaaaagcaagtctgagcgctttgaaacattaattaaagacaccacagtttccttatttaactgagggttgctacctcatctgggattattagcaaagcagagagcctttgttgtgctcgacaaagtgattaattcagactcgaggtgaattttggctttctcaacttcttttgatgtgctaagatcccccaatgaggacaacgtcatcaattacttaagccattaccttgagatcacaattatcggggaggcccagtctactaattggcagacagagagacagaaatggactacagggttgtggcttcaacccttaattgttctagggggagcgagagtcctttaaaatgttttgtggcaatgctcctgctaatctggggtgatcgagttgtttttccaccaggcaaaatgcagcctgggtgacctgcgtctctagaaccaagaaactgcctgtgattccactgacttggcgttctcatgggccaggacacagaactcagaactgagggatgagtgtgtcaatggaagagggatgaggttcataaaattggaaaggagagctttatttctcataaagggttgcggccttcgggtggccattccgacaggctaggaagatattttgatggaggggaaaagggaatgggaatttatgcagagcagggaggccaaatatacatattcaataagctatgggaggagtcatgaatatttatgaaaggagaaacatgtgcatgcgcaattgagcgtcatgcgccttcatgggtcccatgtagaaaaaatggcagccttagcataatctgagggtggagttttcgagcctctgacttcaaaaagtgaagcaaaggacaggaaaaccctcactgagcatcctccatacaatggccagaatcactccataatcggtggtctcgtatcaggcaaaagaaaggggcagcatcaggtggcaggttgatgtcagcggtggaggcttttaacatcagacgctttcagggcgttatggcgtcaacaccaatggaggctttgaaaaggccgctttctatttagcccttaggggagaaagcataatcatggctagtgagggaggggtagaaggagtgtgtctgactccccatcccatcatggccaagaactcagttttcaagtttactctggggaccccttggccaagagatggtccattcagtcagttgggggcttaggattttatttttagtttacaagttctagaagcaaacatcctactcaagaggcaaattctccagcccctggaagctgtctttgggcttccgtgggatgctacatctgggcttactgtcccctgacacataaggaattcaaggaccagatacaagaggctgctttttacattttaaaatatataatcatataatattctgtttaaatagatttatctttgttcatttaactaagccattactctttttttttctctccatcctataaaagagtttttgggggaaggttttatgctgcatggatatatgtcattggtttttctggtgaaaggtggaggaactttgtctggttaaatttagtcaaataaccaatacttaaacaaacaaaagccacccctgaagtgtttcataaatatcagtcacttcaagagttttatgatgtacgtcagttgctttgttctgttttcacaatagaaacacacgttgtgtgtgttttcggatggtggcactactgtttgctgtaccttcatcattcttctttaattctcactgggacagaagggcaagacactttcccagggtcagaatcctgggattggctggctggattttcttttcttcttaatttttttttttttttttaagagacagggtctctctctgtcacccaagctggagtgcagtggcttgatcatagcttactgcagcctctaattcctgggctcaagtgatcctcctgcctcagcctcccaagtaggtgggtctacaggcacacaccaccacacctggcaatttttaaaaattttttttgtagaggtggggtcttgctatgttgcccaggctggtctcgaactcttggcctcaagcaattctcctgccttggccccccaaaacactgggattatgggtgtgagctaccacgcctggccttgggctgaattttcttgggggtgggatgggcattttaaagcactcttgagaaagtagaacacactccattttaaggcagtttctttgcagtgcttcttcgtacacatcaaccctatgctcactctgccccatggcctccaggtgacccatctgttccaaggcagcagcctttccagtgccttcacctgctatggtgccacaacatggctctcgtttattgtgccagctttgacacctctgttctcagtttaatgatttttctggggatgggtccttcttggagggtcctgctttgtttttgtttttttccagattaactttgggggacataataagtggagaccatttatcgttttttaaggctcaacaaatatccaatagtcagacagaagagtgatcaaaatagaaagcatgtatttaaactgggactgacaggtgacaggggatgcctcttagccacaatgatcataatgtaaatgcttaattaactgtttgtcagtagccattgaatgtctgtctggtccactaggctgtaagtgccacagagcaagggcatgtaggcatggtccctgcagcatcctggtacccggaactcagcactcccccagcaccatgcttggtatctgctctctggccatggttttgaactatcagctgagcccaagcaaccttgcagaccacattttgattatgtcttcctcggaccatccttgagagtcacgtcttcttggcagtgtcccatagactgtgaatggtgagtgagatcactttagaaggtacacggactttaaaaatctttcattataaagcatttatttattttttaatttttaattttaattttttattttgagaaggagttttgctctcgttgcccaggctggagtgcaatggcgtgatcttggctcaccacaacctccccctcctgggttcaagtgactcacctgcctcagcctcctgagtagctgggattacaggcatgcgccagaattaaccatgcccggttaattttgtatttttaatagaggtggagtttctccatgttggtcaggctggtctcaaactcccaacctcaggtgatccgcctgcctctgcctcccaaagtgctgggattacaggcgtgagccaccgtgcccggcccaaagcattcattttttatcgttagttttttttttttttttttttgagacggagtctcactctgtcaccccaggctggctggagtgcagtggcatgatctctgttcactgcaagctccgcctcccgggttcacaccattcttctgccttagcctcccaagtagctgggactacaggcgcccaccaacacacctggctaattttttgtatttttagtagagacagggtttcactgtgttagccaggatggtctcaatcttcttacctcgtgatccgcccacctcagcctcctaaagtgctgggattacaggcataagccaccgtgcctggcctatcattagtttttaatttatgtaagtgatactgattttcacttatgatcacgacataaaatttccttttaaaatgaattcatttcaatttatctaaaagaaattgggaaataagtaaatgtacaggcaacttgcagatatggccaaaattataaaggggctatacaaataactgaatttagaagattaaggccttaatactcgttgagacttactgactcaactggctttcttgccctgaaaagttaggataaaaatggagaagttagttaactctctgaattacaataaccatcaactagatacctttttaaaagaattgtaatactttctttataaaacgttatctttggccaggcatggtggctcacacctgtaatcccagcactttgggaggccgaggtgggtggatcacttgaggttaggagttcgagaccagcctggccaacatggtaaaaccctacctctactaaaaatacaaaaattagctgagcacaatagtgcacgcctgtagtcctagctatccgggaggctgaggcatgaggcttgaacctgggaggtggaggttgcagtgaactgagattgtgccactgcactccagcctggacaacagaggaagactctgtctcaaaaacaacaacaacaaaactaaagaatatgtattcttggctgtttcagtggtagggctaccaaagcctggttcagtgctgcccaaggcagaggctgggtactgggtgagctctcggctggccttcccccaccccaccccctgcaactgtaccatgtactgttcagttctgtagaaacaggaagctcagggtaactcacagtccccaccccagacacttcttcttttcaggcacacttcaaaataaaatcaggatctacatacactataagttggcgtggtagctgaatattggccccctaaaatgtcgatgtcctagcctctggaacttgtgaatgcaaccttagatggcagaactgattttgaagatgtgattaagttgaagatcatgaaaggggttaagtattctggattgtttgggtgggccctaaatgtaatcatgaggtccttataaaaaggacacaggagttgtcagagcgagagaaggcagtgtgaggactggaagcagaactggaaggttatgaccatgacccagggagacaagaaggggacaccccctgccatctccagaaggaaccagccctgtggacaccctgcctgtaaaccagtgaggttgattttggacttctggcctccagagctgtcagagaataaatttgtgttgttttaaatccctcagcttgtggctacttgttataacaaaaatagaaaattaatacagttgggaaatataagtttacctaaaaatattccttcgcagccgggggcggtggctcatgcctgtaatcccggcactttgggaggctgaggtgggcggatcacctgaggtcaggagttcgagaccagcctggttaatatggtgaaaccccgtctctactaaaaacacaaaaaatagctgggcgtggtggcacatgcctgtaatcccagctacttgggaggctgaggcaggagaattgcttgagcccgggaggcgaaggttgcagtgagctgagatcatgccattgtactccagcctgggcaacaagagtgaaactctgtctcaaaaaaaaaaaaaaaaattcttcacttctgacaggattctgcatttgatctattatgtaagacacttactatacatatagacagggtctcgctctgttgcccaggctggagtgcagtggtgcgatcatagctcactgtaaccttgaactccagggctcaagcagtcctcctgcctcagtctcccaagtagttagtactacaggcatgcaccaccacacctggctaatttttttttctttttagaattttttttttttttttttggatctcactttgttgcccaggctggtctgaactcctgacctcaagtgatccttgacctcctttgccttggcctcccaaagtgctaggattacaggagcgagccactgtgcctggcctgtttaaaataattctaatggcaaaggattcaattaacaagtctcaaaatggatgtaagttttgcacaggtattcacatggctgaagtaccaaacatggtatcatgaattaagtgcgtaacatctgacaacggtaacacatgctatttttgtattattgtgaactcatggattcaaaatatatttgatgtgttttggtccattgcaattattattttatggagcaaattgtccatgtatcagtcttgctggcctgaagtcaaggtgtcaggcaggctggttccttctgggggatccaggggaatattggtttcttgcctccttggttcacggttgctttactttaatctctgcttccaggcatcacgttgcccaaagtaaatgaggtggggatgtataatcctccaactgggagggacagtcatgtcttaacccattatgcaatctactgtgtctcaagtgtttctgacttgagaagttggtggattgtggttgcaatggtgatgtagagatgattgggagacaacagatttagtgggtaaattaaaatcagatttagattaactgtaaaatgcctaacagacattcaaagcatccatcaagttggaagttgggtaaggaggactggagctcagtggagaaaatggaactagagttaaagatgtggaattattgacttttagatggtattgaagtgatgggactcaacataaggaaaggagccagcaaagacagtgaggagcaatctttgaggcaggaggagtggtatcatggaaagagggaagagagtgcttcaggaaggaggaatgttcatctctatcaaaatcctactgaaggatcagtaaagaaataatgggattgataagatcaaagtcatcaatgatcttgacaagggcagccccaaggaagctgtgggtacagaagcttagttggagtggggggaggagagactaagggcacagaaggggaggaagccatctagacaatgctttcaaggaaacttactgggaaggaatgaagaaaaataaggcaatggccaaatccaaggagtttgccttttttcctttaagatggaagacactggaatatgtatgctgataggaatgatccagtagaaatggagaaatcaatgcaacaggaaggaacaataattgagaataatgagtaaggacaaggagcaaaactaacaagattggctttagataggtaaagaatccctctgtctctctctttctcatcacaatcatcagttcattagtatatgttattaatacacttttggtttctaagcagcctgcctttgttctcagcatattgtctacatgttctcatgttgtgctttatccacaaagtcttagcctaggggacagaaagggacagtaagtagggttagtgaataacggcacttgtctgaaatgtagctgacctggttttaactctgactcaattgcttagcagcaccttgggtacattatttacctctctaagcttttatttcctaatcagtaatataagaatggtatttatttctatccttatgtgattgttggagggcttgtacaagacagtatataaaaagtactaagcatagtgcctgagacacaggaaactaaaaactattgtaaattataataatagtaatgattgtgtaactcttgtatgtcaatatacatgtataatatatttttcttgtgcagtgacaaagttattgtcaggctaatgactgcaatgactatgtctttgtggtacctacattattggtgaaagaactgaacaccagccagatatttatgtatttattgagtagtcttctattttttttccagaggggtaaagattataagcggttccttaggcaacaaattataatggctgtcattcactaaatcttgtatatagggtgggacagaattgaaaaaacaataggaaggtcttgtaactccaacatatctgttctcctgaggtttgcatgtgtacatcttatagcacattgatattcagaagtttcctattggaatgcaactatcagacaataaaaccactacattaaaaatgtacagaatgcagataaagaactacttagaggaagatttatagctttaaatgcgttcattgaaaacatgtgaactaaactaataacttaagaagttaaaagaaaacaacaaggaacaaagtctcaacccaaagaaaatagaaggaagtccataatcaaaatatgagcataaatcaatgaactagaaaacaacaaaaatcagaaatgatcaacaaagaaaaagttggtgctttcaaaagataaataaaatagataaacccatagcacgactaatcaagaacaacttttccaggcaagctaggagtagaaggaaatatcttcaacccaataaaggatatctatgaaaactctaaagcaaaacctcacacttaattttgaaacattagctgcattcctgcagaatcaagaacaagaaaaggatgcttactctttctgcttcctttttgtactagagattttagccaatgtaataagaaaagaaaatgagaagtcagacaaaaggattaaaaagaaagagaatggactgatattatttgcataaaacataattatcagcataggaaatcaaagaaattccacatgtaaaccaataaaactaattagaaagtccagaaggatcattgattacaacgctggcattaaaaaaaaaaaaaggtgctcctatacatgagcaacaccaaaacaaatgtacgtaaatagcaaaaagatactcttctctgcacaaaatcataaaatgttactgaaggacagagaaaataaaatcaacagagagatacaacacattcatatatgagacaaattgatgttgtaataatgttggtatgttctaaattaatgtatacatttaatgcaattccagaaaaatccaaatagcattttctcatcaaatcagactaattctaaaattaatatgaaaaagtaagttataaaaatgtattatatggtaaaaggaatttgagtaagaaaaaaagacaaaaaagagaataaaaagaagtaatatataaaaaagagaaaaaaacaaagagtgtgatttagagttataataattaaaatagtgaagcataagctagacaaatggatcagaatagatccaagcacctatactactgaggagcatgatagaagtgacattatgaatcagtgggaaaaagggagcagtgcagcaggcacaacatccctttgctaaccccttggagggatgtaatcagctgtgggacaggattattttaccagggtcccactgagataccgattctgttgagccacctctcattgtagaatctggctcaacacaccctctgatgattgatttggcttctcaagtacctggaaaggaggtactctaggaaggagatgtccgattcttattgcttggaaaaaaaatactcactattataaatttgtaaatgaacagtctcgtttgcaggttgtattttagggcatagcctagttactactgatacgtgagtgagtgtgcatcagatgatttccagccctgagggcaaactgagattgaggtcttaagggaatggagagggggctgaacatgaggatgaggatgccagggtggacactaggtgctaaaagggaaaccgagaagatctcacgtgtaaaatctgtattgcaccatttccccaccaacccttcaggaacatctgccttgaggcgtgatttaagcagtttcaatccttacagtttctcttgtgggtgtgggtgagaaatgggacaaggataaagggaatggaatttacagtcaactaacaaggctgtggttagttattagctaagtcaatgaaaactattcagatttatctgcttatcttcctcttcacacccagatatgtgcgtggagtcagcttgcagtacctatcaatgactgctcattttccaactaatttttaaatcagttagtggagcacaattctgcctgccacctagataaaccatactgtgggaatgagggggagggaggaagaagaaggaggaggaggaggaggaagaggaggaggaggaagaggaggaggaggaagaggaggaggaggaagaggaggaggaggaagaggaggaggaggaagaggaggaggaggaagaggaggaggaggaggaagaggaggaggaggaggaagaggaggaggaggaagaggaggaggaagggagggagggaaggaagaaggaagggaggaaggaaggaaggaaagaaggaaggaagggagggagggagggaggggggaaaggaagaaggaaggagggagggaggaaggaaggagggagggagggaaggaggaaggagggagggaggaaggaaggaaagagggagggaaggaagggaagaagggaagaaagttagttaataatgtcaaaaattgggaaatatttttgagaatgaagaagaaatgataggaaaatgtgttttctctctctagtaagaaaatagatgcagacatcaaaatacattgatgtagcttacaaattagaaaaaagttttatgagagcatttggtgcaaaggatataccaacggtaggactagctgggacaaactttatggaaagcaattagatattacataccagtgtttaaaaccagtgactcatggatctcaggttaagaaaatcttcatgcacaaagtgtgggaaaacctctgcgcagaaatgctaactgtagcagcataactcaaagtagctaaaatatagaaaacacgctaagtatttgacaataagaatggtttagtaaattataatatgtatataagagcactattaagcagccataaaaatgatatttataaaggattaataacatggagatgtttttccttatgttaaatgaaaaaagtagaaatctggataaatagaagtagagaaataagccaggcacagtggctcttgcctgtaatcatggcactttgggaggctgaggcaggcagatcgcttgagcccaggagtttgagaccagcctgggcaacatagtgagaccctgtttctaaaaaaaaaaaaaaaaaaaattagccacctgtggttgcgcacacctgtagtcccagctacttcggaggctgaggtgagaggatcacttgagcctgagaggtagaggctacggtgagctgaaatcacaccactgcactccagcttgggcaacagagtgagaatgctaaaaaaaagaaaaagaagaaaaagtagagacataggaaaaatatagagagagaatgtaatagcaaacatataaaaaatacacagtgaaaaaaaccaagagaatgacaatataaagagagtaggctttctccctgatagttctagcttttgtgcccaaatttctgtgaagcacttcaaaatgtgtcttggaaagccagcaaacctcacaccctgcttccatttcttaacaaaacgttttgaaaaggcaattatttaaggatctgtttctaataaagcttccgatgtggccatgatgtttaatggaattgctggcaaagcccatgagggcatgcgtgttgaaaccatagagtaaccatggcaaagggcctctcttctccaatgtgcaggacactgggttacctggcaccgctgggcttcacctgttcttggagcatcacaagtttttacccctggagaagcgctatttgccaagggaatctttcaccatttcaaatacatccactgaagtttttgaaagcagtgcaccaagtaggaattctttggtagtgacagtgaggatgtaatgaccgagcggaggggccggctggacccttctcctgcacaccacaggagaagccaattcctggaggtagataatttctgttttcttttgttccaaacctcagtcagtttgaccatctccttaatatgtgattcatcaaaataccaatttatcagaagtggcttctttggctaaacaatgggctaagcacccatgttgaatccatcaagagaaggttttaggctgggcacggtggttcacacactttggaatccccacactttggaaggccaaggcaggcggatcgcctgaggtcaggagttcaagaccagcctggccaacagggtgaaaccccgtctctactaaaatacaaaaattagcctggcgtggtgggcgcctgtaatcctggctactcaggaggctgaggcaggagaatcgcttgagcccaggaagaggaggttgcagtgaactgagattgtgccactgcactccagcctgggtgacagagtgagactctgcctcgaaaataaataataaataaataaataaataaataaataaataaagagaaagccttgaggaagataaaatacaggaaattttccagcctttacaaattgaacctgattttgagaatgatccagtggcccgatttattttgagaatggacagtaaattgtaccgctggcacagcagtatttgtgtcctgtagcgtttaatgacctcgttggttgtgaaaataaaaccgaaagatgctgtctaaagctatatatactttctgttgtcgttttccaacttaagtatccttgatgtaaacaatgacaggtgtccataaccataattgtgggaaacatttgcattaattcacatcaaaggaaacccattgtaaacatcagaacatggtgatcgtctgatcattgcgtattacctgctttacacagtagcatccctggcctcctgcacttttttaaatggcacaggacttaataacacaatttgacataaaaggattttttttacaatgacaatttttaaagttacagcaagatatttaaaaacaacttttcattgaccctgtaagactcactcataagtatccctagtgtaccacttaacctagggctgccatatcaaagtactacaaacttgagtggctggaaactccagaatttatttatttatttatttatttatttattcattttttgagacggggttttgctctgttgcccaggctggagtgtactggtacaaaagtagctcattgtagcctcaaactcctgagctcaagtgatcctcccatcccagccttccaagtagctgggactataggtgtgtgccaccacacctggctaatattttttttttttttttttttttgagacagggtcttgcttcatcatcccagctggagcgcagtggcacaatcttggctcactgcaacttccacctcctgggttcaagcgattctcgtgccttagcctcccgagtagttgggattacaagcctgcctggttaccttttgtatttttttttttagtagagatgaggttttgccatgttggccaggctgatctcaaactcctgacctcaagtgatctgcctgccttggctccccgaagtgctgggattacaggcacgagccaccacgaccaggctcacccggctaatttttttacactttgtagaggtgagggtcttgctgtgttgcccaggctggtctcaaactcctgggctcaaataattgtcctaccttggccttccaaagtgctaggtttataggcatgagccaccacacccagaccaccagaaatttattgtgtcacagttctgggccaggagcctgaaattgaggtgtctgcagggctatgttccctatgaaatctgtaggggagaatccttccttgcctcttcctagcttctagtggttggctgactatctttgacataccttggcttgcagtggcctgacaccaatctctgctttcatagtcactcggcactttcctgtgaatctctgtcttcacatggccatcttctcataaggacaccagtcatattggattgaggggcccctgtacttcagtatgactttatttatttatttttttgagacagagtctcactctgtcacccaggctggagtgcagtggtacaatcttggctcactgcaacctcctcctcccaggttcaagagattctcttatcttagcctcccgatttgctaggattacaggcatgcaacactacccctggctatttttttgcatttttagtagagatggggtttcaccatatgggctaggctggtcttgagctcctggcctcaagtgatctgcctgcctcagcctcccaaagtgctgggattacaggcatcagcagccgtgcctggcctatatgacttcatcttaactaattacatttgcagtgaccctatttccaagtcacattctgagattaggacttctggaggttaggacttcaacttatctttttggtggtgatacaattcaacccattacaactggggttcattgattttgggttaagaacgtgttgagacagtcagagggcagcaaggggaccctgagaccagagggtatgaaacaagagtgcagagaaggaagtggtagggagacaaatggaacccatgttgctattttgcccataaatttggtggcaatgatctctccctgcagatttgggtgcaggaacttgagttactgatggcaatatttggccagtttccagctgaagatgctcaagttccagatttgagtcgaggctacaaatgctcaagttccagatttgagtcgaggctgcaaagggaagtttgtggtggtgtccaggacactctgctgatgccatgtgtttgaaaatgtctgaattttgtgcatagacacactagcagtattttcataagtggagttacataattagggcatggacttgcataataattagcatgtgtaattaggcacagacttcttgtcctttagacaatcaagacatctaattacaaaattaagatgtaattatgtggtccaaggtctacatctttttttctacccattagagattacttttagaaaataattcaaaaaagctgatgaagaaatgaacatagacacgaatttgaggatgttaaagaaagtgttaagtgggctggtaagtttcctttggtctttcctctctgttgtaaggggaattatttaaaacattatggtccacttgaaagaataacttttaccaactgtgctgtcaaccttcggtactcacactaatgaagaggagtgttggtatgactaatccttggcgttcacgtgtggctcttgagtgtggtttgtaatcacacttgaacatggacctaaatgtgacgtactgggaattcattcaaacctattaatggagccatacggtggaaatcttaggataacttgggatagaggacatcctgccttcccgttctgccctggttctcccttgtgaccactttaaaaatcgactcatttggccaggtgtggtggcttatgcctttaatcccagcactttgggaggccaaggcaggaggaccgcttgaggccaggagttaagaccaacctggacaatatagggagaccctgtctctacaaagaatctgaaatactagttgggagtggtggcacatacctgtagtcccagctacttgggaagctgaggcaggagaatcacttgagcccaggagttttaggctgcagtgagcctccactgcactccagcctgggtgacagaaataaataaagaaataaatagcacattgctcagaataatgcaaaccagcacttaagctgtgtttcctttccctgaatatttgagtatttttattttaagtactccttattgactgcaggtgggaaagatcaaagagtatagcaaatactctgtcctttgaaaaagagtgattcttatagcagtaatagtttgagtttcaatacacacagaaagctagattgtactgatagtctccatgtttttccttgcccttaaattgtgatttggctgatctctgcgtgatgctaaacaaccagtttgactcattaattttgctgaactaactgaacttttgacctaattggctgctggttagggatcagagccatatgtgcaggtttttctaagccagttctgactttagctgtgttatccctctgttcctataaactgttgaaataccatagtaattccaatgttttgacagccacactgcacttctcagactgccgctttctcctgggaagtggcacagaaatctgtcggaccacgcttcctgatttttggttaagaaaatatgcttcccatatggttgcgggccgagaaaacaaagacttaaagaggttgtaagcatttggtgataggtcttctcctcatggcgccttccctccgttcctatttttactattctctgtaaggccagggaatgtgatgagggacaaattatgtgtgtggcagggaggggttagtcttgaccatgaaaatacacacatttgcacagggagcttttgccattgttagtttttttaccttgccttctgagcaattgctcgtgatagatttagaggcaaaggaaaggaattggagagagtggcatttttaaaacaatctattaagaggaattctaggtcagagaggggcagttggactacatcatctgtaaggcatctccagctcagaggtttcaggattcgttgatctccagcaggtcactcaacaggaggttgactggactcctattctactcactcaactctaggcctccaattttttggttcttagatgtggtgactggaaacctattcttttgcctttacttccagagagctcagtaattctagttcctaatagagcctaaagcatgagtgcaacttcatttctcagcttttgaaatctgcttttccctccaggtactccacatcagcattctcaagactggagaagttaggcctcagacatcccaagccttctcctttcattggaaacttgacatttttccgccaggtaagggctgtcttccattggcttccatcataaaatatgctgagggccaggcacagtggctcatggctgtaatcccagcactttgggaggccgaagcgtgtggatcacctgaggtcaggagttcgagaccagcctgaccaacatggtgaaaccccgtctctactaaatacaaaaaattagctgggcatggtggctcatgcctgtaatcccagctacttgggaggctgaggcaggagaatcacttgaacccaggaggtggaggttgcactgagccgagattgcaccattgcactttagcctgggcaacaagagcaaaaatctgtctcaaaaaataaaataaaatgaaataaaataaagtaaaatatgctgagcccaggacaggctttctgcatgaaacattggtcttgtccaggtccccacaccttgagcagtaaaggtgttctgtgatgccatgagccctcctctacttatatgaattgttatgtgatggcaagaatccatctcttatcactatcaatatgtattgagtcctgtcatccattcactcacccatttcccccaaaccccatatattgtatgtctaaatacgtcagaccctagagtgtagaagaagaggttacttgtgccctcaagtgcactgtcaaatgatggcatgcaacaccagatgagatacaccctagcactaaatagggtggtatagacggtagctgtaatcttctgtcagaggagagggtgatctgtcagggctaaaatcatcctaaggaacttcctgaagaaggaggtccttcagggcctgtggacatagagacgagggtacacacaccaggtgggtggcactatttatgtgagtgtaccaacgtgagaatgacagcacaggttgaccagcagcctggactgactagaggccaaatgctaaggtgcactgggcaatgcagttgggtgagagaaaggggcactagatgcttacagggtaggaaggcacgtgaagaactatttgtgtgttaacatttttgaggacagggacattgaaatggacaacactctgcaagggagaagaacataggttagagctgtagaacccaactgttgctgaagtccaggggtgaagccacgatggctcggtctggtcggtgatgagagtgaatagagatggataattgggagcaaaatgaagaactcttgtgacaaattagtgtagagaattcaaggcaaagtgagtcaaacataagcctaagctttgagccaggggaacagggagaatggctatgggttgacagaaataaaacgttgggtgggggagtggttcagggagaagacaagttttattttaagtatgttgcttgggatttgccagagtgacatgccagtggaaatggccaacagacatttgtagatataggtcaggactttatggtctacggttattttttctcacattgggttttctcagaagccagatggcttattctgctaagtcacggggacactgactccagacccaacgccaggagccggaacaccctgcatgggaagaaccaccaagccaaacaaaggcaggaagactaaatttgggacaatcctgataatatcccttcaacatctctagaatttcccccatccctacctccggaaaggctggcccttggcactagatagaaaagaaagctgctctttctgtccttttctgcccccaccttctcaattatttcttttccattcctttctgtgtccatcaccttttccatgatttgtcattgttgtttctgtcttcctagcatttttaaacaccttctcctctcatctctctctctggggtgggcggttcacaacttttaagctcacaaacaacagtctcaatgaggcttcctgttagccccttgaaacaagtgtgaagaaattttaaagtgtcaagatagaacaacaaaccagatcggaaagctaaagaaaatgcatttcacacatttctggggggaaatgatcagttgtattccgtggaataattaatttggtattaacattctgaggaaaacggcgtagctgtcgacatgaggagaacgctgtgctcccgcctctggagagcctccacatatgctcctttgcagcccgccatcctcacagctacaagccctgccaagttctttctagaacatagtaatttcgctgactatttttatattcatatatactttccttgatatatggcaagcttacgctgcagaattcagtagatttcatgagaaaggcatgtgtttccatgcaggacatccacactcctaacccccaactttccaccttcattccaccccttatgtatccaccccatactccattctcacaacacaaatctaccatttgccaccccccacacccaccccaactcatgagtattttcaggtctagtccattcccaccacacaatggatctagcattttccacccctccgtcaacccagctacacttctttcccattataaaatgtgtctagccaggcacagtggctcatacctgtaatcccagcactttgggaggccaaggcaggcagatgacctgaggtcaggagttccagaccagcctggccaacatggtgaaatcctgtctttattaaaaatacaaaaattagctgggtgtggtggcacatgcctgtaatcccagctactcaggaggctgagacaggagaatcgcttgaatccgggaggtggaggttgcaacgagctgagatcacaccactgcactccagcctgggtggcagagcaaaactctgtctcgaaaaaacaaacaaaacaacaacaacaacaaagtgtctagcattttgtcttatatatcttaaacatgttgaatttaattaaagtttaactcgaatggatcatgataattcagaatttgtgataattttgatagactcagtagaagttacatatagtggcagtaaaaagggctatatgataatgctaaatcaaatttcagagggcaatgttatagttgagaaagcaaactttttgaatattttagcagcaagtatacataagtagtttaagaactggtgatctctcctgtccaagacttttacatggcaattttttttaaagccttttgtttattccaatgtttcaaagtacctgaaagcaatataacttccattcttttttattgtttctgtaattgtattcttgctgttccaaattgtttactgaataagtttgaataattggaattttgcttaatcttattcttactatagtgctgtgtttccttcagggtttttgggaaagccaaatggagctcagaaagctgtatggacctctgtgtgggtaagaaggaaactcaacgtttctattatgtacgatattttctattatgtacgatattttgattttcacgtgttgaactgatatagaagaaatgccaagattaggaatgttgtatgtgtttctatttttcaaagggcccacaaagagggagtcctgcagtacagacaaggcttctagagaagaccctggggttgcccacggggggactctgctggcctgaaagagtaccactttccagcctttgcagccttgctgggctgggcacagcatcatctcccgttgctgtgctgaggggtgttgccacgggatgtggtggcctctttgcctcagagcacaaactgtccaacttgccttgacagtgcacagcaggtcttaccccatgagcatatctgaaccttactcagactcgggtccttcagcccatggggaaagtgtgctgccagcaacatgaccgtgtaatttatcacccaatccagttcccttttgaaagtgaaaggaagtgctattaataattaccccaggataaccttatcacctaagactatcccggatatgctggggcatatggtcaccctagttcttggccgtgtaaagtaatatagcccttctctttattttctgaatttctcctttgtatgctcctttgtttctaaaattccagattctggtgagcaaacccacgttcagaccacttactctattcaagatttaacaggcttgaattgtattgattctcaacatgtgtctttccacactgaagtcctaatcattttagttggttttcacgcagcttctcttcagccactgagcgatttttttgcagcttttcgtagacctctgggtcagcgatcacttttgtaggtgcattaaagttctcctgtgttgccgacgtacattccaatgggctccagtgatttgggggtcctatctccatagtattcatgatgtctgttctcctgatacccatttttgaaagggattggcttgtcctctttatggaaatggcccctcctaggaagcccacagttttggtcaagttcttctacctactttttggtttgctacgtggtcctgaaaaagtaataaattaagatgttaagatgctctctgtattagtcattgctgcataatggactaccccaaaactcagtgacataagcaacaatttatgatttatcatgtgtctaagggtcagctggagttggctggcctaagctgcacttggctggatggctccgctggacttctgggtgtatctgctggggaggacctcatgtggggcaccaaggctctgcatgtctctcatcctctttggaagtgtaagctcggctggcaggttctcatggtaagggcaaagactcaagagagcaagcctgatggtgcaagaacattatacatttctgctgaatcatttcagcttataccctattggttaaaccaagtcacacggctaaacccaagatgtgggcaggagggcactgtggccactttgaggccaaagcaagacacctggcccagcctgacattgatggagcagggaggtgtactcctcggatggacgagcggggaggcaaggcgtgtctttaaataacaagcaaccctgcttcactccctaagatctctttcaacttggccttcacttactttttcatttttgctttttggtgcatagcttcttgctttaagcgtgataggtgctcgataaaggctcaagaaattgaactgtctacatttctcttaccgttgtgtggttctattgctttttgtttttgttttttgttgttgttgttgtttgtttgttttgcaatagagtcttgctctgtcgcccaggctggagtgcagtggcatgatctcagctcactgcaacctctgcctcctgagctcaagcgatgctcctgcctcagcctcctgggcagctgggattacaggcgcccgccaccatgcctggctaatttttgtattcttagtagagacgggattttgccatgttagccaggctagtctcaaactcctgacctcaagtgatccacccatcttggcctcccaaagtgctgggattacaagtatgagccactgcacccagtctattgctttttttttttttttttttgagacggagtctcgctctgtcgcccaggctggagtgcagtggcgcgatctcggctcaccagtctattgctttttaaaggttctcattccagctctttctttcaaacagtctcattctgcagctgagttggcaatgacttggagactgtctcatatgcctctgagacacagcactgactcagaatgacagtgccttcaccagaatcagaaaaagtcctgactgagtttgaattctaggaaccacttttcttgagtgtttcttgtacagatatccaaagtagagcctttgggtatttaaaaataatttgtaaatgccaaattaagagtttaaagggcactgtatgaactagttgtgtgtgtgtgagagagagagagagagagagaaggagagagagagagagaatgacagagaaaaagagagagagagaaaaggagagagaaagagacagagaaagagatagaaagagatagagagagatagaagagggggagagagagagagagaggagagagagaggtggagcgaattggtttccttgacaacaggatatccaatcaactttttcctccaactttaactgagttaacacaatttatccttttcatttcaagaaaacctaaatcatagagaatgatttcaaatgaggttatagagatcaagattgcagtatcatctccattctttgttcccacttctagtgaaaaggaaaaaagaaaggtgatggcataatttcttcctataaagctatcaacttttctcctttggaaaaaaaaagatgagccataaaacactgacttctttttaaatgtgtctactcccagatttagaggcaatatggtggcggtgtaaaaatgaaagggttgaaccaatctaaatcgaatgtcttttctaactctaaatgttattttcttactgcttaaattttagcaacatagtttcactcattgggaatggactatgctcaatgaacagcaaagacccttcttgcagagaacaatttaatttaaattacattagtttttattttattttttattttacttttattactaggaaatataatcaatcccagcttggtcttcttaaaaattgaaataatagattgattcattatttgacaagtgaaatgccacactctacactgttgatgccgtgtagagatgtattgggcctttagatgacagcttggcactgaatgttgggagaaaaatggacagggcaaatctcctcactgctcgagactggaaagccaactatgatggcaatgtatatttattatctggttgtcaccctagcaattcaagagtttgaggctcaaaactggaaattgactccttactcaattcccctcccactccctaccatggggacaatagggctggagaaggtttccatcaagatgggcagacaacatcaatgtttatcattaccaccaacactgccaccaccaccaccatcaccaccaccatcatcgagaacaaaatatcttcaccaagtgtctacttatgtagcctgctttgccaggttctgtgtaaataaaactacacacggtgtctctgccttctttgaacttgaatgtaaagcaggaggactggcgtggatacctatacagctattagtcgtggtggtacgtgataaaaaactctcctgaattgcacagcaacctggccatgtaacacaaagaaggcaaggctttattgctttagataaccttcatcaattaatgattacttgttatctccttcaggctgagaatgagccccaagttggatttatattccttcccaaactctgtaagaacagaatcaacattatcgtcatacattggtgattgaatatggtttatattcaatatataccaatattgaatataaatatatattgatatatattcaatatatcctgtttggatagagattatatcccctccaatttgtagctggactttgtaacccagtagatgataaacctttattaattacttatagttaagtaagaataaatatttacacagtgccctaagttcaggtcattagcaactcctaaaggccgccattcaaagctccttttccctttatctcattttgtgtgtgtgtgtgtgtgtgtgtgtgtgtgtgtgtgtgtgtgtgttttgttttgttttgccttttgaggcagagtcttgctctgtcatgcaggctggagtgcagtggcacgatctcagctcatggcaacctccacctccgaggttcaagtgattctctggtgcctcagccaaccaagttgctgggaatacaggcatgtgccatcacgcccagcaaatttttgtatttttggtaaagacggggcttcaacatgtcggccaggctggtctcaactcctgacctcaagtgatccaactccctcggcctgccaaaatgtgggaattacaggcgtgagtcaccatatccagcctatctcattgtcttttaaatgcttgctctatagttctgcttttacttagccttatccccgtttcttcttcccccaacatcactttagttttgatcttggctccctcttgttgaacttgacttttacacttcctggcatccatcagctatgccgctccattttggtaagtggcacctgcatccctggatcccttcatgatgccagccttgttgcataacctcatatactcccatcagagcatcaagttgtaggtaggtaagcatgaactttgtacataattcataaagtacaaatgagtataagaaaaaagtacacttgctcccaccctggggcccatctgctccttcacagaggcaacctctcttaaaaatttctttatagtcaaatggatcatatatgatacatgctgttctttaccttgctttgttcattaatggtatttgggaaattgtcccattttgcttcattcattcttgttaaattaggtagtgtttttaaggatttccttgtatgaatgtatcctaatttttaaaacaagttctcaattgataaacatctcttacttttacaaacaccatcgcagtgaagattttcatatacacatcattgatgtctggggtaagtatgcaagataaattcctagaaatggaattattaggtcaaagatggtctatgtttttaatttcgataaatatgactaaatttctctttctagggtttatgtcagtttagattcccataaatatgcatatgtccctcccatacttgtcattaaaatgtgtggtcacaattttaaatctttaccatttgatggtatattgctgcagtttcgatgtgcatttctctaattatgagcaagtttgagcatcttttcatatgtttaaaatgcaatgtattttgttttctgagggatcctttgccacttctctgttgggttattgatcttttcccactttatttgtagaagctctttgcatattaaagaaagtagccttttatatgccttaaatagtttctcctctttatcattgtctttgactttgcttatcatatatttcttccaatcagaaaacatttgtttttgtgttgttgactttaattgattttaacagtgtctacattttgcatcttactcagaaaggttttctccaccaaggatattttttcataaactttcatttttctagtttctttaaattttatttttaaaatatagaatgtttgatatatcaggaatttatttggaagatggagttagggacacaccctttttccccccctccaggagggtagagttccatctggaaattcatccttttccaaatgatttgaaatgtcacttttatcatttattaattcctaggtgtatttctgatttctctattctgttgtactgcttaatcacaagccagggctgcactgaatatcctcgtttggatgtcacgtttgtagcttcttgtacctagctgcagtagggtgttctaagaacatctttgtaagtatcaaagcctgaagcaatctatctcccagggaaccttaggtcccatactgaaaaaaaaaatcaatttagcaaataaataagcctttggtataaagggcctgacacttagcttcaaagttcacaccacaggagggggaggtgtctcatatgcctccaagttggaggtttttagcaccatttttaaaatttaattagctagcatgcatgaactaatagcaccttgtcaccaggcagtgaggaagttgagaactttgggatacataaggaaaagcatgtggcatcagcaatcaaaataacaaggtcgtttcaacactttttaaagctcagcttccatggtgccatccattaggagagtctgtgttctggaagtgactaaggtgtgaacacttttcgtgtaattgctcttaaccatcatgtttatgtactatttagatggggttgaagaacagcatagagatggtttactttaatactggcagatggctatgtgagacttcctggcctaccatcatggatcaagaacaacgggaattgaagggctctgaaagactcacctgttggacatgtttgttctttgacttagaagatatgagacatctgaatacactgggcttgaacatgtggctgaggatagggtagggtggaaactattgctgatttgtccaagaaaagacaagtacttagacttaaattgggcagctgacacctggagatggcacttgtttttaaactggactgagctcagtagaatcatagatgttgaagaaaggtggaaattaagccaccgttgtggaagagcttcccagacactgatgctaaggagtcaaactttaggtttttgctgctgataaaagtgcaagcctcagtatgaggctcatttactaaatgtttgacccaaaaatgtggctcaattctaagaggaattgatgaaaatgaaaatatacatagtatattgagaaaacacaatacccttgaaacagtggaattaagcacagaagtcctgaattattctaacatctctggccatgaggccaaactgtgggcaatatttgggtcccctagcttggtgaaagctggctttcatgaaagcgttgaaagcaaagctgtgcattgccgttcccaataatgtgaatctgaaagcaaaattcatgtgagaccatcatgatggtctgtaggtcataattattgagcatcattcagtgagtgaaatatcaatattctcactggtcaaaatagcttaatcatgaacactaagcctgtaagagcaccttttttaaatgattggaattcactaaactgcattattgcattttaggggggccattattctctaaaagtgaatgccctgacatagtgtgctgatgttttaggaggcctttgagaataggaagaaagttgtccacaggacaactatcaccaagccaagcacactgcccagtaggtggaattatcaaaggaacaattgtccacagataaataagtggcttagaccaaagagacagaggaatttgatttgagtcccacttttcttgaatgaaccattaatagactcttcacccttacctgccaccagcatgatctcgttataccaaatagtgtattgctacaaagcttccatgctttcttatgatttaagaccaccttctttcccagtcttgatccaaagacccttctgaagtttacctaattttctggacttctaacttcttctttcagcccatttattttataccagttcatttccccccatcctctttctataacagcatatgggtgatggttgctgcatattttaatgactactgctatctaagtctttgtgacccaccctcataaagatcaagaacctgtattaattccctcttctttgggtagaaacatccaacagggcatgatagcttacagtagaaatctgcagttaaaatcccagcttcaactttctttctctctactgcttgttaccttaatggatttaggccaatcacttcccctctccagctttagttctcttagatgtaaaatgtgggatttggactaggtcggtgattttgacactgtttaatcatgaacctcagtaaataatatattaaccacattgttatctaatacacacacatacatttgaaataaaagttttacagaagaacaccttattcacagtataagaaccactttgatctattctattgtattgtattctatctgtaaaaaataaaacatttacaagttggtcacagcccattaaattgatttcatgaccactagtgagtcaaaatcagcaatttgagaagcaaagggccagatgatatctgaagtcctttccagttgtaaactggatgactacaagccaatgagacagcccctatcagtgtgcatcagaaaattgttagaggccattgtgtttgcctctttgtggtttaagattctgagaaacctctgtcaaagtcagtaaaagcccaccgttcacagctgaaaccgaactccagtggaagcacttctcctgcagagaccagctcccgcacctgactgtgggcccaggctgggcacctcccacccagtagcaccttcttgttctttaaaatcacaagttcaactattattgaaattatttccaagccttaactcggaatcatgctaagaagctaacacaaatatattaattgaccatttaagacatctctctgtaagatttttgcattgggtgtaaatatctaagtaattcatgtggatatcttctcccaggtaggtgtggccagctgattacttattcccagggagctggagcagcaggaaggaatggcctggaaactggaaataatcccatttgccggggtaagctagctgtggaaaactgaccaggctgtgggtaccgagagagcagcttcctgctaaacttcctgctgtgggtgaagggcagcgtttaaagagtaagatggtgctccccattccagcaaacactggccacagtggacagtccaggagagagctgtgcaccaggaaggtgtcagctggacagtagtcaagcgtccagtaaagcagcgatgaggaggctgtcagtggacaccagggccccactagtgggtggttcaggaacctgagaagcccccggccctgagaaaggagtctaggtagtacagcagggtctcagcggtgagggctctgaggatgaaccaggaattgacattcagttctaagattcacagcatcatgtgaggcccaggaccagaagccagacctaatctccgatatcagtcagggtggacaggtccatcatggttggaacagatccatgctggagaggcaccgagtctcacgatgtgtggctggaggttgttcctgcttctggggccagggctgggcctgcagatgagggacagagcacctggctagaaaggagagaggactgcagcggctggagcgtcagccacagatttttaattttgctttccttgatattcacatccaaaatctaccatggagaactgtatatcacgttcaaggtggaagggaactaactcattcctcattagtaactatcaaatatggcatcagtaccttctttatcctgtaagtgacagctctgcacagatgtgttcccaatcgatagaatgtctcaattaaagttgcataaaagctctattttgagctaatatcttcaaataataaattccacatttaattgaagcgtacctgcaacaaatccaagttgttcaacccaaaatgcataatagagtatgtaaaacagtcatgaatcactgtgacatttgtcaaggcattctcccatctggaagcaggtccagaaagcacatggctgtatgcatatatcttttgtcaagaactttgcacagacagtctcaaaaagtgcacacatttacccaattcttagggctcttcactctgattgagaatgcaaatagcattcctattctatctaaaaagaagaaagacaagccatctttgatttcaaaatttaaaagaaattattactaaatttgaagaagcaatgagttcccaattcacttagagcttaaagttcctctttcatcactattttgtgagcagaggaactttttccaaacaagttcttagaaatccttgcttgattaaaaaccagttctaaatcttgttactcacatagggcaaaaggtaaaggaatctaaatgtctaaaaccaaattaactccagatactagtgtgaactttcaagcaaaaaaagtcacacaccaccgcatacacgtttgaaattctactaaattttgaatgtttgacgttagcctttaaactggaacatattcttctttcttccttaggatctttaaatcttttaaagtttgggttgtttactatgcattctaattactcctgatcactcttatgtgtaacatttctatagctatgcacacaaagtaattccttagcaaggccccaccaagttttatgatgcctgcttgcctagggcagataatataaacttaactacgaaaataagttctttgattattcttcgtatctcaagaccgtgctcctaacaacctctcctccatctcaccctcaagctgcaagaattttgcaacccactctatgaagtttttccaccctgagtaaggctgtcagtttattggcctatttataaaggtctgactctctgacatgttctccaggctccccacattaaccactaaggaggcactctttgcagatgaatttttttttttttttttttttttttggcctcggcttaaagaggaacctattaacctttgcccggaatctatggctggtgaatggcttgtcatagcatgttagtttgatgaggcaattgtggtcttttttgttaaaacaccccccagcacctcttgatactacttggcctactggagatgtgggcatccaggattgaatcaaaactactgcacttcacaacagagctactgcaggaaggaaatccaggtactccctggcttgtgccacctccatcttttccgtggctaatgtaatgcctagtgcatattcaccacaaagaggcaactgttgaatggctcttccatttgcctttgaagattgcttgtaactcttcaagttcacttcttcatctcactgccagaccacagcttgagactgatgattgacatggccactaggttcttcccaaagactccagcctaaagattgttagctgcttcccccaaaggcttagccttctctgctagagttttggttctttggagcatcccatgagcaagaagcctcagctctttgtcctcctctgtgtaggagcccacaaggatgctttatctccaatctggaatggacacttagcatcctgagttctgccctgctcaaaatccatacctgttcatgagtaccagggcttcagggcccgagaacccacagctaacacccataggagaaaggtttcatatgagtaggtgggatgggttttcatgcctctacaacctggccagcaggaggaacactgtgacccatggtttcagaattgatggtctcccacttctcggttagatctaggtattgagaataacctgaaggacatttggctggaggacattatttttattgtgttaaaatatgcatcacacaaaatgtactctcctatttttcattgtatagatcagttgcattaagtaccttcacattgtcgtgcagctatcatcatcgttcacatccagaatttttttcatcttgcaaagctgaaactttgtcctcattaaacattaactctcccttccctcctcccccaggccctgacaaccaccattttaccttctgtctctacaaatttgactactctaagtacctcaataaagtggaatcatatggtatttttccttttgtaactggtttatttcacttaatataatatcctcaaggttaatccatgttgtagcacatgggagaactactgcctttttaaggctgagtaatattccattgtaagcctattctgccttttgtttattcgtttgtttgtagatggcggagtgtgttacttccagcattgagctaatgtgaataatgttacttgaatatggatgtggaaatacctctttgagaccctgcttttagttcttttgggtatatatgcagaggtggaattgccagatcacagagtaaatctatttttagctctttgaagaccgtcatactgttttccatagtgaccataccatttcacctttggaggacatcttatagcaatgctttgttgtccccttttcaccacgattatgtggccattacttcttgttttcaaaccttgagagtgagctcaggttaaatttacacttccctttgtgccctggatcccaactggtcaaggtgaaccacacatttctaattggaatgtatgaccccagtgactttgcctgtaacttccttttggctaggccagtaagcgcatttttaaccaaaccgaccccattatcaacaaatgcttgcactgcacgataaattcagtttgctttaataaattcccagtagtcctcacccagagctccttctcctcttatctcactccttgctgccaaaccctttacaatttatgtgtctgcctttcggttctgccttcagccccctccaagtttcctctttcccaccagctcactgtggcctttgtgtctcacataaattttgtcttctgtgtctgaaactcttactgacttctgcttccttgttccctgggtctacactgttccttctcttcctggaactgacccttcgatctctgggcttcctaccttgagtaatttgtcaaaatcctgttcttgcaattggtggcttctcaatttttttcctctgggtttttttcccacagtctttccactatatcacagggcatacactcctgcttcatgactgttcatgacatattgaattcccctcttgtaccccacagtctctgcactgagtgtgtgctcattgggaaaggttagctcacattatacctatccaaaaaaggagaggtggcaggtggcctgtggagaagagtgtatccaggcacatatgcatgggagaaagttcagaggttttggctgagatagaaagaagaagagtagaggccaaatgtgtgctaggaaaatgtgatgtttggggcacaagtagagaggacaaccttggcagtggcagatgagagagaacctcaggactggtgctaaggaggtgggttatttaaagaaagttgtgcaggtatagagtggagaaggggtgcagggggaggatggaattgagttaaaaaaaaaaactagcaaaaaacattctgatagcacaggtgagagagataagagtgatttagattatcagaaatggaaggaaaagaaggagaattttatagagaaagtgtcctgtagtggccgggtgtggtgactcgtgcctgtaattctagcacattgggaggccgaggtggggagattgcttgagcccaggagtttgagacagcctgggcaatatagtgaaaccacatctctacaaaaaataccaaaattagctgggtgtggtggcatgtgcgcctgttgtcccaagtactttggaggctgagataggaggatcgcttgagccaggaaggcagaggctgcagtgagctgagatcatgtcactgtaatcctgtcgaaaaaaaaggaaaaaaaaaaaagaaaagaaaatgtcctaaaaatgcagcaagtcattgattgtaacaagtaagagatgagtcaacattaatcactgaggctgacttcaaatgctggagacaacatggtgattccaccataattaagaggttgaacagggcaaagacaaaatagttttatctttttcttaatccgttggagcttgtcctcatcctcatgtgttcaagctgttataacaaagtgccatagactgggtggcttatgaataacagaaatttatttctcatagttgtggggactgggaagtccaagatcaaggaaccaacagattcattgtctggtgagggctcactttctggttcatagatggtgccttctcactgcaccctcccgtggtggaagaggtgaaagagctccctagggcctcctttataagagcactaatcctgttcaagagggctctgccctcatgacccatttgtcccccaaagaccccaccttctaatactgtcatctgggggtttaagatttcaacatatgaatctgttggggggatggatacaaacattcagaccatggcagagctgctaaggagacattgggtgcaaggtgacttaggaatgaagcactcagaggatcaggaagctgcattaggaaggagagaggaatgggagctccagggtaggcctggaatccggaatctccacctcccaccctccaacaatcgaatggggtgtttcccgcagtgtgtccttgagaccatcgtttccactgacagtaataattgttacatggggaatagcaaaaggaacacaggtctcttcagtgtagaaagactccgaacctttcatgcagcaatgtccttcgacaatctccaagtgagaaatttaggatgcagtcttttttttttttttttttttttgagacagagtctcgttttgtcgcccaggctggagtgctgtggcgcgatctccgctcactgcaagctccgccttccgggttcacaccattctcctgcctcagcctcccgagtagctgggactacaggcgcccgccactgcgcccggctaattttttgtatttttaggagagacggggtttcaccttgttagccaggatggtctcgatctcctgacctcgtgatccacccgcctcggcctcccaaagtgctgggattacaggcgtgagccaccgcgcccggccaggatgcagtctttatttgaccacagaacatttttccccccagagtatttcttgggactaggatatggagaacaggctttgagagaaaacactgatctaataaataccagcattttactcctaaagaattccccataaaagacaaccattaatagaaatagtttacttcaccattgtgaattatcaacattacaaccagtaattactaattacctccattttgagttgatgttttgggggatgtttttatcctgcagtgctatggagaggctgggaacgcactgctgcctgtgttgcttgtttatttatttccttttattcccagtgttctctcattccccttcccatccccaatagtcaaccattccaattgtgtttaatgtgtttttttttcacatgttcttgcaaattgtgcattatcatttcgtggatattatccttagtttatgccaatagtactgccgtagatctcattctattccttagttttttcatttagcactgtgctttcaaggtccagcacagagttcccattgagtctgctgcttcccatggctgcctgacatgccacggatgcctgtacctacttcacctgtccactgtcccaggaggagatacccagtggccctcagcaagcaaccctgcagtgggcatccttttatgggacctctacggacctgtgggagaactctatgggctatccatcttgccctatgattataatatatatatatttatttatttatatatatatatttgttccctaaggccacttacatattaattgctaataatctgaaagtgttttccagcactcagtgtggatcatgtccctccaatatagtatctcccatggccatcccaataacatccctgagagtttggccgggctagttgcattatcctcaatcatacagaaacatgagtgactagaatgaaaagggcgtgtggctagtaagaggtgtgagcagagttgcacaggttctttttattaatccaaagctctttccattccactgcctcttcttgctgtttcttcaacattccaaacagtcctgccttaggacgtttgccataacaatacgtaacataattatttgttggttgacctgctttcctggtagaatgcaaacttcacgagggtagggacttgctctcttgtttgtgctgctatttccagtgcctagaatggtgactgacacataatagatgctcagtaaatatctgttgcgtgaacagaagaatcatctctaagtacatgtctttcatgtcagatttgtctccaaggaaacttcaaacaggaaggtcttgctatttggctaatttgggtaatggtactattttactggagacaaataaaaggaattagggggagagtctcatattaaaatagagggttggataaggggagtttatactctttccccatcagtggcttttatgctctatcaattcagtagttagcccatcaaagtaaaaaattgaattacactgtgtaaggccaccttgggatccaaaagataaaagagaagataagggacatgttctcctgatacactagctgggctccactcacccaagtcattaattggagtcttattgggctactgcctcatatcctactcccgaagagctgatacctcccataacctcattcttagggtcagctggccgtaccagaaagagcactggattaggagccagatctgggttctggtcttagctcagctatccctactgatgggactagaatgaatgagtcatttatcattttcttccctttaaaaaatacttgaggccaggctcagtggctcaccgctgtaatcccagcactttgggaggccgaggcgggtggatcatgaggtcaggagttcgagaccagcctgaccaacatggcgaaaccccgtctgtactaaaaaaatacaaaaattagcctagtatggtgccgcgcacctgtaatcccagctactcaggaggctgaggcaggagaatagcttgaacctgggaggcggaggttgcagtgagctgagatcatgccactgcactccagcctgggcgacagagtgagactctgtctcagaaacaaaacaaacaacaacaacaacaacaaaacaaaacaaacaaaaaaacttgagcacctacctatctcacaggtctgacatgagactcaaaggagctctcagagccctcccagggcagactgtccaagtatcagggattccaactgggattccactgctccttggtgttcttgtagccagcctgcatcttggggagtctgccgaattcagaagccccatacctcaccagctcggggtgagcttcttgagtcctgcacatgggtcctctcaccctcatgtctccagggactcctccgcctgggtaaggggagacagcacacatcatccagtcctctcccctctttgggcctcattttcctagctatgaaatgagggggttgggctagaatgatcatcttgaagcttccctccatctctaaagtattatgatcagtgctttattattttttccctgcctctgatttctctcccactgtgtctgaaattcttttgccattaaattttctcttctttcagagttgcatatctgggctttttatacctagtcctggacagcacattcttcccatggcactgggcttcctcccctggcctcactgtcttttcaggagtgacattagctttttcccagaccgtgtattcctgttctaagcccacacatcatttggggagagatgattttgccatgtactctcacaaatatatgtcctgcacatattctatggaatagacacacacacacacacacacacacacacacacacacacacacacagctcccttcaatacccccgaatatacatgcctgggcataacgtgtgggcaaaaatattcagggacagccaaatgactattttaatgttcctttgtccctgcagggccatcgaactatttatttagtagcttgatgctgtttgcatcaacaactttgccttataggctgttcttcatgtttatgattcttactgtgaaaaaaattgcttgcctaacatctgttctgaatttgttttttctttatttttatttatctgttccccattgaattacatttgcaccaagaacagtaacttgaattgtaatcttcagtgtccttcaggatttctgcacacttcaatacatctcttaattactctttttttattgttatgagatatacatatatacccatgctcacactggcagattggtttgtagcttacctctgcctgtccccctctggggactaagttttattaactgaataaattagatgggtgggtatattcaatagagtagggaggtttatcattacaggtttctttcagatatttttcccccttgctgcccagttctctcctttagccatagctctgttttggagaaagctttattgtagcttgacagagtcataactcaccaggatgagaaggaccacttcatcttatagatgaagaagctgagggccaggggggaggctatcttcctgcctgcttccagaaagcgtggagaatagctgccccagcgccattcttgagaggtagagcacagcttgaccctgcctctccaggctgccaagcctgggggctttccttagcagcaggaggcctcctgggactaccgtgccaccacccacgcaccacaccattgctgcagacccagtcctttgcagagcaagcattttgcatgttttccatgggtgtggctgggttggggtggttagaaaagtgtgcagaagatggtgtgggagaagggcagggcatggagaatcacagtggggtctcttcatgcttgtggactctcctggtggagctggttctctggcctccctcaggctggctcgtgtgactggagccctcattaaccccctgctctcaccacttagaaaccaacccagggaccaaccaagcatattcccagcagtaggcaagaagatccctaaagaagggaagtgagacctgcgtttattcccctgatacttgggaaatctagcagatatagagacagtgacccaggtatccaagggattggtccaaattcaccatcctgtaactcgaaatgcaatgctctttctaccatcggttctccattctttctggaaggtgtgtcccccttcttccttttgccctttcccacactctttgggggtctatgtccatgtcttccaatggcacaaagtcagaggggatggtttccccatgtcttgaagtgctcactgctggccctgctccagatgttgtccactcaacagacatttcagtctttgctacgtgtacagcatggagctcatggcagtgggagagactacccatcccctccagaaaatgtatcattcatgtctcttttcccaaagaaagctgacatctaatttaggagaaaaacccagacatgggccaagttgctcaagaatgccaggtagtatagtggctgacttctacaagagaaggacaggacacccagaaagaaacccagaagaacaggaaacccagaaagaacaggaaacaggattctgggtagaatcatggaccagtgaaggcagagaaggcttctaggaggaagtaggtcttgaagaatgaataagggggaggtgagggcaaagaatgttccactcagtaaaaacagccagagaaaagcccttgaggtgggaatggttgggggaatggaagttgtggctggagagagggacacagatggattggccagtcatcatcacacactggaaagccttcgttgccaggcgaagacatgtttgttatccttttgttacccttgctaatggcctgtaagctgcttaaagccatgtcttgcaggtcagtttctagagatggggtttgaggggcaagatgtttactagggatcagtgaagggaaggaggagaaagctgtcagtcatcccccagtaggacaaaatgccacctctctgtgttcctactcagcccggccactggatgtgggctttaccaggaagggggtgaccccagtgacatggatctcagcagctgaggctggccctgaaggagctaacagctggaggctccctgctgaccacagtctcggctgctggacagcaagtccttcccagaagggggatctggacgacatgtcttgatgtcatcacatcatgggaactctagttcaaatgaagtttttggcagaatcaccaggttgaagtgggaggtgatctgagggttctgtatgctgagcttccccacagaggactctttgccccgctagacctgagactggctggggccagccacaaaggcaggcccatggctgatggagccaacagggcacctctgcagggggcacctctccagggtggtaggagtgaaatagagcaggccccaagttttagaaaatgaccaggggctgggtgaattttggaagcaagataaatgtggataaagagaaaaaaggattctgaggtttcaagtctggcttcagagttgaaagctccttctgccaggaggagtaatagggaagccaagaggataaaatgatttcccagtcctggaaaggcagcttaaaaccatccttccacttgctcttaagggtgaggcgctctgctagcttctcagggatgcacggacagataagatgggctttgtcttgagagaacttgcagagcgatcaggagcttatcaataaacagagggtgatgcaggtcagtagaggaaaggaccaggtgccacagaaactacaaggagcgaagggtccatgaagccttcacaaagaggggcaggtgacccgactgtctgaagttttccaaactaacaagagggcagccggcactttagagggtaaatacttgcaaagaggcagagcagggggaatactgcacatctggggaaccataaataactttttcacagcaagaatgaaaggctgtggttcccaaactgtgtgctgagacaccccagggtgccacagtgaactcacaggggcttcctgggctatggtattttacacattcgtgacaaatacagcaacatctgtcaggcactgtaggaactgctttcagtttatgtgtattatttcttcaaatgtccactaacttgctagaacatgtatacttataaagttgtttgaacttatctacttagaaatgagactgtggggttcttcttttggcctggggagcgctacgaagacattactgagtcactaagggcaccgtgaactgagaacgtttggaaacacaggtataagaggaatggggtgaggagagaagtcaggagctcctgaagggcccctgcttggttacaagtgaagaagcttaaacttgcttcaaatgatggagaaccactagagatttatagggaatagaacgacacagtcagcttctgttttacaaaggtgattggccttggcgggagggttggtttggagacagagagcttcactgggagctcctcagtggtccaggcgagagagacagggcctgaagccagttggcattagacgttggagctggaatacagcacactgcgttgacatcatggaattcccactgcatgcttaacaccataatgaacactagacatcaaagataagaagacaagatgtgtttccaccactcacaaacgagcagaaagacagtcaggaaaaaaattacaattactagagaaccactaggagtcaaccaggcaagaaaagaggagccgttccaggcaaggcagggggaacagcatgtgcaaaggcatgggagtgagagatcatggagggtttcagtcggtatgatcaggattggctcttggcggtggggtggggagggggaccgggggcaggcaggcggggggaataaggaggcacaaggccaaagaacaaggcagggagcagggtgtgaaggacatcatgtgccacatgctaaagacttggcaaaccattgaagggtgttcagtaaagaagcagcatactcagatttgcactttaccaagtcctaggtggataagtggagttggggcccacatgtggacaagcagcaggtcagaatgatggagacagaaacctctgagtgggaggtccaaagtctggccaggaagaggaccagggattgtaccagcctgaaaagggcaaaagaaagttgctgaacaggctctacaaactcctgaaaggggaggggctgagaaagcgctggttcggtccattgatctctgcagggctctgtgaattcagggtggaccccaggcatgagtactctgagggtaacatgggcagatgttgcctgaccctgctcagagtgacagacaggagccctgggaaagcaactccagactccatggcctatgactgtgtcactggctcctcaagaaaactctccctggtagctgagtctgctctgtcattcagctgactcaagcctcttgctctaatgacagacgggagagctgacccaaaagggaaagacactccatgagccaagcagggacagagccccaggactctggggaccctgctttctccatggcaccctgtggaccatccagccccggaggagcgcctgtgagtcaaatgcccaggtactcccagcactggacttctccttaactttctctgaactttctggaagttgagcatctcagacactcacaactgtgatctgcagtagcgtctacccctttcctcactgagcctcctgccgcttccacatggacattccatggcaaaggtcagacttgagggtaggacagcagctaccctgttagcatcctcagcctgctgggaaataaaactgtcacggagacaagaagttctcagatgcttggcatttagcagttgtcagaggagctgaaagccctcatcagttctacctgaaaatcagaagtttcccaacgtgcatggcttttttttttttttttttttttttttttttttgagacagagtcttgctcttgtcacccaggctggaaagcaatggcgcaatttttgtacttttagtagagacggggtttcgccatgttggccaggctggtctcaaaatcctgacctcaggtgatccgcaagtgctgggattacaggcgtgagccactacgcccggcctgtgcatgcctttctgttccttctgctgatgtggggggtgttgggctcctgtcaggggcctcctgatgccccgttggggcacttcctcgctcagcttcctcgtccctgacaaagtggcagcagcagggtgtggcccatggaaggtgaccatgaccagcattttcattaaactttactgttcggacaaactattctcatctgacctcataacggtctctttaatcataggaacagtttcaagaaggttgatttgctcaaggtgatacagctgttaaattacaggacaaagccttgagcccaagttcctaagactctctgacacctgcaactgtggcactgccagccgccactctgcctctgacagtctcgggggaccaatccagtgacaaattctccctctcctttttttttttcattgcagaagtcacatgcgctcattataaaacactgaacgttcaaggaatagataagatgaaaaggacagtgccccataatttcctgctccagatctatgccctgtaagccaggggtctgacacagagtatgtgctcaataaatgctttctgaagggactagttaatagaaagaccgactataatttattaacagagctccccatactattttacaatgtgcttttccatttggctgggtcatttggacattttttcatgtcggtgcctgtaggtgaccccctgcccaccaccaccaggaacagtctatagctcggtcacccctaacaggggcaggccttctggaacaaggccaggcagcccccaggctaatcccaacagtctattctacttaagttcccagaaggcggctgtgaactattttggtttaactgactggtcagtttcaaaaaagagagaaaaccactaattaaacaagtcaaacaagtggttatttttgtctacacaatacttcactgatttgcctacattttctcttcaaccaggtgctttggagttgaataagtgaattcttaattgcatagctaaatgtagatgaataactggttaagaatttcttgcccggaaaggagtctatatgtaagtttggattagagtgaaccaaggccttacctctttaattgggctgggggttttctggtccattaagcaagaatatgctctaaatctccacctttgaaagccacagtctgcacagctgggagcctgcctgctttcccttgcacacctacccagcactggagcgggttcaaagacaggccacccgagctaagagcagtcactggaatagatgacagcatgctcaccaccaaggacctgggctggggtcaagtccctgtcttgggcaagtgactttgcctctctaagtctcagtttcttattctgaaaagtggataaaataatgtcctcatccattttctatgagaattacatgaggaaatacaggcaatgcacttagaatgaagcctggtcaatagtaaaccctcaaaataaatgctaacgattgttgttaatctcaaaggtttgagaagaatctacaacctctgcaaatatttcactagtatgagaagtttctttgcaccctataggaagtagacctaaaattcaaacaccccatactttaatttcctttcaaatttgtaggaattataggatttacagttccagtaaactacagagataacttagttttcactcccatatttcagccatggcccagagagtttcagaaatttgcgcctggaacggatttctgtgtgagtggtatggctggatgaacccggatcccacctgctaagctgttgcatattaatctccaggacccatgccacctcagggagcaggaagacactgcctcacattcacacctttgtgcaataccaagatcaggcccttctagggaagtaagctttgagaggcagaatggcactgggaattcacaaggttgagaagaaaaaggggcaccatactagttaggacttcctgatttcaaattatgggaaacccaacacaaactaactttagcacaaactaactaatgtaagctaggaggatggaatgaagagctgcaggaggaaagtttggactctatattgtgctttgtaggcagtctgtctatctgaaatctctgctggtctctattagctccttctgcagaccggctctctccatgtggtacaaaaatggctgccatcagccctagattaatatattctcagtttagcagctccaggagaaagtcagagcttttcaccccagcatccatgtagaaatcccaatgaaggatccataccggcctggagtgggtcatgtgtccaccccttggaccagtcactgttgccaaggagatgagatactaggattggccatgcctgggtggtgagcccaccaccatgaccagaggggcagggttctatcactgagagctccttcagaactgcatggaatgcgagggtggttcctcaagatgtagtgggcagacaaaagcaggtgagccatcccagacacccaaaacgaaagctatgtgtgcctaggacacacttcccttacattttttctccattcaaggtcttttcaggagctcctcaaactacagatgagagtttttgtaaatataaattcacaagattacacaatttacatgtaaaatgggaccagttttctcacgagattcataaaccagctctgaagcaattctaaaggaattgttgcaaaattgtttttagcattagcaatattactacaaaaaaaaaaaaaaaagaagcaggaagactcccaaggtgactacttggaaggacaactttcatttgaaagtagaagtattattttgttcctttaaaaaaatctagattatgcgtaagattattatgataactaaatcaatacaaatatattaccaaaagttgcgtgtgccctacagtgtaattgctttccttttagatctaagaatttagggaaatgagaatgggtgtgaactttggttaaatatagagcaggttttcacccaatcagattgggtccacaatctgtcaatcacatcaggatcccctgggagcttgttaaaataggaggtgcttgggtcccaccccagagactctggtctggtaggtctgggtagggccaggcattattatttctgaatgctccgcagttggttttgacaagccctcgaggctggaaaccatggccctaggacagcatttctcagagtatggaaagagtcctcttgcatcagaatctgagagctggttaaaatcagattcctgggccctacccaggcctgctagattagtcttggtagggagcttggctgtgaatttagagtttattaagctccccagtgactttttaaaaatttttaattttgaaataattatagatggacaggaagttgaaaaaaatatgtatggggaagtcctatgttcccattacccagcttcccccaatggtaacctcttgcgtgactatagtacgttatcaaaaccaggagaatgaccctggtatgacccacagtgcttatcatattttttccaggtttatatgcactcgtgtgtgtgtgtgtgtgtgtagttctatgcagttttatcacctttgtagatctgtgtaacccccaccacagccaagataaagactatcctatgaccataagctctctagaactacccctgtatagccacatgcacccatcaccacccccatccctaacccctggcaaccactaatgtgttctccatctctataattttatttcaagaatgttatgtaaacagaatcatacagcatgtaatctaatgatatttgttttttcagtcacaaaattcccttgagattcatccaaatttgtgcatgtaacaatagcttgttcttttttaaattgctgcatagtattccgttgtatagatgtactacagtttgtttacccatctacccaatgaagaacatttgaattgttttcagtttttgcctattacaaacaaagctgctgtaaacattcatgtacatgtgttctgtgaatgtaagttttcacgtctctgggacagatgttcaagagtgcaattgctgggtcatagcataagtatgtggttagttttataagaaatcgccaaagcggctttatggttttaccttcacatcagcaacttataaatgatccactttctccacatgtttgccagcctttgatgttatcactattcttttaaaattttagcctttctgatagatgtgaaatgatatctcattgtggttttaatttgaacttcaccaatggctaataatgttaaacatcttttcatgtgtttacttggcatctgtatatcctctgtagtgaaatgtctgttcatgtcttttgcccattttctattttatttttccataagttattgggggtacaggtagtatttggttacatgagtaagttctttagtggtgatttctgagattttggtgcacccatcacctgagcagtacacactgcaccatatttgtgtcttttatccctcaccctcctcccactctccccaacccccaagtccccaaagtccattgtatcattcgtatgcctttgtgtcctcatagcttagttcccacatatcagtgagaacataggatgtttggtttcccattcctgagttgcttcactcagaataatactctccagtctcatccaagtcactgcaaatgctgttatgtcattccttttaatggcagcatagtattccaccatacatatataccacagtttctttatccactcattgactgatggacatttgggttggttccatgattttgcaatcgtgagttgtgctgctatgaacatgccatgcaagtatcttttttgaataatgacttcttttcctctgggtagatacccagtagtgggattgctggatcaaatggtagttctacttttagttctttaaggaaactccacactgttttccatactggctgtactagtttacagtcccaccagcagggtagaagtgctccctgatcactgcatccacgccaacatctactgtttttttaattattattttttgattatagccatttttgcaggagtaaggttgtatcacattgcagttttgatcggcatttccctgatcatcagtgatgctgagcattttttcatttgtttattggccatttgtgtatcttcttttgagaattgtctattcaggtccttagcccactttttgatgggattgtttgtttttttcttactgatttttttgagttcattgtagattctggatattagtcctttgtcagatatatagattgtgaagattttctcctactctgcgggttgtctgttgactctgttgactgttccttttaccgtacaaaagctctttactttaattaggtcccagctatttatctttgtttttgttgcatttgcttttgggttcttggtcacgaaatccttgtctaaaccaatgtctagaaaggtttttctaatattatcttctagaatttttatagtttcaggtcttaggtttaagtctttaatccatcttgagtgaatttttgtatgagagatgaagatccagtttattctcctacatgtggctagccaattatcccagcatcgtttattgaaagggtgtcctttccctacttcatgtttttgtttgctttgtcgaagatcagttggttgtaagtatttgagtttatttctgggttctctattctcttccattggtctatatgcctgtttttataccagtatcatgctgttttggtagctatggccttatagtatagtttgaaatcagatagtgagatacctccagatttgttctttttgcttagtcttgctttggctatgcaggctcttttttggttccatatgcattttagaattcttttttctaattctgtgaagaatgatggtggcattttgatggggattgcattgaatttgtagattgcttttggcagtatgatcattttcacaatattgattcgacccatccatgagcatgggatgtgtttccatttgtttgtttcatctatgatttctttcagcagtgttttgtagttttccttgtagagttctttccactccttggttaggtatattcctaagtatttttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaaggtatgtcccttgtatgccgattttgctgagagttttaatcataaggggatgctagattttgttgaatactttttctgcatctattgagattatcatgtgatttttgtttttaattctgtttatgtggtgtatcacatttattgacttgcgtatattaaaccatccctgcatccctgttatgaaacccacctgatgttcgtggattatctttttgatatgttgttggatttggttagctagtattttgttaaggattttagcatctatgttcatcaaggatatcggtctgtagttttctttttcggttgcatcctttcctggttttggttttagggtgatgctggcttcatagaatgagttagggagggttccttctttctctatcttgtggaatagtgtgaaaagtattggtaccaattcttctttgaatgtctggtagaattctgctgtgaatccagatgcaagtccttagtcaggtaggtagtttgcaaatattgtctcctagcctgtagcatgtcttttcatcttcttaacagtgtctttgaaagggcaaaaatttttaattttgatcaagttcaactttttgatttttgtcctttatggattatgttttagtgtcaagtctaagaactttttgccaagctctaattttcaaagattttttttttacttttctaaaagttttatagtttcacattctacatttaattctgtagtccattttgagttcattttttgcataaggtatgaggttcatattttgcctatggatgccaattactctagcatcttttttttttttctcactctgtctcccagtctgtagtgcagtggcttgatcttggatcactgcaacctccaccttccaggttcaagcaattctcctgcctcagcctcctgagtagctggcactacaggtatgtgccaccatgcccagatagttatttgtatttttagtacagatggggtttaccatgttggccaggatggtctcaaactcctgatctcaagttatccacctgcctcggcctcccaaagtgctggaattacaggcgcgatccactatgcctggcctactctagcatcttttgttgaaaaacctacccttcctgcattgaattgcttttgtatctttgtcaaaattatcagttgagcatatatatgtgggtctacttctgggttctctattttgtcccattgatctatgtgtttgtctttctgccaataccacacagtcttgacgactacagccaagttttgggatctcgtagactgattcctcccactttattcttttttcaaaattgatttagttattttaagttctttgcctttccatataagttttggaataagtttgtctacacctacaaatattcttgctgagactttgattggaattgcattaaactgatatgccagttttgggagaattgatatttttacattgtggagtcttccaatccatgaacatgatatgtttctccacttagttcttcttttatttctttcatcaacattgtaaatggcaatgtgctttcatttggtttacacatgttcattgttagcatgtagaaatgctattgacttttttttgtatgttgatctggaatcctgcaaccttgctgaactcacttattagttctaagattgtttttaaattttttagtagtttctctgtagatatcatgtcatctcaaaatagggacaattttatttattccttttcagtctatatgcttttcatttattttcttgccttattgcactggctagaacttccaatactatgtcaaacaagagtagtgaaagaggacatccttgccttgttccccatcttaaggaaaagcattcagtctttcacattaagtatgacattagctgtaaggtttttgtagatgccctttatcaagttgaggaactcctctctattcctgagagtgtttatcatgaacaagtgctggattttgtcaaatgctttctcatgtcaactgatataatcacataattttttatttttcaggcagttaatatggtgaattatattgattgttttgaaaatattgaatcagccttggacacctagaataaataccacttggttttgatatataagtctttttatatagtgctagatttgatttgttgaagatttttgtgtttaaggtcatgagagatactggtctatacttttcttgtagtatctttggctggttttggtatcagagtaaacctgtcctcataaattgagttgtgaagtgttccctcctcttttatcttctggaagatattgtaaaattagtgttaattcttcttttaatatttggtagaattcttcattgagaattctacattagagaattgtactctctaagtacattgagtaccacatcatagggtggtgtaatttttgcttcaaccatcaagtatgatttaagagactccaaggtatcctggcctggagatgtgtttttcaggaaattttaaattatgaattcaaataaaaaatatgaataattaaattttgaaatttaattaaaattattagtagttttgtggttgtaagattattcagattgcccacttcatcttgattgagctttaatagtttgtaattttcatagaattggtcaatttctttctagtttttaaatatattagtctaaagttgtttgtagtagacccttatccttttagtagctgcagtgtttgtagtgatatcccatttcattcctgatgttggtgttttgtgtcttctctcttttatctttgttagtcttgttcgaggtttatccattttattgatattttccaaagaaccagtttttcgttcatcagtttttctgtggtttttgttttcaggttcatagagttctgcacttttttttttattatttcctttcctgtgcttgataaggttctttgttcttctttttctagtttcttgagatgggagcatagacgattcatttaagatctttcctcttttctaaagtagcatttagtgctatcaatttctctctccacattgctttagctgcagccacacattttgatatattgttatctagtcattacattatattcaccattatagtagtgtatttgttctcttttattccttctgctccttgtttcatttttcttacctttttgtggataacttgaacatttttcagaattccattttggcttatcataattttaaaatagtttttcttagttcttgtgtaaatacacatatataatttatcacaatctatgagtatgaatgccttaccattttgagtgatatgtagaaatcttacttccattttggaccttttagcctccttacttttaaaatataattgtcttaagtatatcttctaagtgcattgagtaccacatcatatggtggtgaaatttttgcttcaaccatcaagaatgatttaagagactcctgagaaggatagtctattatttttatccatttcattgtcctttcctttctgaagttccaaactttcttctgttatcatctccctttcctttctgtttggagaacatccttcagccattctttaagggtaaatatgtgagtgacaaaatctcttagttttccttcatcagagaatgccattatttccacttttctcctgaaggatactttcaccaaatagatgacttgtgattgacagctatttcctttcagcacttgaaaaatgtgccacttccttctggcttccatggttcctgataaaaaaaacctgctgtcctttgaactggtgttccctatagataatacattatttctctctggctgttttcaagatgtttttctttcttttttagttttcagaagtttaactatgaggtatcttggcatggatttccttgggttcatctgagttgagattcactcagcttcttgaatatgtaggtttatgtcttttgcaaaattcagaaattttcagctgttatttcttcaagccaaggtgacttttaagcacattgtatatttgagaaacattgctctggaggggggttgagagatccaaggacttctcaaattgtatgcagaatgctgttaagtgtccacagctttcattagattctcaaaagactccatgaccctcaccatacattttataaaagaattggtttatggccttattgagttgttttttgttttcttggttaaaatcagtaaaagcaaacaaacaaacacaaaaagtagttagtattcttttctttctttgtaccacatctgttgaattcctgtttctcaaagattttcctgacaattttggaaaatacgatgactcaggtaaatgttttccaagtgcctaatatgtgccagacaaatatttttattgttttccatagttaatgagaaggagaagaatttaaaacaattaatatcatttgggtttatgaaaagttcttggtaaataagtgctagagtaaaattggctgcttttcagtgtgactttcccctttaaaatctgttccttactgctctgagctggatacaccagcgatcaaattacatccctgaaagtataatttcatacaccgaaaacatgtcattacacagtgggccgcttgtcatcactctggcttgctttgcacagttggtagtccggcactcacggttcccccaagcaggcttgtccctggctcaactgctctagctgattcctccagccagcagaccctcacctcctttgtcaccccttattcctggactaacttttgctcatcttccagaactcagcttgggaagcaccacctctgggaagccttcagtctcttttctccaagcattgagttgagtgtgcctccagggtcactcatgcctgccagaacatcacgctgtatattaattgcctaattgtctctcctgtcagatagtcagacccttggaaactgtgactgggtcttgatttgctttcgtgcccccagtacttttgtaagtataatatgacatgtgtttacgcactatctccagttagagttcacgccaccagctgactgactgactgagcctttcatccatattttcattaatgtcattaagtatctgttgagggctgggcacagaggttcatgcctgtaatcccagcactttgggaggccgaggtgggcggatcacttgaggtcaggagttcaagaccagcccagccaacaaggtgaaacgctgtctctactaaaaatacaaaacttagctgggcatggtgatgggcgcctgtaatcccagctactcaggaggctgaggcagaagaatcgcttgaacccgggagggggaggttgcagtgagctgagatagcaccactgcagtacagcctggacaaaagagcaagactccatcacaaaaataaaaataaaattttaaaaagtacctgttgagctcctttatatataggtgtggcgaccagatattcagttcttcccaagcaggtttaatctttcctcacaagcatctgtttattaattcactttagactttttctgagaattggtataaaggttattggtcttttgctagaattcctatctttccgttttggggaaatatggataacaccgacctctgccattttccttctttgtcttactactggatcttatgaaccctttattattacatttacatgtatagctctgtctttcctattaggctgtaataagctccttgggcagggagtgtatcttattcaacccagagtctccagggaccggtgcaaggtggcattccatgagtgctggtggaaagaaatttgatgttagatcatcacagctatatggttgcttatgattggaacatatgtttcctcatcgtctccatacctttacttcctagttatcttttatccctcattctaagctaccgtgaactcttttttggaaaggagaaatgggtaatgcaacacattttaatgcattttttattcctcccaggtactatcttggtcgtcggatgtttattgttatttctgagccagacatgatcaagcaggtgttggttgagaacttcagtaactttaccaacagaatggtacgtagttttctttccgcatatagatggatggggaattgttctcagatggagacactgcatgtcagatccaatggggatgcaatcaggcctctgatcaggtttatgtcagttccactcaaaactaagctcctcagtgaactcggtttttcaaaagagatctatgggactggtacaaaagagtaacatttacatttaagaaatgcttcaagaaagctaaagctcaagggaagctgaggctattaaaaatgctaaaaccaagagggttttctaaagctgggttcaaagccgggggaatccagagggcacaggccaagtgactgacggagaatgagctaggctaataaatattagttggaaagcaaaattttgaggttcttgcacttacatctttcccagaaagtataagagtattaaggctggaaagggaagtcaagcaaaattaggagagaaatttgtcccctagtaagagaaggaaactttaagagggctcctttacattaggtcaagtctccagcctacatgcatgtacatatccctttgtttttggaaagtaaatgtcctactatttatctttgatgagaaatcccaaaggatgggcgaggtgacagaaaatggcagagatcaggccaggcacagtggctcatacctgtagtccccacactttgggaggccaaggagggtggattgcttgagttcaggagttcgagaccagcctggccaacttggcgaaactctgtccctacaaaattacaaaaattagccgggtgtggtggcacacatctgtagtcccagctacttgggaggctgagacatgagaattgcttgaacgcttgaatctgggaggctgggagtgggaggggctccagtgagctgagatcgcgccactgcactccagcctgggcgacagagacgctgtctcaaaaaaattaaataaataaataaaagaaataaagaatgaaaaaatggcagatatcagtgctaaccattttccaaaaatagggagataggcattctagcagagaagaccagtaacctttacgttgattcttggaaaaagtctaaagtgaattaataaacatgtttgtgagaactcagagaatcaccttgccaaccatttttggggggttccaattagacctcacttttcattcttttagggaagtacgtattcattcttttgttgattatgtggcaaactttttcatacctaccatatgccaggcactgtgtaggtgctgactgtaaagagacagtgtccctcgaggaactctcggtttagtgagggaggcagacaaggaaagggaccagcacaatgcagtgtggtgagtgctcctgaggtggggagcccaggccaccaggatgcagacagaggaaagcttattgggtgtgaggtgcttggggctgagtcttaaagaaattagagaaagtccccctgcctgtgttccgaactaggtgagccatccagagtgtgtccttgtcatcgcaagagcttatgagatgagtacaattatcatctctattttatagacaaagaaactaaggttcagagaggctaaatgatcaaccctggtaacatggcttaacacgaggaagagcagggattcatgtgccatctctcaacttaagtctagagctctttttactgccaaagctgtgacagctgcctcagtgacatttcaggatgtcaaggttgagtggagtaattggccactcacccaaaatttgctcatcttcttccagccccagagcatcatgcccaactccagacatcacgtggcctctagagggatgtggcctggagggaggcggctggcctgctacctccatcccttcaggatggccgaaggaattgcagaagtttaactgcttctctgctgcctctagattctctttcccaaacactgcattgctatctcctcgctcaaagtcccctggaagccgtctgtcaagaaactgattctgattattaaatgcagctgtagcttgttgctccatcagcctcagcaaggagtgctgattaaagaagttggagaagccaataagtcaaagtgcacggaccaccaagccacatcctggcaagcagtaaaggtactcccaggagcctgtcatagcacttgagactgtctgagcccctaagccatgagacggcacttgccaactggtgtctccatatttcctcccatgataccaggacatgtgaccctgagagctgacctagaagaggtcaatgatttggcctgctaggggcagacatactcaatgcacatgtccaagcaaggaggacacaataatattgccctcagctttgatcaatttatcctccaagccatttgtctgccgtttctaatttctttcaccatcccctcacccacccctccacgcagactaggtccagtgccccaaactccagagtagagttccaattttcgtcctcttccactcagcacaggattaagccttcaggactaagttcaagttccctagacgatatttaagggcccttgtgtcttagatccattgtgtgtgctccaccctgtctctcactgctccccaatacaaatcgtcactccagcctctccctgctcaccctcacctgctctggagagacctgacctctgccttgctcacgctgacactgcctcagaattgaaggcagtgtaacagtggggctcatattgattatgacgtgagcttgagcacatatctttttttttttttttttggagacacggtcttgctctgtcacccaggctggagttcagtggtgtgatcagagctcactgcagcctcaaactcctgggcccaagtgatcctcccacctcagcctcctaggtagctgggactgcatgtgtgtgccaccatgcctggctaattttaaaaaaaaaaaatttggcagagatgggggtcttactatgtcgccaaggttagtctcgagctcctggcctcaggtgatcctctcaccttggcctcccaaattgttgggattatagccctgagccactgtacctggccacatttcttaacttaaaaaagagctggggcagctctttttaaaaatatccatggaaagtggagctgaatcaacatgactcagcagaaatggtcacaaccagtggcagaacttcttattcttggcctcctctcaaggcctggagttgggggatatgatccaccttactgggctgtcataaagccacatgggatcatgcatataacctctccctctacacagtacttggcaggtgacacattactgcttctcacaagaaaaccctccacctcttccacacccatccaaactcttgctgttcttcaagacactcctcagatactgcctcctccaggaagccttccctgcctccatccacatgcacttttccccttccctgaactctggcagcgctcaccatgtgtgtcactcgttgtcacagttgatccccttgtgccttccagtatttacagtgaaggaggatatggctttcactctagcttgattattagctctttaaggccaagaactgtatcttgtattttttttaaaccccatgacataaacacatattgactcttcagcatccaatatattcttgttccaactgaatggaatttccatcaacttgacattcctcccagaagaatgaggtattacttgaacctggagttgcaatatagtcttcttcgtctcggtcattcacaaacacgtaaaaagacccatcatagataagatctccaggaaatcccagtgtttatagttttccatctgggaatgcatccacttatgtgtagctttgtttatggtctttaagccaattccatatcgatggtaaaacaacccttagtgactcaattttttaaaaaacagtctttaaagtgggattttctcacaggtttttgaaagtcaaattaaattgggttctgtggttccctcttatccatatgcttatttatctgctcaaagaactcaaggagattagtgagacgtgatttctccttactgacaccacgttgccttccctctaataggccatgtttacttaagcgttcagcaattcagctttattatacattcactcggtaaacattaaatgcttactccatgcaggctgctaccaaacggtcccttgtgatacagaaaatacctcggcatattagtttgataaattaagtgaaaaggaatttaaataatgcatgctctcattctccaacagggagagcccatgtctgctcacaaattcaggcttgagttacgttgagttttgtccctggacagcctggtggagaagggccctgatttgggaagctggatttagctctgaaatttgacatgagccgtaagcatcccatgagggatccatagagcatattcactggaggtgggggtgatgcaacagggagctccctgacatacaacaacattgaacaaatgtgtgaattcaaatatcatcctgtgaaatattcttttccaaactccagaacactggctggagcagactgtgggttggatccggagcggcagttcttaatgtcatgctttcccattcacagtttttgggcctctggagtctgtgcaatgtctctgcttcatcttgctcattttccacgtggaccttgtaggtctctatcaatgtcctcagtgcttcctgaaactgctccatgatggtgcaaccacagcttatcattaaacccaaatcaatcttcttggcacttatagaagctcagtcgtcctggtacatcaggactcggatgtttctatttagatattttcaatgagctcttctttgctgtcaggtacggtacctaatgaaaccatagggcagctcttttttaaatatctgtggaaaatggagctgagtccacatgactcagcagaaatggtcacaaccagaggcagaacttcttgttcttggcctcctatcaaggcctagagttagggagctgtgggaagggtgataagaggtaagccagtctttggcccatgttagcttggtctggtcagataggcatgtcagggatgtgtcaaaacactaagcctagtgctttggagatgtgggttctggtctggagtggcagtatggagtgccatctctcaggtcctcatgagcaacacagaggtcacctctccaggcacaggtcgagccacaccactgacacacaagagtcacgtccaaagccatgtgatggacgtggtgggtggttttatcccgaaccatcaatacccggcaccctggctgccccaggttcagcctctcaggggctgcttcactcgctctccacacagctgtgaacattgcaggatgagtcactgtgaaaccacaaactccttggcattggtgaagatgactaaagttataggcaaattagtcactggaaaccttcctgtcctctgtatctgcagcagcctcctatcgaaggaagaaaagagtatgttggctcattgcagagctaattggcaaggaaagctcaattcagggctacaggtgagtcagacgcccttgtgcgggggccacagggacccgcctgctggcatccattgaggagagaggggcccttggcagacttgccataaaaccgccccccttgaactcattcctacacctgtaaccactgacagtttttgaaaactgttcacctggagttcctggttctctttctcttaaatcaaacattgagtaaatgaagacactcagatgttcaaacatgtgcatcaagattttacttgtgagagtggttgccatgcatgacctagggaagctctcatggcttcagtcaaaccttgccaactttttttagctgtgcatttcttgagaaaggtcaactcacattacgggtctacagctctgagcaagggagaagttcttcctgaaagcacaaacagactacagagggcagtgaaaccagaaacacaggtgtgcaacctcatttgcctgcccccgtctctattttgaggcctctttgttttatgtgacctccgtctccttctctgccgcaatcttcttcttataacacccactttcttcttttaatttccccctcttctaagccatagcccagtggtatggcgaaaggtctttgctgtgcataggaaaccctccaatctgaactggaagcttcctgttgcaggatgggctgccccattggaattcccaggtgacagtcgcaatgggatgcctgtcccctgcaggtctcccatttcacctgcttttctaatgtctggacatggctaagtcctagaaaagccagatccatggcattacatttaatcagtacaacacactgagcttcgtttccaacatggtagctaagttttaattctaacatctttaaaagtactgagtgtcttgtgatgccttgggaacacaggaatagtgttaagtggtgttgattctcaatgctcaaatgtacttctctctgccttgcagagatttttctaaaatttcaagaccttgttgaaaatgatttcatatttttgtgtcttactagactcttggttcagcaggaagctatctttatatatttttttaacaaaaagaaattagtaaaagcttgctctgatatttatgccatatttccctaacttttgtcgtggcagaagtagaaataagtgtgtaaaccaggagattaatatctacaatttaggcatgagaatagagaaataaaccataaaatcaattcttatctctcaatggatatattccagaacattccatggaaatcaagtgactaagtcctgatcctccctgtctttctccgccccaatctccttcttatgacattccctttcttcttcccattttccctcttctaagccatagctcagtagtatggtgaaatgtctttgattttagtttaaagaaatgaaatcagattccagatttgctacctcttattagttgtgtggccttcagacaatcctttaacctcctgattctcaatttcctcctgtgtaaaatacattagactagctaatccctaaggtctgtttggtgcccagttcacgtgaccgttggcagccacagggagccacggagtcccaccagcgtcccatagagccacttggagcttcaggtacaaggaacaagcccctcttaggccccctcaggaaaatttattctcgcagccaagcatgtcaagtgcaatatcaggaacacccttgtccttcttgaacactgcttctggccagaaactctgctgagatctgttggagagtttcctgcaaagataagagttaacaagcccccagattcccttccccgctcaggaggggccctcactgtcagctttggggctgatagaagcacagttccaagcgcctggcttcctcctcctccccagtggataaaatgctggaactccgtcaggcaggactgccataattagaagaggcccctttccagcagctgaagctgactaggcagatagagcccaaatttgtttttagccaccacatgcccctgagctgacccctcaagctgtggacacatctcacaacctcacccggaggccattctctcaggccagtcacactctcccacagagagagcgaagatgatgtcaaatctatggccaccttctaccagcagagggaatgaatgaaaactgacatgtagaagagtaagaccactactgttttcatttttggtattttttttttacattttaatttttttatactctatttttagtaaaagggacacctttactatttcaaaccaccaaaatataagccctatttggttcaaatctttgtacagccagatagcaatagatataaattgacaatggcctcaagtatagaatttggggttatacaagtgacagaattcttgagtctcagttgattataatataatgaggggacagtgccaggtctttcacgtctccaggtgggaaggggacaagttgcacgatggctgtcctcatctgtgcctggttgtgtgagaattagaaacaacgtttgtaacagtggtacctagtctttgtgaccgtggtcctctttttgatattaatatttttgcagactagttggcataaacaagttggctctctgtactcacattacaaccactgaggtataacactatctcttggagtccttagaagcacctcgctctgttcagctggcctctcagccttgtgtggctgtttcagaactgttgatcatctgtcaagtcatcccagagatcatctagatcttgagtccatttcttgcatgttccagaacacaagaaaacatttgtggctatagcttcatattctatcatgcctttcatccctttctcccgataatacatgaacccggttacagcagaaatgcattccatgcatttgcaacactctggaaggagccagtggttcttgtgtggctttaccaggccagtcgagaatcactgggctggtgcatgagaaaccttcagtaagtggctgctgtcttcatgcacccatggaatgccgaggtgttggttttcttcaataacctgctcctcagggcagtgtttcctaattgctggagaatgacccaagagttgatgaaataatatgaaaagtactgtgtttgctgtaagatggacaagtattggtgatataggccaccccactcccaccctccattctttgtcttgatagttccagtcccagtacagcacctggcacacagtagttgctccatcattattcacagcataatcacagacaccattcagagcagagcttgtacagccctaaacataaagtgcagcaaacccagctcaagatcattgaagctagcagccattcagctcctgctgtgggatggccagggagggtcagagactgtggtcttgacacattctgtgtggggttcatccacatcttcctaaatgcccaaggcatggctatttgaagcagagcaagtaaagacaacgaggggtccctctgctgggttttctgtccccctctggctgccagcactaatctagcctttgaagaggggcagaaggggcaaagttaaaccacactttcctctcttacctgttgtcacccctctaatgacttttcactttctctgctcaccttctccttcctgcctcttttagaaatgggaaacaaagggcccataggccctaaaaggggccaccctttgaaggaggagacatgaccacaaatgtcaccctttgatatcctaatgggatccatgttaaaaaaggaagtttttaacctggtctcagaggacacttgcaagagatgccaaggaaggcagtgtgatcatcccaagtcaagcagcctaacgtgagcctgtgagagagaaactgcaatccacccgcaacgtgtggtcatcaaagggcggcaaccccagttaccagcttgagattaaaaacccaaattaaaacagggccaaaggattcctgtcagctcttaacacctctcttaaaatgtgaccactgtctgaaaaccattgtttggctgatgaggtctaacttcattacacatcacagtaggacactccttcctgagaccaggcactgctcccatgagtgcagtaggacagacctcctctgttcctgacgatgataccccaatacagcccgacaagcgtgtgctcaatgaaggttcccagatctttttaatgcgactttttgcaggtcaggttgcttccatcacatgcactgaacaaccaaattttaaacctaaatatgaaaccttgtagttacatctgttgattttcgtcttgttagtgttcatccagcattcaagtctgtcgaaattaaatgtttattattccttagtatttttttaaattgaagtcacttccatacacaaaccttgagtgtaaagctcaatgtattattgtctatgtattcccctatgtgacaccacccagatcaagacacaaacatttccaacactccagagggttccctcatgcctcttctcagtcaacccatccctaccatccagaggaaaccactcctctgacatcaatttgtatagatttctcttttcctgctgttgaacttcatgtaaatgtaaacttacagtatgtatccttttgttctggcatcttttgctcaacataatgtctgtaagagtcatccataccacgtatttagattaatatagccaggtgtggtggctcagtcctgtaattttgcactttgggaggctgaggcaggaagattgcttgagcccaggagttcgagactggcctgggcaacaaagtgagacccctgtctctacaaaaaaaaatttttaaattagccaggccccgtggtgtgtgcctgtggtcccaggtactcaggagactgagggaagaggatgccttgagcccaggaatttgaggctatagtgagctatgatcgtgccactgcactgcagcctggggacagagcaagatcgtgaacatagtttgcatttttcattgctatgtagcattccaatgtatagaaacaccacaatctattcctctgtcaataaacatataggtttccagttttttgctattatgaattaggttgttatatcaacaggcatttatgaacacctaggagcagcatcgctagcccacgagagtaggtgcatggtgggtttttgtacatactgccaaacagttttccaaaggggttgagccaatctatactcccataaagtggagttctagttgttccagccttagccagcactttcatcttgccattatttttcactgtaactattccaggggctgggtagtagtggtatctcaccacagttttaatttgtatttatctggtgaccatgtcattgagaactttttctttttctttttttttttttttccccgagatggagttttgctcttgttgcccaggctggagtgcaatggtgtgatctcagctcactacaacctctgcctcctgggttcaagcgattctcctgcctcagcctcccgtgaagctgggattacggacatgtgccaccatgcccggctaatttttgtatttttagcagagacggagtttctgcatgttggtcaggttggtctcgaattcctgacctcaggtgatctgcccaccttcacctcccaaagtgctgggattataggcgtgagccaccgcgcccagccgagaactttttcatatgctctctggccatttgaatagtctcctttttaacaacgtgcctgttgagtctttgccccctcccccacttttattttaaggtgtttgactttttctgattgacttgtttttctttgcatgttctgccttgagtcttttgtcagataaatgtgttgtgaatatcttctcccagtccatggtttgtgtgttattttcttaataatatcctttgataataaagtccaatttatcaaaatcttcttttgtggtattgcttttggtattctctttaagaactcttgccttatatacaaggtcacaaagatattctcttggaatcattatggttctacctctcactattgggactatgatctatctccagttaacttttgtgtatagagtgaagtatggatcaaagctgattttttttctctgtattaatatccaattgccccagtaccattgttgaaaagaccacccattcccccttgaatagcacctttgtcataaatcaagagatcatatgtgtgagtctacttctggactctgtcccatttcattggtctttttgtttatccttgcaccaatatcacactctcttaaatagcatagctttatcattgatcttgaaagatggcagtgtggccaggcacggtggctaacgcctataattttgggaaggccaaggtgggggaattgtttgaggccaggagtttgagaccagcctgggtaacaaaccaagacccagtctctactaaacaaatatatatatatataattagccaggcatggtggcgcatgcctgtagtcccagctactcagaaggctgaggtaagaaaattgcttaagcccaggaggcgtaggttgtagtgagccatgattctgccactgcacttcagcttgagcaacagagcgagaccctgtccgagagagagagagagacgcaagagagagaaacagagagagatggcggtataaattctcgtggttattctagttcttttggttccatatatctgtttacaggaatcagcttgtcaatttttaaaatgtttaatttttgtgagtatatagtaggtgtatacatttatggggtatatgaaatattttgatacatgcatgtatcatgcatgcatgatacatgcatgcaatgtataataatcacatcagggtaaatggggaatccaccatctcaagcatttttcctttctttgtgttacaaacaatccaattataatcatttatttttttgccctgtcttatggtgctgatctttcggttattttaaaacctgcaattaaattattattgactatagtcaccaaatactaggtcttattcactttttctatttttttccacccattaaccatccccacctccctcgacactctttcactactcttcccagcctctggtaaccatcattctactatctccatgagttcaattgttttactttttagctcctacaaataagtgagaacatgccaattttgtccttctgtgcctggcttatttcgtttaacaaaatgacctccagctctatccatgttgttgcaaatggcaggcttttattcttttttatggctgaattgtactcccattgtatatatgtaccacgttttctttatgcagttgtctgttaatggacacttaggtgcttccaaatttggctcttgtgaatagtgctgcaataaacatgggtgtgcagatatctctttgatatactgatttcctttctttggggtatatacctagcagtgggattactggatcatatggtagctctatttttagtttttttagttttttgaggcgcctccaaactgttctccatagtgattgtcctaatttacatttgcaccaacagtgtatgtgggttcccttttctccacatccttggcagcttgtgttattgcctgtcttttggatataagccattttaaatggggtgagatgatatctcattgtagttttgatttgcatttctctgatgaccagtgatgttgagtaccttttcatatgcctgtttgccatttgtatgtcttttttttttaaactgtcgattcacatcttttgcatgtttttttaataggattattaggtttttttcctgcagagttgtttgagctccttacatattctggttattattcccttgccagatgggtagtttgcaaatacttcctcccagtctgtggcttgtctcttcactttgctgattgtttcctttgctgtgcagaagttttttaacttgatgcaatctcaatcgtccatttttgcgttggttgcctgtgcttgtggggtattactcaagaaatctttgcccagttcaatgtcctagatattttctcaagtgttttcttttagtaatttcatagtttgaggactcagatttaagtctttaatccattttgattcaatttttgtatatggtgagagataggggtctagtttcatcattcttcatatggatatccactttttccagcaccatttattgaagagactgtccttttctcaatatttcttcttggcacctttgtgaaaatgagttcactgtagatgtatagatttgtttgtgggttttctcttctattccattggtctatgtgtctggttttatgctagagccatgctattttagttactatagctctgtcatataattagaagtcaaggattgtgattcctccagttttgttcattttgctcaggatggctttggctattttgggtcttttgtgtttccatacatattttaggattgttttttctatttctgtgaggaatgtcacatagagattgcattgaatctgtagattgttttaggtaatatggacattttaacaatattgattcttccaattcatgagtatggaatatctttccattttttttgtatcttcaatttcttgtatcagtgttttacagtcttcattgtagagatcttttacttcttcagtaaagttaattcctaagtatttcattttatttgtggctattgtaaatgggattgctttcttggcttctttttcagattgttcactgttggcatatagaaatgctactgatttttgtatgttgactttataccctgcaactttactgaattcatttatgagatctaatagcttttcggtggagtctttaggtttttctaaatgtaagatcatatcatctgcaaacaaagataatttgacttcttcctttctaatttggatacgtttatttcattctcttgactgattactctagccaggacttccagtactatgttgaataacagtggtgaaagtgggcatccttgtcatgttccagatcttggaggaaaggttttcagtttttccccattcagtatgatactagctgtgggtctgttgtaaatggcttttatgttgattgatgttccttctatgccttttaggatttttattatgaagggacgttgaattttatcaaatgcttttttagcatcaattgaaatgattatgtggtttttgtccttcattccattgatatgatgtatcacattgattgatttgtatatgttgagccatgcttgcatcccagtgataaatcccacttggtcatgattgatctttttaatgtattgttgaactcagtttgctagtattttgttaacgatttttgcatcagtgttcttcagggatattggcctgtagattttttgtttgttttgttttgttttgtttgatgtgactttgtctggttttggtattagggtatgctggcctcctggagtgactttggaagcattcccttctcctctcttttttggaatagtttgagtagaattggtattaattcttctttaaatgtttgataaaattcagcagtgaagccatggtgtcctgggcttttctttgctgggagactttttattacggctttgatttcattacttgttattgatctgttcaggctttggattagtgattcaatcttgacaggttgtatgtgtctaggaatttatttcttctagattttccaatttattggcatacagttgcccatagtagctgctaatgatcctttgagtatcagttataacatctcttttttcatctctgattttatttacttgagccttctttctttttttcttagtctggctaaaggtttgtcaattttgtttatcttttcaaaaaaccaactttttattttgtcgatcttttgtattgtttccttcatttcaatttcatttatttctgctgtgatctttattctttttttttctactaactttggctttagctcctgcttttttagttctctaagatgtatcattaggttgtttatttgaattttttctacttttttgctgtaggcacttataactataaattttcttcctagtactgcttttgccatatcccattagttttggtacattgtgtttccattataatttgtttccagaaatttttcaatttccctcttaatctcttcattggcacaatggtcattcaggagcattgtttaatttccaattaaacaattggaaattgtatagtttccaaaattcctcttcttattgatttctagggtttcttttttttgttttttgtttgtttgttttttgtttcttgagacagtctcactctgtcacccagactggagtgcagtggcatgatctcagctcactgcaacctccacctcttgggttcaagcaattctcatgcctcaaccacccaagtagctgggattacaggcgtgcaccaccacgcccggctattttttttttttttttccgtacagacaggatttcaccatgttagccaggctggtctcaaactcctggcctcaagtgctctgcctgcctcagccaaagtcctgggattacaggcatgaaaatagacacacttttgtgtatctattgtatgtttttagatttgaagttatcatatcttgcaaataatcttgtaaaccattattttaaactgacaacttaacactgattgcataaacaaacaaaaataaaactaataaaaactctacgctttaacataatcttcccactttttaactttttcttgtttatatcttattgtactgtctatatcttgaaaagttgttgtagttattattttcaattggttaatcttttcatctttctacttaagatatgagtagtttacataacacaactacagtactataataatcttgctaagttttgaagaattgacatcatgacaatgttgaattttccaaactatgaatgtggaacctctatatatttaggtattttaaatttatcttagcaatattttgtagttccagactacaggtcttttgtacatctttagtcaaatgtttttgtaggtatttaatagttttactgttattgtaagttatatttttaaaatttcatttttcagtagtttgttgcccatgtgtagaaataaatttttgtatattaaatttgtatccaacaatatttttaagctcaatattgaatctagaagtttatttatagagatttctcaaattttctatgttagacaatcatgccatctacaaataaatagagttttacttcttccattccaatttttacaaattttatttatttttcttgccttattgacctctctatgatgtcaaatagaagtgtaatagtggacatagttgtcttgtttccagcctcagaaagtgttaactatttcactgtttaatataatgttaactgcaggtgtttttgtaaatgtcatttttaggtgaaggaagtctccttatattgatagttcactgaaagttgttattatgaatgggtgtcagtttttatcaattttcttctgcatctcttgagattgtatatgtttttctgttttattctgttaatgcaacaagttacattgattttcaaagttgcattcttggaataagtcccacttggtcttaatgaattattcttgtaatttatcactgagctatattacctaatattttgtttacgacttttgtgtctatgttcacgagtgacattggcttataatttttctttcttgtaagtctttatctggtttggggctcagtttatgctggctcatgagatgatccagattaatgttaaatcgtgactctgtgcacattaactattctcagctgtgatttctgcaaatcagtagttcattatgaaaataacaaataaaatgttcgattcgactgggataagtgtagaaatctgtgggtctctatttgattccagattaatagagttttatttgtctttggtgttctgacagccatgaaaccaccaacccgttgcttctcctctttccccataagaatgtccttggaaatcacaaaatgttttgtttcccacatctatagatctgtccctatgtgggggaaagaaaagaatgagtaaacattacttctcagtgaacttgttcctaaggatcacttttttaaaaaatcttttttaaatgggagtaagctgttatctgcacaaagcccttggggtgaagtccagtcaacagggcttcccttaggagatgttctctaaactgtgttcatgaaagtgaataagagttagcaggcaaaggagaaagggggttggagagggatctagagtttcagagaaagagaaaaacagctcacgagaaggaccacaccctagagagatgacatggtcaagggtctaacggaataatgcgacatcatctcaacactatgtgccaaggactgtcctgaaagctgtgtcataaataaagttttggtgccgcaaaagaaatagcactcaaatataaaattttctttttaattctcagcaaggcaagttacttctatagaagggtgcgcccttacagatggagcaatggtgagcgcacacttggacaagggaggggaaggggttcttatccctgacgcacgtggcccctgctgttctgtcgttcccctattggctggggttagaccacacaggctaaactaattccgattggctaatttatgtgatggagtgatggctaatttagtgatggagtgggtggtttcgtgggaaaaatggctatgacagagcatgtaataggaatgagtcagggtggagcaggtgattggaatgagtcagggtggagcaggtaatcgaaaaaggttgctttatgaggaagttaagtttaaaagtagaaggcaaaaaattgaacatactgacatattgattctttgaaaagaaatttagaactcatatctaacagctataaatgtattaactgcattcatcattccgactgctcagtccaaaacccttggagtcatccttgactcctgtctttctctctcccacctcatatccaatccatcaggaaatcctgttggctctaccttcaaagcatgccaggctgatcatttctcccggtatctgtgtccagctccctggcctgagcctccacccccgctctctcctggccactgtgcttcctcctgacggcgctccctgcctccactctggctcctcacagttgattctcaacaccaaacagcgagattctttaaaacagaagtcagctcaagatatgtctctgttcaaaactctgctatgactacctgtgtcttgtggagtacaaatcctaccaagattctggaggccctccacacacaggcccccatgccctctctggcctgcctccatccctcccctccagccgcgccacatccttaagggtcctcacgcacatgatgcctttgctgtaatggttcccatgcccaccaaacccccagctccttcaaggctttgcactaatctcacctatgcaggagcccagtgccaactgaccaatttaataacacacctcgccccatcccactgtaccgtccagtgtatttctcatgcttattgtccaccttctcccactagaatgcaagctctgtgaggacacggagcttcattttgttcacagaggtatcctcagcacctaaatcatggcctagcacataccaggcactgaataaatatttgtgaagtgagtgaagcctcacaactatcctaagaggtcggtagcgttattatccccattttacagattgagaaactgtagagaggtcaaaccagagaggtcagctctcaaagtcacatggagccaatatttgaacccaggcatctgactctagaggcaatgttcttaaccactgcattatcctggcaagcccaaagtagcaaatgcaacccgagcttccagaaggccctgtgacttcagactatataagggattgggaagttaaggcactccttcaggctttgtgttcagaaaggggtggggaactggccagcacataccaggcctcataaaacaagttagggagtttgcaccaggatagggctagatttgtctttagaaagatcccactgactacagggtggagtacggatgggtgtgacaaggctgcgggcagggaaatcagttaggggctgagataatggtgacctcagccagggtggcagctgtggggatggaaagagttggccaaagagagatttaataattgtaactgacaggattgtagttgagagagagagaacaactcctaggtttggggtttgggttagttttggtttttcaagcttttttgactatgatctacagtaagaaacacattcacattttgatacagaatacacacacacacatacacacatacacacgcatacatgtacatacacacatacacacacatgcatacacacacacacatatcttgaacaagttcaataaccacagaatactttccctgacgttaaatgctcctctgtgtttcctaatcttgtctatctcttgtctctttctctcctttttttaaatgctggttgccactcatgacattgatttcatgactgatcatggcttgcagtctggaagcccttgaccagagagtgattggaggcttgggacacagctaggctgacagacaggagcctcgaaagctgtgtccctggacctcctttctgcagagtccccttcctgcatgacatacacagtctggctcccatcacacttaccagtctcgttactcattgaattagtccattttcacactgctgataaagacatacctgagactggcaatttacaaaagaaaggggtaatggactcacagttccacgtggctggggaggcctaccaaacatggcagaaggtgaaaggcacgcctcacatggcagcagacaagagaagaggacctgtgcagggaaactcccctttataaaaccatcagatcttgtaagacttattcactaccacgagaacaacataggaaagacgtgaccccatgattcaatttcctcccaccaggtccctcccaccacacgtgggaattgtgggagctacaattcaagatgagatgtgggtggggacacaaccaaaccatatcactcattcctttggggaaaatcctttgtctctttcaaggcatctctcagtaagtctcatcaatgaatatatgtggacaagcaggaggtgtggaggggtcatggaagctattgtttaataggcacagagtttcacttttgtaagatgcgaaaagttctgtggaggaatgctggtgatagtagcacaaccatgtgagtgtacttaataccaccaaactgtactcttaaaaattattaagatggggcacctgtagtcccagctacttgggaggctgagacaggagaatggagtgaacccaggaggcggagcttgcagtgatccaagatcgcaccattgcactccagcctgggcaacagagcgagactccatctcaaaaaaaaaaaaaaaaaaaaggttaagatggtggattttatgttacatgtattttgccacaattttttaaatcaatgtgtaggcaaactaatagaaaaaagagtgtctggagtggctttccagacatgaagtctcagggttgaaagagtccttggaaggcttttagaccaaacccctctgcatgctcaagccttgggtacaggatttctaagaagtggaacagtctccaggggtgtggagctcatcgctcaaggcaggttatcttatctgaataattttgtctgttgactattgggatagttctccttcagatgagctgaaattttctccatagcttcctctattaaacccaattccacttctcagggtcacaaaaaaaaaaacaaaacctaaattccctctcccatgcagtatgtattcaataaatatttattaggcatatgcctaagtaccactgtctgatcttccaaatcttctcttttccagttaaaaattccaaatctgacaactatttcttaaatgacatgattcaatgtccccttaccatctgactgctcttttgaaatcatcaatttcctcttattgtgggacatctataaacaaaaagaggccaggcacagtggctcatgcctgtaatcccagcactttgggagaccaaggtgggaggatctcttgaggctaggagttcaagaccagcctggtcaacatagtgagacaccatctctacaaaaaaacttcaaaattagctgacatggtggcatgtacctctagtcccagctactcaggagactgagagggtaggatcgcttgagtccagaagtttggggttccagtgagccacgatcacaccaatgcactaccgcctgggtgacagagcaagaccctgtttcaaaaaaaataaataaaatgttttcagaaataaaaacattacaataatcaatagccccaaatgatttcatcaaaaaatgggagattctaatggaatttccaggcccaagtgagcacagtgtcatggcatgctggtgagaaagatatgtgaaggccatgctgacatattgcaaggaggactacatttgtctttcaggtgcaagacaaaaaatagtgtaaattcacccttaagtcttaaggataggtacgagatccaatcagccttcactcttatctctaatttattctgtctcatcagaaccagaaaacatcactgcactttccttggaggtaagtgctttattccatgtagtgtgccacaggactgcatcttgccactacataaatacacataatatatgatttcctccttcaactctggaacctaaacaaatggattatgttccccaaattccataaagccataattctgttgagtggccatggcgctcccaaagaatttctttctaaatatagagaggtattcctctgcagaaaaaaatatcccagcatcttggttctaatatataattaactcctctctagatactttgcagttacgttttatggcttattttgagtgttcatattttatcagaaaattataattttcctctaaataggagtttttacaaggcttttgaattctgatgactggcttcatgtttcagctataattaaaacagtgaaatgaaatagcatcaccatgcatcacatgtggttctgagactgcttggtcccccaaccgcctgtctccccacaccccgcaacctgcaggctggggacactctgaccaatggtgggggctccagttttgaccacttagtgggacagctggttttagaaagaaacagaatggcctgagaagaagggatgaggagaccaaagtcctcacctcggagaagcctcccaaatatgtcccccaccgatgtcccaccttgccccattttccttccaggaaaatatactttctccaagaaatacactttccctccaggaaaattcactttccatctagttgttagcttatgagcttactctctgcttcccctctagactgccaactccatgagggccaatgcaaagtcttttttttttcttttgttttttttgagatgaagtttcattcttgtcccccaggctggagtgcagttgtgtgatctcggctcactgcaacctccgtctcccaggttcaagtgattcttctgcctcaacctctcaagtagctgggattacaggtgcctgccaccacgcctggctaatttttgtattttagtagagacggagtttcaccatgttggccaggctggtctcaaactcctgacctcaggtgatccacccgcctcagcctcccaaagtgctgagattacaggcgtgagccaccatgcctggccgcaaagtctttttcattcaacatggtatagacaacttcttgaaccccgtattagtttgctaggctactataccaaccaaccataggctgggggtttaaacaatagaaattgcttttcccacagtgctggagatcagaagcctgaagtcaaggtgtcagcagtgttggtttctccggaagcctctctctttggcttgtgcatggctgtcttctccctatatcctcacatggtcttccctttgtgtgtgtctgtgtcccaatctcctcttctaataagcacaccagtcatgttggattagggcccaccctaatgaccttattttaccttaattacctctttttttgagacggagtcttgctctgttgcctaggctggagtgcagtggcgcaatctcagctcactgcaacctccgcctcctgggtttgagcaattctccctgcctcagcctcccaagtagctgggattacaggcacccactaccacacctagctaatttttgtatttttagtagagagggcatttcgccatgttgaccaggctggtctcgaactcctgacctcaggtgatccacccaccttggcctcccagcgtgctgggattataggcgtgagccaccactctcagccttaattacctcttcaaagaccttatctccaaatacagccatccctcagtagctcgtgggataggttccgggacccacccttgctcaggacaccaaaatttgtggatgcttaagtttctgacataaaatggcatagtatttgcatataacctatgtacatccttctgtatgctttaaatcagctctggattacttataatacctcatacaatgcctacacatcactttatgtacatggattcaatgtagttctctggacagagcaaattcaagttttgctttttggaacttggtggaattttttctgaatatttttgattcagaattggttgaatccacagatgcagaacgcccagatatagaaggctgactgcacagtcacattccgaggttcttggggtcaggatttaaacatatgaagtttggggtggggggccgaattcatcccataacacagtattaggctatcaaccactgtttgctgactgagaaaaaaatgaatgaccaatagaacacagaaacattatggcaggcatgctcctggaagcagttctcctggcacacgcttctgaaggcctttcctttttcccccttccctctccctccacccatacaagggtccagacgagtgagtcttctgtcaacttcgggtccaacctaaccaatccagtcacacaaaaccctgtgccatgaacttcagacatgatactaattcccaggaaagactaggccatctccaggaagccttccttgtttgtcttcagggaacccctgctcagtagggggactgcagaacacacagaagccattgagttgtctctatgatgatgaccacatcgcagcagggtacagctgagccaccagagcttgcccatctgctccctctgggccccgccatgattctttctatcactgcctgtaagcctttatagtcttcctctctctccttgcaagagaaacctcctaacttgttggccactgatggactttaaccagggtgtttgtcatggacctgtattgccaccaaggtggctttggctccctgagtcctgaccctctgcttgttacttcccaacaggcgtcgggtttggagttcaagtcggtagccgacagcgttctgtttttacgtgacaaaagatgggaagaggtcagaggtgccctgatgtctgctttcagtcctgaaaagctgaacgaggtaagacatgagaaatgcaaactctcttctcttacggagcaggtttcttctctccaaatcgtgatgagagccagttcatgttgcatcacttgcccaggtgacacatcaaaatgcctttcccactgggaccttcagacctctctgttatgcagaaagcacgggactctgtgttgagcgtctttcgtctctccagcctcccatatccccacttgccataaatgaactgtgagtcaacaagtacacagggcattcgcctgtgtccagagacagagcttgaggtgctttgggggccccaggagacaactgcaacagtgtctgttggactgtcatgcataatggatcacctagggatctggctacaaagcaggctctgattcaagagggccagggtggcctaagaatctgcatttataacacccggccaggtaatttcgttgttactggacaatgaaccacactttacatagcaagaaactagagaacagcatgaaacaaaggtgacctaccaatcaagtcttaaatagggaggtgattgcagtgaatgactggggaggagtgggcgatcatgtcaggcagggacacccaggttaacctctaggccaagttcaagggaagggcaggctccacaggatgctaccagctctctaaggccctggacactctcctttccctactgagtgactcactctttcctatcagctgtgcacccaaaaccgggtgtttgtacagcctccagaccaatttctcacacaacagatcctgactgctgtgttttgtatctaagcctgacagccccctcaattgctggtctggctttggtgtttgctgttctgaattgtgcaaccacaagggagagagaacttgagcccttatgatgtgaaggggctaaggggcttctttagttccagtctcaggtacacaggcatctctagagcaagggagcttccaaagcttggcttgagtgccctgggcttctgccatccaccctgtctggatgttccagagtagcctgtcttcagttcaataaaaatgaaagctacttttagcttaagctcaagatgctcatccatatggtcctgattgaattcctataaatcttctgaagtcccccagaagaggagggggttccacacctcattatatccaattaaactcactcagaagctagtgatccccccatttttatgaggttttgatttgcatttccatgggtagctgttggtgtttgggggcagagcctgtctctgtatgcagcacctgctcacactcacacagctcagagtcaggtaccaagggttgcctgtttagactaacacactgcctcttcaccacattcctgcgagataaataccatcatccttattattaccatcccattttacagaggaggaaactaggcacggagagattaagtagcgtgctccaagtctcatagctagtaagcagcagagccaaaatcagaatccagctccggagcgctcttcacctctctgcctgactgcttgctacctccatgtgattttccagtggtgctcggaggccacgtaggactgtgccaggggctgtctggaggatgcaggaaggggaagtgtagcaaatggggcctcggtggaaagctggggggtgggggagggtcagaagcaaaacttctctattttctgcctaagtttggaaccaactgaggtatggaaagaggttttaggcaaaggaaataaaattttctcttatcttactggtaaagctgtttgaaaaatagagtccccatctgatcacatgggcttgctatgctaatacttcacccagaatgggacaattgcaggggggtggcagatgccatcggggctggcccgcggcccacatgtgctcaattccttcctccaagactgggtctgatacagtgtagacagcaggagatggagagtgacttagatgcagcggttggccagtggggcccaccgggatcacttggggggctttgaaaactgttgctgcctgggtcccacacctagaaattctcattcgcttggtttgctttgggatgcagcctgggtttgaggatatttttttcaggctccccaggtgattgtcacgtaaagccagtattgggaaccaccaccagtagaagttccccacaaggacatgagaggaaaggggcacctgcttccactgcaacaattagccctgctcacattgatctctgttatctattgaggattcacaggagaatgtgaaggaagggcctgcatcttaaagctagaaaccactgctctaaaccatgtagactagctgcctggagtgtgcccctttatcacatccagccactaaaaggttgagtcagccaagagaagaccgggggaagagaggagaggtaggtgagcctagggctggcatcactagcgtatatgtctgtattcaaaagcaatggcttcatggcactatagaagtagaaagaacctcatgtgtgaaaaagaaattggtaaagagtatctgagaaaagaagaaaagagaaagaagaaaaggaagcaaggaaaggaaaataaggtttagcagtcctgggctatgattctttgataaggaattttatcatggtctagattcctttaaccccttacaggggatactccagaaagtgacacattgtcgtttcccaagcaaatccagtgctcctggagtccagtcttctccctctagtccagaaatcaaatgcatagtgcctgaattaattgcagaaaatagagttcctcaatatgtccacggcattaagatgccaagagaagccaggcaaggtggctcacgcctgtaatcccagcactttgggaggccgaagcgggtggatcacctgaggtcaggagttcaagaccagcttgatcaacatggtgaaaccctgtctctactaagaatacaaaaagtagccagtgtggtggcaggcacctgtaaccccagctactcaggaccctgaggcaggagaatcgcttgaatccaggaggcagaggttgcagtaagccaagatcataccactgcactctagccttggtgacagagtaagactccagactccatctcaaaaaaaaaaaaaaaaaaaaaaagccaagaggtagagagagatttcatagagcccattatttaccatacactatcaataaccttgaaattcccttgaaaggcatttttttctactccatatagttcaatttaggttcttgggtttgcgtttgaaaggattccatcccagaggcaggagaagttaactttttccccacctctggggattttagacctggcgagttgaagtttactggaaggcccctaaggagacccttcaagaagaagttggctgtgcagatggcactcaggtgggagggggaagaaagatggtcttcaaaacacagagacgtgtagcatatgtgttagatatggttctggggagaaccatatttaagggaggagcggaggagaaacctataaagaagactcaggaagaacagcctgaaatggaaaccagcagaatgtggaaggggaaagcatttcaaagaggaaggagcagccagaggtgttaaatgctgctcacatggaaagaaacacgaggacgaaaaagtgcacagcaaagataatatttctgaaacgtgaaaccaatgtatgtctgtttcatgctccatagatcgtgttccctgtaattttcccgcacccgcggaatcaatggcaccagtgggtgctcctgaaggtgcctctgaggaagacagtaggtgccatccagaacaaggaagtagttgcttgattttgaactgtacgttagcaagctttattaggagaggaaagagttttcctaattccaaaagcagctcccctttgcatatgaagagcagagggtttgaggctctaagccatggtgtagacaggatgcaggaaatgacaggggggctgcttctgggctgtggaagatgggtggaggggacaaaatgagaagtgtcctatattcctccccaaaacctcctggtttctggatgcttcctcaaactttaatctcccagctgcctttgttctctaagtcactggttctcaaaccttgtgggaccaagggctgcatgagaatcacctaggacccttgttaaaaatacataatttcagccacctcaagatctatatagtcagaatttctaagggtaactgagaattcgcatgtcacgagttccctggaaagattctgctgagagccagcgtggaaagccccggcacagtgagtgttcctgttggtcctctctctgaccacctcagactgactacatctccaggctcgaaggacctggcccctgaacccccaccctccactgctttatttttctctgtggaactatcaccagctaacattccattttgtttacctgtttattgtatgtccccttctgctagatggatgcttcaggaggacaaagtctttttgcttttttcttattttctttattgttaactgcacacactaggtacataatagacattcaggaacaattaatgaatggatgtatgaagaatcaaagaaccgagaagctttctacctattctgcctaaggatacatgatgaaactaagctaaaaaaatgaaagggaaataattctatcaagaaaaaattaaataagaggatacagcaaactggcttttcctttagagagtcaccaatatatacacatatacgtatacacatacaaaaagtcacagacacaaagagggaaatgagccacagtgttaggagatagctcagagactctgagccacagatactcggctgtgggtacctgagtcagttttcctggaaatagctttgaaataccagcatctctagtcctttctgaatttgtaagtagtctttggacttttgttatcaaacatcagagtttattcttgaaataaaagtttgtttccccttggaattctgaggctttctcctttagaaccttggcagcctaagtccctctctacctgtgtctttaagtatggtcaatattcaaaagctttggatggcgttgtcttcgtttatgcggatattaggttgcctcagtcaacaatgcttgaaaatggctttaaaatgagcatcatatcatgaagccatatttgtatttaaattaaaattgtttttttttttggtctatgtcataccagggataatatagagcaacagagaaccagggaaaatgtgattcatgcatctccaagtcaggaaaaagagactattggaatcatagccagcgacaaacaagttattgggatttatagaaaaggatggctgagcattcctggaaaaacaactgactttttgttgttgttgctgttgttagggaagattttgtctgcttaactggccagagttttcactccatcccccgaagaattgacgttttaaaaagcacaactgtagatttagattttcacagtcttttgctagattctttaccaaagactattagtgagtagtaaccctgggattgtataaaactttattaaggatgagggaataaataggtttaatttcaggaaataaaactggggctaaattagtacttctctgacggaaaatgtataaataatgtgatcccctggggacccaggttagcactagatttatttttaaattttataactcatctgaaagagagagaacacagtggaatctatatatttgtatattcctctaagctgttctgatttgaaagatattaaatcaataggaataactttctgagactcttgtaagattgcataagtcagcacaaaagtggcaggtaaccttcagtgtaagcaagaataaaagaatacatttaggagaaaggcatctaaactgtacttatatgatgatgaatttcaagctatgaattactaccagggaaaaggatttgaaatatggaggaccgaaaaggccccatagtcaaataatttggtgaaatattacaaactatattcttcaagattcaccatgtacctgagcatatgaaaggcttgagaaaggcctgcagtaaagaaacctgcttaactttgtttattctgggctcaaataggttttcaaaaggagagaacgtgggttgttaacttcctggttggctactgagagaaatgagtctcttgagcaattatcctttgcaggtagcttccatgaagaacccagtttttgagtgcctctagcagagactaagcttcaaacctcattaaccatggatccaatccaatatggcagcttgtatgttctccattctcaaagcccaatataaatgatgggctttcttcattcacccagataactaagagctgatggtaccccattgagcagatatgggagacaatgaatcttcatagatgagtgcctaaggatatatgtgtcactcaagagtaaatgaaccaatcatgttgctatgcatagggactcagttaaagaaaagtcagataaaatgggaggctggtatctcgcacagcactgatccggctctctgcctaatttttcacttttcatccagatgttccccgtcaagaaggcacagtcaataatgtatgaatcttaaaggcagaggcagatgtggttattactccctgtaggcatttcctgacttggagacgacatgttactcgagaatgactacaatttttaaaaatttaagttgatatagcccgcttatgagtaaatgcatttcagtgcaaaagtcttttcagaattacagtcatcatcacagtttagtttggcctttaaattttcactgtaaactctccagatggtcacatatgggggcttctaaggcagaacacgcttcccaataacattagagcaagcagccttctctaggaggcatccatttccagcagtctatttttaatatttgcttttatttcttaatcctcctgaacaataaaaatgaacgtcattataaccaagtgtggctgtagtcatcaatacttcagagtccaaaaatacattggccttgcctgaccagttgcccattttctggaatagctgggtatttatctagcagcgagagaccattatcctgagacacagtcgtgttccaccgacacctgatctactaattaaaatcactatcatgatggactgtttaaattctggtttaaatgttccttttgcatttgcatttaaaagaaaacacactcctcatcatgggcaccccagcctgggttataatttggctttcctttgccagaattataatgtcactctgacttgccgctggttaaatctaaaagagcatctaaatgtgcctcacagcttggctgttgcttggcaacgccagcagccacctcctcattggggtgacttctaattggtcacaagtcttgacaggagccactgacttattagaaatgacacttgattattcacctagatggctagagctgatacttagcagcaggaaattttgcataaaaaggagtcgtggatgtttttaatatctgggtggcttttagcgatggtgtagtggaagaaggaagtgataagtttcattagtggaaattaatttttcatttgttggtcaccagtttagagcactttaaggcattaattttttcatttttaaaaaaaacccagaaatacgtttaaataccttcccccacccccagcagctgacccttacttattcagaaaaccctcctctgacatcagccccaaaatattgcccccaggtccaccaagggccaaatcagatgaaatgttcaatttataaaggtcaacaaatatttattaattagttcctgttgttaaggagtttataatgtagaagagaaacacggtacataaatcactgcattattaccaatcgtggaaggtggtgacagagctggggtcctgctttgagcatcagaagccactttggcagggaggaagcagtgagtagcaccggaattgagctctgaagattttgctgttttgacagagggagaaggtgcattgcaggtggaatgagctgcaggaatcaaggcatctggacagaaaagtacagggtatgttcagggaataggggagtacaaattggctggaacacagagtacatgtaagggattagtgagaaagaaagctgaaaaagtaggttgaggcacgtacagttcactgttctgtgccgagagagtgtttggtgcacacttcactagagctcgaggagctattaaatacttgaaagtgagggagtgacctgctcagaactctgtgttaggaaaaagggtttcatttcagctgtttagcccccaagccagccatttcccagacccatggggcaaatctttctggtgcagatgaggggaactgtgaattgtctggaggagtctcctctttgtagtagccccaagtatgggcaggctcccaggggccatgttatgacatcaaggcagcggtgtccactgtggctcttttgagtccctcttcgtgtgtggatcaacaagtcacccaagctacacaccatcaacgtttggggcttatctctgtttagatggatagggttatgcaaaaaagaccctctccttccctctctctgtgtaggaaatatgttttccctagcactcagcattgtccaaactttcaggaactccaaaggcttaaagatggtgggttttttctttctcaagtttatgacataagatctgcacagaatgacctagaagtgaataaactaaggagcaaaggaaatgtggaggctgagttttgtgggaaagcaacaagccaggagtcaggatatctggggttccaattctcatttgaacacaaaaataaccagattctgccctttaggtccctatgtattctgaagttgatgtgtcaaagaaatgacaaaaggctttcttgggaatgggatgtgttgctgaaagcacatggaccaatgatctgacacttccctgcactgagctaagaatttggctgctctctccatggcttcaagcaactgtctcaacctgatgctttgtgacctccttggaatcttcaaatgtcagtggaaagggacattatagctcattgcgatcagcccttcatttagggatgaggacccacgttcagagagattcaaatgccaggtccaaagtaacacataggaccagcatgagtctcagctttcttcttcagagccagttttcagcaaaccacactgtattcatgctaagagacagtgcctcaatctgttcatgtttcttgggtaccttctatgtcaaggctctcaaggaacatttgatcaatcagtcatcacacaggtatttctagaaaatcaacagaatggggtgtgctatgctcattcttgatataacaaataccaaaaacttcattaatccatgacaacatgcaatagttaccacaaaagagcaatattgagagtgtattagttatctattgctgtgtaacaaaattaccccaaaacttagtggcttaaaacaaacttttgttagctcattgtttctgtgggtcaggaatcctggcatggcttagctgagtgcaaaggctgagtccagagggactgagggctgaggccagagggatcaaggtgtcttggagtagtagtcaaatggctggcctgatctgtggtctcatctgaaggcttgactgggggaagatctgcttctaagcctcatcacacggttattagcaggattcaattcgtaatggactttggaagataagaatcttgtactgtgtccttcagtcagtggggatctacaaatgtttcagcaaagcattactgaaataacaagtatttttggaagatctggccaggcatggtggctcatgcctgtaatccaagaacttcaagaggccaaggtgggaggatcgtttgaacccaggagttcaagaccaacttgggcaacatagggagaccccgtttctacaaaacattaaaaaaattagccagctgtggttgtgtgtgtctgtagtcccagatattaatacttgaggggctgaaatgggaggatggtttgagcccaggagggcaaggatgcagtgagctgtaatcatgccactgcactccagcctgggtgacagaatgagatcctgtctcaaaagaaaagaaaagaggccaggaagctctttcaaagaactttctttagtacacctgggtgtcaggcactatcaaagtcctaagactacaaagatgcttaggctatagtcttttttctcaagaaggaagatgacaaccatattccaggtgacaagtagcaacacctgaactaggaggtgactgaggagataaatatgaaagaacagatgaaagaaaggaagcaatgttaacatgatgaggcaagaacagatggctccaatggggagttgtccctgaggaacaagaaaagagaagagaatgattccagtagtccaaaccagcctgggaggatggatccctccagaggacaactaccatgtttacaccactccctgccttctgtgccaagtgttttgcatattttgtttctaatctttgtcacgactcttcaagggaggtattattttcatttttgcagatgaggaactagactcagtgaggttaggcaatgtacccaagatcacacagctataaagtgccaggggaaggaaacctactaatttgcagtgcctttgagtatttgctatgcttggggcaagtattctccaacaaggtcggaatcttacactcaaggaaggaaactcagtgatgagattctgtgagtcacccaaaaggagaggagaagaagacctttgagcagaagctctcagcccttcttggtcgttactctctttgcccactcatcaggccctccctccttttagaattcactctgttgccctctgtctgcaccttgactcaaaatttcacagacacagttggtagaaaatccattaaaaaaaaaactggtgcccatcaatgacagactggataaagaaaatgtggtacatatatggcatggaatactatgcagccataaaaagggactagattatgtcctttgcagggacatggatggagctggaggccattatcctcagctaactaacacaggaacagaaaaccgaacaccacatgttctcacttacaagtgggagctgaacaatgagaacacatgcgcataaggaggagaacaacacacactgaggcctgttgggggaggggggaggaagagcatcaggataaatagctaatgcttaatacctaggtgatgggttgataggtgcggcaaaccaccatggcatatatttacctatgtaacaaacctgcatgtcctgcacatgtatcccaaaacttaaaataaaataaaattttaaaaaactgggtactttaattacataagaatctccaggttatgcagaaccttccttccttggggaatttgcttcccagggtggggatggtgatttcccctgaatggttaccactggttgccagacagctgctcagcctcacactcggcatcacctgtgtagggacaaccaatgtgagaggcgagaggaacaaaatgggaaactttctcccctagcttggctactgcactgcaaccccggtcttagcttgggctgtcataaccaaacaccattgagtgtgtggcttaaacaacagactttttttttttttgagatggagtcttgctctgtcacccaggctggagtgcagtggcgtgatcttggctcactgcaacctccacctcccaagttcaagtgattctctggcctcagcctcccgagtagctgggattgctggcacgggccaccacacctggctaatttttgtatttttagtagagagggggtttcaccatgttgaccaggctagtcttaaactcctgacatcaagtgatccacctgccttggcctcccaaagtgctgagattacaggagtgagccactgtgccaggcccagacatgtattttctcacagttttggaggctgggtgccagcgttgttggtttccagggaggcctctctttctggtttgtgggtagccgccatcttgctctgtgcccacaagacctgttctttgtgcatgagagagagagagagggagagagaataagcatgagtgctctggtgtctcttcttataaggacaccaatcctattggatcagggccccatccttgtgactttaaccttaattacttccttagaagccctatctccaaatacagctacactgggagttggggcttcaatgtatgaattttgaggcaacccaaacattcagtctataagaactcccaataaatcactttttttaaacctaataacattaatattttatctgattataagtgtaatacatgtgcattgtgaaaaatttggaataaaacaaaaaataaaaattactcattatcccatgaagaagatgaaatgtaacaaccgaatgcatcttttagtaagatctgagtgagaatagcattgtgtattcatctgtgcatgtgtgtgtgtgtgcacatgccacgtttgcctgcttgttcaaaaatctaggagaagaactgcggggtttgtggattgtataaagattatgcaagcccatcaaagacagcttttgtttgtatgcaactcatgtaaaagtaaatattccgtaactgctgtgtaaaatgcaaggaagaaaacctgaaatgatggctattggccaacatacagattatgctcggctgtcttataatattttctctgcattgctttttaaaacatttttcatattacatgccccatctcatatcacattaacccaaataaaaatgtcattatccattcagttcgacagacagcaagcagagtatcgcagaaaattacaatcacgtcaggcagcaacaaaggattctagtcaaaggcacgtagaagacccgatggtgggcagctggcctgggctctctttcacactgtccaggaatatgtttggattcagaatgggtggccccctctttatacacagggcatgcctctgaagagttgtgtgtaaatcacattttatgttccatctcttttgttatgttaagaaagcttcaagctagatatctaaaaagacttcctttcaaacagtacatatatatatgtagatagatagacagattttcttttaccatgttactattcctctgaagtaaatttaaaaggtatttaggtttatgggattttatgaaactaggattcagttgtaccactaaacttattaagataatcgaaggaagatagccagtaaagctagttataaaaatgtggcttagactgtactgacttttccaatgttaagggtagactgagacttcttggaagttggggcctagagaccattttaagtgacccattggcacacccttttgtactgatggattattaaatcgatggtttgtgagaatttagaaaagcatacagtagtcatgaagcatcaacacagagatactaagaataaatcaggatagtcatacttatttttcttttttgagtggacttccagataggtagatgaggtaaatcacatttctgtttctgcaaatcatttgacaaagtcttccccagctgactcatcagtaaagcggtgcctggctgagtatttacttaggttcatgcacagatagcccaagatccaaaaacagtgatgatgaatgattctgcggctacctaaactagctgtccagtggaggggcacaaggctctgcaccagggcctgcctacagaccaatgaactgaagggaggcttagaaggcacacttactacattgcagatagaacgaagaaagaatagcccagtgttgcaggtgatgggatttttttttttttttttttttttttgagacggagtctctctctgtcattccagtgatgcattcttggctcactgcaacctccacctcccaggttcaagcgattctcctgcctcagcctccgagtagctgggattacaggtgcctgccaccacgcccagctaatttttatatttttagtagagagggggttcactctgctggcccgccaggctggttttgaactcctgacttcaagtgatccgcctgccttggcctccgaaagtgctgggattatagacctgagccaccacgcctggccaggtaatgggattttaatgagtgagtacatcttttgctcccccacagtgttcaaacaccccagtgctctaagccctgtggctttatgaacagcaaatctattttcccaagatggctctccctccatgagccttggcaacagggcactcatgagtctcagatgctctgctatctctccacttgggtgtgttatgctgtgaacattctgctccttgagctgttgttcagccgtccatagcgctgtccaggccattgtccctgccttggttaccacctccacgtggcagccttcatggagccattgcagctttgatctacaggactccctcaccctccatctacgggaccccctcgccctccatctacgggaccccctcgccctccatctacgggaccccctcgccctccatctacgggaccccctcgccctccatctacgggaccccctcgccctccatctacgggaccccctcgccctccatctacgggaccccctcgccctccatctacggggacccactccttcagcagaggagttgggcccctggtaacacaattctttccttacacccagagcacgtgggactgactcggaggaaactgcagaggagaggggtcctataaaatttcatgtcctcccaacatcctgtcaatagccggccagctgtcccactctaccaggtgtctccaaccaactgaatattccagagaagataagagatcgttctgctcagaacacacggcaggacaactagtgcctttctaatgaatggtccctaaaaaaatcgaaatagcaattgtacctggttatcatccatggaaaaagacctcgtggttttcattaacctgaacctcaatatttgcctgcactgtttgtcttctagaaaagtcaacataaaactggctttgcgattgacgtgtagggtacagatctcaggaagtgattcatttaccatacaccaatccacacctgaaatactgtattccacttatgaggccacctttaggagtgaccctgataaagatgagagcaataaggcaggaggggtgtatgcaagccatatggttcagtcccccattgaaaggatgggggcagccaggcacagtagttcacgcctgtaatcccagcactttgggaggccaaagtgggtggatcacgaggtcaggagttctagatcagcctgatcaacatggtggaatcccgcctctactaaaaaaaaaaaaaaaaaaaaaaaaaaattagccaggcatggtggcacacacctgtaatcccagctacttgggaggctgaagcaggagaatcacttgaacctgggaggcagaggttgcagtgagccgagatcacaccactgcactccagcctgggcaacaaagcaagactctgtctaaaaacaaaaaaaaagaaagaaagaaagaagaaggaaagaaagaggaaagaaagaaggaaggaaggaaggaaagaaggaaggaaggaaggaaagaaagagagagagaaagaaagagagaaagaaggaaagaaagaaaaagaaagaaagaaagaaagaaagaaagaaagaaagaaagaaagaaagaaagaaagaaagaaagaaagaaagaaagagaaaggaaggaaggagggaaggaaggaaggatgggaacagttgtctaggagaagatggggagcagataggtacttgctgtctgagtgtcgggtgcactgtcatgaagaagagaacagaaatgaaaccagcaaaagattgttagacgaagtcagattttgcctcagtacaacaacataccttctgagaagcagattaactttataacttttcccagtgcctcaagactttaagaggaaagagtgggtattacataatcagtacgatgccatgattcgttcattcacttaacaaataattactatgagccaggcgctgttctaggtgctgggtttataaaaatgaagaaacagactaagatctctctgacctcgagaactcaatattctagtgtgaaaatcatcaaatctaaacataggttacattttatgtctttcatgagaaatgctcagaatgatgtattagagcacgttgctttagctgtgatgctattctagaatgggcagcgaataaaatgattctgctcgatattttcagcttggccttttaatcatgcaagagagaataaaaggtcacatgggtggccagcaggctccacaaagaattccacccacccgtttgtcgaagccgagtggtatctatgtgaatctccattatgccactctacctttctgtgtaagttaggaattttctaacataaaagtattttcctattaaaaaaaagaaacccaacaattgccccatgtgggcataggaggcatcttgaagtcaaggttttcccagtattcgaaagcttagcggcttaagcacaaaagaataaccatccatcaggaatgctctataaataatttctgtgttaaataagaagttgaaatggatgaccttaggttcctttggatactaagattcaatattctagtgaaagatctaaaatacaatcggaatacacaagcatagacttgggttaattccagggattgtgcatatggattaggctttatttactcgctaatgctaaccaaatgtcatgaaactgagtactgattctcagttttgtctaagcacttaatgatcattttcataattatttcaccgtattcactgtaaatctgttcttcttttttgcttccaaagataaaaaatgcttaagctaaaatagacgtttagagctattgtattttatgaatatttgtgaattttaggatcttcttcttgaatcttagctgtgtgaaaaatatcttccaaacagtgttcattttcccagaaagcactacatataacctcttcatctgcagccaatttaggtgtactcccggcatggtgccctaattacacctttgttatccattatcagatggttcccctcatcagccaagcctgcgaccttctcctggctcatttaaaacgctatgcggaatctggggacgcatttgacatccagaggtaaggctgctgcattacagatgagaaatcgagtttttgaatcactgcttcttgtaactgtccataattgctgacaattaccttgggactagcaaactgtggaaacgctagaagctcataaaagcatggatggactgattaataaaaagaaaagaaacccacttaacatgggaaagagatgtgagcagagccagggtacgtgcgtcctgtcgaacctgtggatggatccaccctctgacctccacagacccaggaatgggcaggacaggcctgcgcctaaggacagggatggggggaaagttcaagcattttcacttcaagaaaaattgtggtgcacctcagcccagaagctataacttagtggtggacaccaaatttaaataactgattatctggcttttcgtcattttgtaactaaaaggtttttgctttaaaaaaacatctttagtctaagtttgtccgacccacagcccgctggccacaagcagcccaggatggcattgaatgtggcccaacacaaatttataaactttcttaaaacattgtgagtttttttgcagtttttttttttctcatcagctatcgttagtgttactgtattttatgtgtggccaagacaattctcctgcttccaacgtggcccaggcaagccaaaagatttagccacctttgctttagtcattttatgccaaatcatggcttacagcagataaagaataaagtgggatggtgaatcatccagaaatttattcattattatcattgctaataaaataataacataatcatcaccaacactggtattgcaccagtttacacagtcttttcatccacattgtctctgattattataggatgcatgagttggctaaagataaggtggcctcatcagctataaaagcaaagtaaataaccctcaagacccttaaatcttcaaccttcaggatcagatgaaatcacattcagtagtctcattcttgttttcactctagcagggaaatgtgtaatcagttgtagaaacgttttcaataaaagcagtgtgaattttaaaagtcatctggaaacgtcatgtattccttaatgataagttagtggttatagaattcatgtacaaaaggagttaagtgtgtgcctacattgagaacaaaaattggccttttaattataaaaagatattaataacccagtttttagctttttggaaaagaacttaatctgactactcctataagataacaaaaagaatcatttgagtttaaaatggccttttgagggggcagctttcctatagcctaagaggttaaattttctggagctcctgccagacacttttccttctgtttgtttctaaagcacaatgtatgttttctgtaataatatacagatgttcatgaagcctgccttaaagtttgtcttgtgtttatttgagtgctaagagcccttgctttttgttcgttgctattaagaaaactgtaaaatcattaagaggaagagggagacaaagttaataaaactagataattaggttgttaattcatcaaggacaatttgatgtctatcagtcaatcattagattctggcctgagctgggctgtgcagagctttgggtacagcatgtaggcgttgggtcacctgtgtgccctccttcccagggaggaaactataaagtgtccttcttagtacctggctgtgttctggttgaccacagctgcctgaggctcgaaggtggaagaggctgtgccctcctctcctcccaggtctttgtttagacgccaggtcttcgtgtctcctcccaccctctgccgtcactgctcagagtgccccatccaggagcccatctccctccacctccccccagatctgcagaagctcctcttccagacacatctgcagggctgggcaagccagtgtaagcaattcaggccctcctcctctggagggggccattgtgggtagcccctgccagagtcctttcagatctctgtgctcccatctcccgtaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactctgtaagtgcggctgcagcccggggcgctgcgatgactccagcaagttgggcagaccccatgacacctggggtggcttctggggctctgtccctgccactgggaaagggcactcgggttgttcccctgcagaggctttgtcttatggagccaccgggttcctcttgtcacccgcctagggccacttattagcaatgctgtagccctggcattggtaataagtggccccaccgccatggtgagaacggttgggacgcaccgtgttaggcacggggtgtgcgttgcctcacttagtcctagtactcaccctatgagaaaaatattcttgtccctatttctcaggtgtgaaacaggcctagaaaggccgagctgagactggaacccaaagcctttcatttcctagggcatatttctttccttcagcaaaatcctcttcacaagacttctccacttgaagcccaacacacagaaatcctgtgtggtggatgaggattaggtcacccaatgcacgaggaccagtctatttattttattttatttattattattattatttttttagatggagtttcgctgttgttgtccaggctggagtgcaatggcacgatctcggctcaccgcaacctccgcctcctgggttcaagcgattctcctgcctcagcctcctgagtagctgggattacaggcatgcaccatcacgaccagctaattttgtatttttagtagagaaggggtttctccatgtcggtcaggctggtctcaaactcccgacctcaggtgatccacccaccttggcctcccaaagtgctgggattacaagcgtgagccaccacaccaggacttattttatttttattgtagaagtgagattttgccctctggccaattctagtatcttcttgcttttataggagcattgacgtgttgttatgcttggtattgattattgccatgatttctaaccattctgctgggctggtaaattccattcattccttgaccagtttcattcccgtttctgagccgatgtccatgggagcccgtcacctcactggctccgccctgaaatcgtaggcagagtcactctgagtgtccagcagtctcttcctgcaccctttccaccgatcttggaggcagcgcaggctgtgtctgccccttgtgcctcaaccacggcccaggcctgtggggcaggtggctcagttgtgtcatcccttctatttctcctctctgcctctgcagggccctcctgctgctgtgtcacattggttcggactctggctcttgaaaatgggcctgcgcattctgagagcatgtgtgtctggagatgttctccccagcccagctcccatagagcccggtgcagggtgaacccacaatggaagctgagaagctgaacccagccagtgcccctctccaggggagatgaggggttcctgactctggcagcccgatccccagcacatggcagcaagggcccatgctgcacccaggggccggcaagggaggcacccacagcagcaacagccagtacccttgtcagcagctgcagtggcagctcttgggagcaattcaggaggtcatgctgggaacaattatccactggaaagaaaattcaaatgaccagaaagtttgtaaaaagtaaatcagcttctaccacttgctaaggcttgaaacagcctgtaatcctttctctcttaatgaagtacaaagaccttcaggtctcatccccaggacctgaaacattaatttatgagggtgaccttgacctcttgagggccagatggaagtgcagactcgattaattgcacagatgtttattgagtgcttactatgtgccaggaatggtgaggagtaccgagagggagtgagacatcacccctgctctcagaagcagcagtgcggcggggagggcaggactccaaaacggctccgattccaggcccgcgtttgcttcccgggaacaggcgtctaatggccctggtttattatcacccccttttcaatgccacttttgtttttctctttcaagtatcatttccatccataatggtcccactggcccggattttgcccaataagaaccgagacgaactgaatggcttttttaacaaactcattaggaatgtgattgccttgcgggaccagcaagctgccgaagaggtaacgtattttaataggacacagccttgaaatggaatggagccgactttggcatcactgtctctgctctttctcttccctctcagccccgcacatcacaccgtgccgtccttcagcaacccaccacttacagcttccagggacagtggagagaacagaggaaggttgaggaaggtcagacaagaaagggagggtgggacggcagagagaagcctacagcaatgtgtacatcctcggacacggacgggtagaattaaagccgcccccaaaactgtctccctagtgcaagcatcaacccaagcacaggttagaatagcccagaagaattttctgggtaagtgtgcccacatgcaattttcatgagcatattctttatattgaaaacccagcaagatggagttctccagcatgaacagcatgcttattagagagttcggcaactgtcagtcactaaccccacactcccactcagcatggaggatgtcgctacagaactcgtggttgagggccccctggactccttggcacgattcatatgagacgtagcattttctttcctccttgcagatttgcactatgcttggcacatagtaggaatcaagtaaatatttgttgattgaacttggctaaaatagaaagaggagttttcagtgggaagaaaggtcatttcaatactggatatgcatatgcatatgtaaatctgggctttaaagcccttgtcacattaaagaaagttactaaaaaggaaaacagggctgaaatggcctttccttagctggctcgtgcaagatgcaactttaaaagggttgtctcaaagactggatggctcagaggaattggtgagggccaattgttaaggcactggcctgaaatgaaatcaggggtcaattagtggcttgatacaccgagcggccttgggcagcagccgcgtcctgtgcagcttcacgcccggagaactgtgcagcaaacgtgtctagatccagaaggcatgggaaggtgtaggcaagcttgcagccccttcggcccacaccactgtgaactcaactcgcatgtccttggaggtgcgggaagaagcagctaactggcatccctgccccagctctgaagcctaaaaggacagaacattctgatccaggttcatgtttctccgcagagtgaggctggagccagggggagaagggataaagaaagaaccattttcaaccctcaacattgctactaagggccaccttttgagagtgttcacacacacacacacacacacacacacgcatccctagcctggctgtggaatcaggctaaaaattttaaaactgttgcatcgaatgacttactaagaggtgagaggttattaaagatccaattactgggattgcctagagcttttccttttataaactctagtgctatttgtttcaaacaatgagttgatctgagaaaaatctcccaaccacaaatccaggacagccatgtcaagacagagctatacggttactaagaaaacttgctttaaaaccatctaaagtctgtatacattccatcaagcagatgtgtgtttgcgcagtgaaaatgcagcacagatgttaaaaggtaaatatttttctaagctctagccgatgggtggattagacacctacatctatcagggtgcgtattttccttggataggaccataaaccagcaccgtttcagtcctcaatgggcagtgttcagatagcctccctgatgccatgtgaataaaagaaacccatctatactaatgttcttctccagtgcacgggccctggagagtggcctttcctctggcctctgtagctggaggttaagacagatttctgcaagattctgacagccctttagcagtctgtctgggctgggataagaggaaaggatgctggctgcagttttgcccatggaaaaatacccggtgtagaggtggctgtgccctccctcccatcattactcctacactacctcagcaaagccatagccaagcctcagggaccacaatgatatcacaccccgaggaccttcagagggactgactgagaggtctgggggtgctctggggtcctgtgctggtgtcccagagctgagggagcaagggatgctcacttcccctgcgtgccatcttgcctgaccctgccccagctctgctccatgggagcagggccagcagtgggaccacaccagcgcccattgaccgagcagcaggaaggaagctggggaaagccagcccttgaggatgctgtttgaaaatcagaacgagcagggccagggtggaatgaagccaccaactacccccgaccctcaccattttctcagctattacaacccagcaggctgttgggaagctgaggccttgcttccttagactcaaggtctgtggcacccatagtcttaaccttgagcactgctaggatcccagtaggcaccttccaaagtcacaaggctggggtgcagtagagctgcaaaggtgtcagcagccaagactcccgctctaaagagcattcacttgtcatcaaactcagcatacccatcctccaaatgcacgcactgcattacatttttatctgttgagtcatggactgcagatttaacatgtgctcagcataaaactaggcacggtgtcaggggttgagggtggggtcctgccctggagttgcttataatcttatggaggaggaaaagcaaccacacatgaaatgacaacaatcttaaaagatggaatcatcaggaggctgaggcgggcggatcacctgaagtcaggagttcgagaccagcctgaccaacatggtgaaaccccgcctctactaaagatacaaaaattagccgggtgtggtggcacacgcctatagtcccagctactcaggaggctgaggcaggaagatcacttgaacctgggaggtggaggttgcagtgagccaagatcacaccattgtactccagcctgggtgacagagcaaaaaaaaaaaaaaaagatgaaatcagacgctcatgtgtgtggcatagattattaatgcaatcgaaattcagaagccagtgaactgagaaaatgctgcagctagcagagtactttgcatgaaattctaatatttttctgttggtgattctgatactctccttttgccattttagtcccataaacttcagaaaatggaaatgtcttggttgtccttcatgacattaaagagcatttcaaagaagggatgttctaggaataagctttgttaacacagaggcgatatagaaacactcctattgttacaattagtaatagtgaaaatataaagaatatgcaaatgactgataaagaaggtagggggaaatggaaaaaaagctctgactacttaaacgggggcaggggattactgagaaatagagggaaccgatgtgaagatctgatatgaaggctaggggatgaagaaggcaaagcctggagactttgaagacaggcgccgccaaactagtcccctcgccttgccctcacttctgttaacttcctactgtgtgagaaaaactggtggctgcccatctaagccctaagctgcacagaagtgagcagtacagcacatgcttggttttaaatctatctatgtgatgttgccattgttttattgttggaaaaccaaccaccaaccaacagtacaaaaatgtataaagtaaaaaataaaagcccccctcctggttttcccacctcctccagctcattatgaactgttgggtggggacattgctaaaatcgtctatgtgtagacagatataggtgatgatatatttagtacatttgctgtttttgcagaaacgagagccacagtgcatactgttccatgaccggctttgtttttacttaacaaagtggctcaatgactttcacatcagcccagatagaatggcctctgccttgctcagggcagcagcccaggctgctcttcactgccccagaacctgcctgaccagtgctatactaagggacattcaggtggcttccaggttctcaccgtcccagataacccagcaatgaggaagcttgttgctactgagctcttcaaaagctatgcccatgtatcttcctcctttgttctccaggaagcctcactcttcatgactgtaaggtcaaaatgtgcatttttctccttttgttccttagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacgtgagtacaagttggatccagttacccatgggatatccataggacaattgattttgtgtttgtgggagtgaaacttatttttaatgacttgctaatatcacattctaagcttataagatgaaatagggtcattgcttggcttctcctgctctccgggttagcaagcgaaatgaaatgttgagaacaataaccacaacaaaaagacaaattgtgtgtgcaccttcactgtctggggtagtccatgaagccaggcctggctcgaggaagctgtggaagcccaggaaggtgtcaggcccaaagggcagggatggggaaggagtcatggcttcccaatatctgacttggagctgccacacggagggaggcaggtgtgagccagaaaggagagccaagatagaaggcaggagtggacaaaaggacaggccaagctgaagctggactgaagactggaagctgaggaggaggctcacaaatggaataagggaagatggggcccgtcagcgcccaggccagcttcagggcattttcttctagatgaggcccctcttgatcgcttatagcagatataacgagggtgctgagcaaggctactttatcacctcattttttcctctagatgcttgtgtgtgtataactttgactcatgagttgtcaaagagattcatttttaaaatctgtactttaaaaggaagaccaccacagtggaatcctttctgttacattctgatatgattgctattacattcaccattttgaaaggtggtctgttctgttactggaaccattaaaaaatgtttcatacaatgaactgaaaaccacttcccgggaaattctacttctttattctactggggaagtaaaggcaaagtcagtgtctcttcttcacagcagtttttaaatatttgaaaactgcattcactgtgttactaattaattgtcttaactttaggctcaacatgagtttatggtcaacttcaagttctaagtagttatgacaactgccaagctgggcctttccaaaccctgcttacacaattgatttattgagcctagacggaagagtttatatttatccttattactgttcaagtcagtcaaaataattttgaatcttgattctgccatctgttatattagcaattcctccagcctcgtgtcatctgagacttattaagcatgtctcctatttcatccaagtcattgattaaaatgttgaacaggacaggacttccctccagattgacattgatccattaatcaatattctttgggcatggaatctcaacaagccatgaatccaaataaccctgccacccatcttattctgttttatatgtagtggtttgtgtatttgttcttaaattgaggaaagggtagagggagggaccaacggtgactggggtgcattagtgcaaaagaagtaaaaggagctggaagcgaggcaatctattaggatacatttagttgcagataacagaaccccaacccaactgatttaagcaaaacaaaaacaaaaagtaaaaacaaacaaaaagactcataaatgtgtatttctgagtacatttaattgagcagctcaggaatagatgtggctccaggcaaatctttgtctaggtctcaaactggtgcacaggtccgtttctctctcgccagttcttggctgtgctctcttatattggccccatcctccatcatgctctcctctcaaagccccaagaagcctgtcaagagtgtctgggactccatacttccttgcttgtaaccaatggagaagagagggtctgtggcctaaaattcccagaaagagtcatgagggtcactctgacgggaatgcttaggtcgctgcccattcttttttattttttttttgagatgaagtttcactcttgttgccgaggctggagtgcaatggcacaatcctggctcactgcaacccacacctcccaggttcaagcaattctcctgcctcagcctcccgagttgctggcattacagacattcaccaccacaactggctaattttgtatttttagtagatacggggtttcaccacgttggtcaggctggtctcgaactcccaacctcaggtgatccgcctgcctcggcctcccaaagtgctgggattacaggcgtaagccaccacgattggcctgctgcccattcttgaaccaactcttgaagcaaggggaatggggtccctgataggcttacaccaatcagactctagccctcagtcaatcatgctcaagtcacatgactgagaacttgggaaggtgacttctcaagggaagcttagcatgctgtcccaggaaggcattagagggaagcccagcgctctggtctcagtaaaccagaaatcacaccaaattaagggctttgaagcatctaatgagtgtccagcagtttagtagacacagcagaggctaggagagggggcagaagctctaagagatagaagtcaggtcctcatcttgcgggaattccatcgccaattgagaagcaatgttatgtctatgaaacaatattttccttccaaacacaggcctgcagggcagtagaaggcagaagataatcaggtctagaatgtgtgatgtcatttagagagccatggggcgataggagtctgtcccaccagctataacaatagtcacatccagttatgtcagtctgccaggaggacacagcaagtgctcatgttaggccaggcacagtggctcatgccagtggctcatcccagcactttgggaggccgaggtgggtggatcacctgaggtcaggagttcaagaccagcctgaccaacacagtaaaactccatctctactaaaactacaaaattagctgggtgtggtggcacatgcctgtaatcccagctactcgggaggctgaggcaggagaatcacttgaagcagggaggcggaggttgcagtgagcaaagattgtgccattgccctccagcctgggcaataagaaagaaactccgtctcaaaaaaaaaaaggaccacatgttattatggggctgtacagactgttgcaaagcactgagaccccttggtcaaataaacacattacagcaggtcaaatttttgagtttagtgtgcataaaagtatataggaagactgcttagaatgcactttccagggtcctgacctcaggggttccgattccataagtctgggctgggacccaggaacccgcattttattttattttattttttgagatggagtctcgctctatcatccaggctggagtgcagtggcacaatcttggctcacagcaaactccgccgcctaaggaacccacgttttaaataaatgtttccagtgattctgatgcaggtggtccctggttccactttgagaagacagccttagactctcaagggctcggatccctcttccaagaaaaaaaatcagggtccaaagccctcctaagccatgcaagccacaaggtgattttcttcccctatgtgatagctggttgtgggggggagtctctgaaaaatgggaatatctacagctgtctttttaaaaacatacatttggtagtcacaataatgttgctttgcatagccttgcacatggcacccactcaatgaatattggtaggttttctttttttcttttctttctttccttcttttatttttttaattttttttttttttactataatcagagctctgttaatatgggccatctgtcaggacatggaaatgcagattagatgttcacacattagatattttcctgaaaatattcctgaaaatttgcatgtaaagtatgacttgttataattttcctgctggtttccattcaacaaatatttcttgagtgccagttaatgccagactccggggctccagccctacgcacgagggtgttctggtctagctcttctgtgacatccctgtagagcatccccatgcctcattagatggccttcccttgtatttgtcaatgagattgcttaatttgagctctagagtttcttttccctgagcaatttctttcatagcaatgcaccatgggaatctgatgagagctacatctcttcctccaagaaagagcagatatgtgcatggcatcagttcagactcttctgtggacagtgataaaaaaaactcagcccagattgtctcagggagtttactgacccctacaactgaaaactccagagggcagagctgccttcaggtatggcttgattcaggggctcaagccctgtccaagttgttctctctccccatttctcagctccggtttctctgggcacactcccttctcaggcacatctcccctaggggtctcaagccagctgtgtaaccagtgttttgaacagtctcaactcagtgaggtaccaacttgaaaccatttggtgttttttgtttcatttttttcccttaaatgtgctctgatgaatctcctttccctgtccgtgatgatactttggacagatctcaatgatttctggtcattttggggggcattaaaaagtccaggccagtctggcccagatgaaaacttcaggctcaaatccaatcagtgcccttctgttctcttagctcaggctgacctgtggcctgaggatgccgccctgcgggaggagaggtctgttttttcccctccttctacccctcccccacccctgctgggcccctttctcctccaggagtggggcctgtgaacggatccccaaatcctgcctacctggagctgccctcagtgccttccctgcggggcttctgacgtggggtagatgcaagacgtattcggagggctcccaggtctgaagtcctcactgcataattccctgccagggagacaggctccagctcctgccaccagctcctgccccaaggctgcttgatggggaatcttgagcaggataccagctagatggctccagcttccatgccttccccagtgtccgcccagcctatgggaaacacacaactgggccacacccacagtggccaccttctgccctctccttcctccctccaccctgtcatgtctctccaagtacttttcctttgctcaaataggcagagagggcacatcagcaattctgctgcatgagcagatggccaaggagaatggcccacctctatgagtggctctgctgaagaccctcttccttggcttgggagtagggaggaccctcttccctaggccaatgactccttgctctaagttttctttaaatccctctaatgtctttataggctgaggatgggggtaggagagagtaggttcaagttcaacgggaagaagcaagagtctctttcctgcaagtctcagcaaaagcctcctggcatcccagtgacttcgagagggtcatgcacctgccccctcaaccaatctttggaccccagaggaatatgatcccctgattggcttagacttgggtcatgtgccccatccttggagttggtgtctaggtgaggccttacccaaaccactgagctctcgagcggaggagaggttgatccccaaatcactcttattaaaagtggggtaaatggcttctgggtagccaggaaacagtgtgtttgcccacccctgtacatagaatctgtggcccccagattagaagttcccacctctcaatttcctgttatgtgatcatgttcaccttccctctgaacttttaaaatccagcttgccaaattagaaggtataagtccggcagtgcctggaacagcctgctcttgcctgtttcttgcaaatcatcccaagttccctgtgatttctgcaggaccagtcggtccagctcagcagttttgccttattgcatccttcaccatttgagaagtgaaaatgtcaggcatgaaagtcaataattcagattctctactgttagcagttctaaacccctggcgcatataaagatactcaaaggtctccctcactatcggggatctgcctccgcacatcctgtctggcaacatcccatctctcatcccatacagccttgactgcattctcctttcagggtatagattttggttccagcttctaaaacagttacaatccacttttttgtttgtttttgttttgttttgttttgtttttgagacagagtcttgctctgtcgcccaggctggtgtgcagtggtgcaatcttggctcattgcaacctccacttcccaggttcaagtgattctcctgcctcagcctcccaagtagctggaattacaggtgtgtgccaccatgcctggctaatttttgtatttttagtagacatgggatttttccatgttggtcagtctggtcttgaactcctggcctcaagtgatccgcctgcctcagcctcccaaagtgctggaattacaggcgtgagccaccgcgcccggcttcaatccactttttaattcatgcccccagactgattctttctggaccacatgtgttttcttccaaatcgtcttgtttgggaattttatctggcctctcctcctcttgtcccaccatcaaaattcagtgtaaaatcttctttctcaagtcccccaatctcttggagaagtctctcttttcccatgttgccttggtctatggaaaaggaggtagtacgttcagtaaattcaatagtggatgggtgggaaaaggtttgtaccatttgtaccactcgtaaagctgaaaaaaccacaccatctatttaatgagacctttgttatatggctgcttcattgtgttctcatgtaattttgaaaaggatgagaaaggaaaaaaaccaacttcttttcatataaattgtgtcttctatagctttagtgttctatgttgaaattattgacttttgatctggctaaaccattctcttttcttctctttggtgctggactctgccagccaaaatttatgacccattttccttctgcttaattgttgttataaatctgctgtgcagaacccagttgtaaatttatcacagactggattggattgatatacagcctctctttaggataatttgaacacagttatgccttagaaggaaggccaaattcttaaaacttctcttgaagagctgctttgtaaccattataaatatctaattaaaatacaacttactctttctttttctcttaaggataaaagaacattctgtgctggttatttcagcttattagctcatgctgctgtgtgagcaaggttgaggatttgttccttgaagcagtcagaggatctccaagaaaaaaaagcatattatgtgcttacaaaaaaaaaaaaaaaaaaagccgttttacccccaactagctttttcatgaatacacatcctttgtcacagggaaagggttgagcaggaaaaaaagtgaatagcttaacacaaatctatcctcactatggaaaaaaaaaatgtcttcccatgtggatctcacccagggaggagggcatggttggctttgagatcaagtagaaaactggaaatgggtttttccccatggggaaggtttcctcccctttgcccaggtctgctggggtcgggctacccacagttggtgaggagtaagttcaggagttccccatcaattcagtcccccagccacacaggggtcagaggtgctgctgagtctctgccttctgacagaccccacaacagcacaacaggacaacagagcacaaagccacagggacaagggaagaggcaaaacagagaacgccttacagccctaatgttgaatctaaaacaaagaacagcgtcactgcagcgtgagaaaagtggcaacgggctgtggcaccggcccttggttagggcatcacaaagtttaacgtgcacgggaatcacctgggagtcactaaatctgcagattttgattcagcaggtctgggacgagcctgagggtctgcatttcttttttgtgattattattttgtatttatgagacggagtctcactgtccccgaggctggagtgcagtggcacgatcttggctcactgcagcctccatctcccaggattaagtgattctcctgcctcagcctctcgagtagctgggattacaggctcacgccaccatgcccagctaatttttgtatttttagtagagacagggtttcaccatgttggacaggctagtctcgaactcctgacctcaggtgatctgcccgcctcggcctcccaaagtgctgggattacaggcgtgagccaccgtgcccggccaagggtctgcatttctaaccagctcccaggtgatgctgatacagccagtccatggcccacactatgtacaaggagccaggttctgaaccatacgtactgtgtctctctcacgtgtgctggacatggcaagtatgtattcctcatgacatttaatgtgctcatgttcttcagtggtttaccttttgctaataaatctcagtggtttcctgatcattccataatcatgatggcattcactttattgagtgggagatgaagtgatgcaggaatgagccaatcctaatacattttagaagtgtattaatcctaaataaagcctaaaatcatctattttcttcagtaattgtttccatggtgggaggttagggggagcttttgaggtgatttaaagtcattttcaaagcagatgaagacggcaacctgagctttctgtcaggacatgtgtgtagactggagacctatcacatccaacgggaccctcaggccaatccttttaagcagggggctccacccagccccttagcttccctactcccctaagccccttggttgtagacagtagcttcgggtgccaggtgggaggccatgccaaacaactatagccaaagagcatgtctctgatgccatttctttggtggcctaggacagaatctgagctatttccactagaggaataggagcttcagcagggggccttggaaatgtatccaaggtacccacctcctgtccttctttctggaagcatctggccctgggaagtagcatcccgaccactaatatcagggcactaatatcaggcaaagggaggaaaagttgcatcctgaccactaatatcagaaaggcccctcctcccagcccgtgaagaggggcctctctgggtgtgtacctggaaccctatcttggaagttaagttttgtggtcactgctaccaacacaccaactcccaggacacaggatactagggacttctgtgccccatcagtggacaagtcacaagttcccaaagcagggtgaccaatcgatctggatcaggtggcagggcctcggatcttaactgtccatttcattgttatgcacacaaacttatcttagagatccggccatctgcctgttcccgtcctggggatacctgcgggaaggcaggctgtgcctcccagaggtcatctgggctgcaaatgggtgccaagaccttcctctgcccctactcaggactccagactcctccacatcccctggagatactcaaagcccatgcccacagtaacccgtagggaaactgacccgctctgcctgggagctgctcccaggagcctcagcagtggcaaccaggagcttagagaccgctgtgcctctccctgcccaccctctccctctcatcctgccccatttctctgttgtctttcctctttcctctcttcattgttcacagcactatttaatctccttcccctctttcttcccttattcttgttctgactctattcccaggtccagagaggcccagaatcttctctgctcctgctccacctcctgacccactgccccctgggagcccctggtcatcccagaagcctgtaagtgcacacagcagccaagacccacatgcctgcaatgggggtggcacaggggaggcagggtgaagagcaggacagacttgcaggtgtttttttctgggctgcctggcttcatcaactgcaacactccagcactttgaatttttagcaattaatgccccaagtccccctccccctgagtccctgcagagcagagggaggggcacctgcaaagagaagtctctcccaggaatgggtcacaccaatcagcatgtatgtggtgtctttcatgtagcaaatcagagtctttcatattcaatagctgggcctctagagggaccaagctttgctaagcaaataagcttgtggggttggttcacatccatccagaaaagcaagaatgaaaaataaacttgggaaagtcagctccacaggtgaagctcaaccttctgtgcatctgcttggcatggagctacatttgcaactgaatggctcatttatttaactattgcacacattatgggctcttaaaacatcaaaagaatgggttttattcccaacaattagctcttgaaataaaagaataaacatactttttttttaacttccccagactctgttgaccaaagtcgctttcacaccagtggagtggaagctccaaaatggtatcatctggtgggaatttaaagacttcttgtccccaaaaaaccttttcgtcactaggcttaaaattttccattgggaggccctggctttgttttgacacatgatccgttattaacacaccactcattttgggaggggaatatcatcaagtcccagccaggatgtaaaccccacgactaggaagcctcgtccgctgggtaccttggtaggtcccagggccgagcacagtgcctggcacgtgagaaataggtgttgagaaaagttatttcactcttccttttctaactggaaaccaactccaagcacagatttgaggggggacgagcagggaggcacagtagataaagcctgtgagttactgcgcccagcgagaaaggggtcggtggagtcaaagagagaaggcactgcgtggggagatggaggcaggttgaaggcaacacttggagtccctatagtcctacaattgcagtgcaattgcccagaagatatcatgctaagaaaaggagggagcctcagccctcggcctccgaggagacctctggggacatctagggcagcttcccatccaggacagatatctgaaagatcatgaggctgggcttgaatcctgctgacaacaagaaacttactacctatgtcccctaccgctgctatggtccgcctcctctgtcagctcatggtatttgagcacctactaaatcagcaaattaatagcttctgcctgggggctgcttccacactccactaatagccaatcgctgggcatctcagagccgagagaggaaggaaaattggaaaatgagtctagaataaggggcctttccaaaatgtgtgcttatggcccagacactcctttaaccctaggttttccagaaagtctgttttgccccaggactgtggacagcattatgttttgtttggtgagctttcttttttttttttttttaggttgtattttataactgaatatggcatgtgtgaaaatatcagctaccagactctgttagtccaggcgtatgaatattccagatcacaagggaggtgtgactcccctgtgaattgcaatgcggaaggtttataaagttaatcatttagaaatctgtctttaaaatttaaatatttagattgggtcgctaggacacaaaaggcaattcctgtttctcactcacttaatttgatttttttttcttttggtcgcacaagttgtttttcaaagcctcattcctcgaatgttccctataggaggaatgtaattaaactccactggcctccccctgctgggaccaaacaggggccagagctgtagggagcataaaacagatatcctgcaaaagaatccttattataaagatgagaagagaatcaacttccctctggttatgaacaagaagctttagaaagccacccaggctatttttgcaatgggcttagtctccaagacattttaattagtaatttaagactggaaggaaggggataaactcctcacctccctggctataggcaagaacttcaactggatgagtaactggttcaagtggctgaaaaggagggaggtccagagggagggtggttccttaaaatgaaccaactttttcatgaaaatggcatagctagatatcccggcccccagtcagtcactgtttttgcagtcccacttcttaaggcagttctcacccctcaccagaggcaggcactgcctctctctgggacactcggctggcaccagagcaaagaagcttgtgctgagggatggttcccctcacaccgggccaacctggacttctctctgaccaaagagcatatgcctcccaccaagcgagaaggtggaaagatcctggcagggaaccccgagacctgggtgctagcatcatccccgccatgagagcacacggggcccctgagctgacacctgctggcaatgtgacgtggatcactcacataatcccttccttagtttttctgtctgtaaaatggggatagtaacattgtgtagctcataaggttgtcaccaagattaaacgagttaagaatacacgtgcaatgtttgaacagcgccagcattacgtacatatagctactctcattcgcctttctgtgactcagtttccttatctgtaaaagaaaaaggttggactagacctcttctccactgttattgatgatgatgatgataaatgaatgtttctgtgccagatcctaaactaaacaaaagttaacttgatactcacaatggctgtatgaagtgggagttatcaccatccccatttcatcagtggggaaagaaaggctggattagtcagggatctccagaggaaccgaactaataggacagagacagaaagacattcattttcaggaattggctcatgtaatttatggagtttggcaagtgtgaagtctgcagggcaggctggcagtttggacaaccaggcaggagtcaatgcaacagtctagacacagaattctttcttcgccagaaaacctcagtttttgctcttacggccttcaaccgattggatgaggcacgcccatattattgaggataatctcctcaaagtcagctgattttaagtgttaaccatatctaccgaagaccttcccagcaaccctgggattcatgtttgattaaataactgcacactatagcctagcaaagttgacacaaaagactaaccaagctaaataacttgagaacataagataataccctaggacagggcctaggtcggattggcactcacgtttcccgactccttagtctgtattcttttcaaccttgtctctaatattccatgattccatggttctgatgccattcctcagcgctctgctgttcttgcctgaccaagtggatcaatggtggctctggcatttctataaaggggatttcagggctgcctgctggggagggaggcttgaagctgtgtctgcactgcatcttcacagcactgagaaaatgccagtcattcaggaggacagggcagccctgtcctcgccacagtgcccgcatcttcattggttcacctttgcaggtatcatctgtgacctgtcatccaggctctgagccctgaggataataagtttccctcgaaggtcctgggtttgttggagctttttctccctcttgccatgtccttttcacggtccatcctctgagtttgtgaattatctttcttcgtggcccatgtggcacaagatgaagagtgcatgggcagcttctcccctgacatccctacctccctgacgcttaacccacatagggaagaacattcctgaaacagagacgtcacccagggttgctttctgccacagcaggcactctgcttcgtgcctttctcacttccatttgtaaatgatcttgtctccttccttgtagaaagcttttcagccattccaggctttctctttgggttccatccctctgggattttccacgaattgcatttccttgtagttcattttcatcattttccttgttagggaaatgcacctgagacattggcatgcagcctgattgcccccggcctcccctctgctcattgccagagctacctctgcacagaggagtcactctcctcccactccagggcctctgtcaggggccaggcttgatgctgtcaccagccagctcttcactgctgcccagtgccatattcatatccattgagacaagtccctgggaaatggttgggagccgggggacagccctgcatcctgagatcctaagatcagggaggttctccctgcactcccagctggaaggagactggatcggccaccctcaccaaattcccagattctctgactgaagcaagccagtccttggtttgaatggggaatcaactcagggttataaaatagacgccagccttcttgtaggtagaatctgacttcagacagcaaaagactctaaaacagcttaaattcctgtatatgccttctcctgtgcatgccaccggtcagaccaaaggccacacgccaatcaaggcccaagatcagccaggggtgtttccatgtcctcaagaacttttacaaactgtagctgattgggttccgcccctggagattcgatttagtgggtctggagtgaggcctgggcttcttagaagccccagcggattctaaaatgcagccaggaggaagaacgttgccagaatcccatgaggcacagatgcaaatgtgcatagtgacattgggttgcattatcaatggcaggactgactttataaacctccacatccttactggagctgctgtttgctttttagaaaagtccctcatcagattatcaggaagtcgtgggttttccgtgatcatgctgtggtcagatccagcccaaccagagagccaaaaacaaaacaaacatacaaaacaaacaaacaaacaaacaaaacccaaatccctggcaagccccacgaaatgactgctctgataacattcagcagacaagcctgtttgaaatcatctcagaatcataccagacccaaacccaagaggtcatctggtctatgcatcgactctaggagggtgtattagtccgttttcacgctgctgataaagacacacccgagactgggcaatttacaaaagaaagaggtttcatggacttacagttccacatggctggggaggcctgacaatcatggtggaaggcaaagaggagcaagtcacatcttacgtggatggcggcaggcaaagagacagcttttgcagggaaacttccttttttaaaaccatcagatctcgtgagacttactcactatcacgagaacagcacgggaaagactcgcccccatgattcaattaccgcccaccagtttcctcccacaacacaagggaattgtgggagttaaaattcaagacgaggtttgggtgaggacacagccaaaccatatcagagggtgaggggctatttctccatgttacagacaaggcacgtgaagcctagggacgttccatcacaggcccacaccttgtctcagaattaagaggaaatgcttctggctgccaggggtggggtggggtaggatgcagagcctctccctccaccaccacctccatccttttccctttctctgaaaatctcatttgatgattccccagcctggctgcaaattaaagatttgtagacctgaaagatgctaccgatggttatcagcaccaccaccaccatcgtaacagtaaacatttatggagcgccataattattcataataatttttatgtgttaaacaaatctgacctagctctataaagaaataggccctgttaaccaaaaatattggataaattaaaagtctcctagaagcatctgatgaaaggatctcaagttccataacacacggaccattcagtggtgttgtttctgggcttgattcactgtgggtcacttgaacgatgtcgggggtattgtccacctcccagtgctcagtctgtggcttgtggccagctgttcctctgtggggtctatgttggctgtgttaaggcctgctgcagaaacatctcatttctagcatgtttttctcaagcagtgatcctgtggggtcaagtcttcaatatcaaataatattgataataattatgatagaaataataagaggccaggcaccgtggctcacatttgtaatcccagcactttgggaggcagagttcaggtggatcatttgggcccaggagttcgagatcagcctggtcaacatggtgaaacccagtctctactaaaaatacaacaattagccgggcatggtggtgcacacctgtaattccagctactcgggaggctgaggcaggagaattgcttgaaaccagaaggcagaggttgcagttcgctgagattgcaccactgcactccagcctgggtgacagagtgagactctgtctcaaaaaaaaaaagaaagaaaaaagaaataaagaagaataataagaattatcagtcattgaacacgcgctctgttcttggtgctcttggtgttattccaggcaattctaacaccaattagatattttcccctattttaaagattaaagcaactggcgcagtggttcacacctgcaatcccagcactttgggaggccaaggtgggaggatcacttgaggcagggagttcaataccagcttgggcaatatagtgaaacccctgcctctacaaaaaaaaaaaaaaaaaaaaaatcaaaaattagctgaggctggtggtgcgtgctcgtactcccagctactcaggaggctgaggtgggaggattgcctgaggccaggagttggaggctgcagagagctatgatggtgccactgcactctagcatgggcgacaaaacaatagtcttgtctcaaaaaaactaaaaaagactaaagtgaaattgaaattcagagagtaagtgacttcaaggtagaggcagaaacagaggctggatttgaattcgatcctctggctccagagctcctgggagttatcttgggaatgactgcaaggtctgaggtagatcgttccaggagcaggtgcttatatacagtggaatggcacccactggcacaccgctaggaattctgttttcttaccaccaccggagccaggtctctgtcacggtgatgagaagttcccaaagtcatttctcctctctagggtgtcccctctctgtctgctgccactaaatccctaacgacattagagcgaataaatggcatttttaacttcagctttaagcaacaaagaaatactattaagtcaagatgtgtccatctttaccataaaaaaaaacaaaaaacttgcttcaataaccaataaacagatcaaacaacagaaaaataaatagcaaaagacttcagggctcgatggctcacacctgtaatcccagcactttgggaggcggaggtgggtggatcacctgaggtcaggagtttgagaccagcctgaccaatacggtgaaacccgcctctactaaaaatacaaaaattagccaggcttggtggcgtgagcctgtagtcccagctactcaggaggctgagataggagaattgcttgaacccaggaagcagaggttgcagtgagccaagattatgccactgcactccccattctgggcaacagagcaagattccatctcaaaataataataataataataataataataataataaataaatagcaaaagaaagaaaaaaccctcagctaagaagtatactgttgtgttttttggggttttttttatgtaacatttgacaagtttacattttccttgtctgccttgggtgccttaaaataaaactctgtcaatatttccatgtaacattgggttttgcttttttttttcctcacgtaaaatccacatatcaggaattcctctatttattccgtcgcctgggtttctttccttgggaataatttatatgtcaaacctgtcatttatcgatttattgctgtacctagcagcatttttctccctgccctcaaaatttagcttaaagaccacttaataaggcctgtgcgggtcctcagactccagagatttctgctgatatgagccataatttagcaaaacaaatcctgctcattgcgggcatctaaatggtatcctgttaaatttccatacatgcttttcttttctaaagttatggcctacaactagaagaagggatgaaacatcacccctacctccacatcttatttcctgtatcaaatttcgaagcccttggagatgcaaggcgggtttccctaatgagttgagaatcaatgcgaatcatctgaaatgagaggtggcccgtgggtgtaatccatccctgctggtgctccaacttggttacacatttccagaaaccagcacctccctgttgtccatgtctggtcatcagaggcctctctcctcaggtgggataaccagagaccaagaaagaaacatgtttctctcccttggaatttctcttccttagtcattttcagaaagttaggagtcggcaaccttaaggaggagtttcctatcatctctcctccacttcctcccctcatttcctccccgtcttctccttggagtccttcatcaatgtctctattttctgttcaggataaacaaagagtccctcttacctgcacaggcctcacctgccttccccccctgtcatttctgcagccagcctgtctcctgagcctggcctggcattctccaaagactccttaaggccacttggcttccggtctgcctctaggcttcactgtctgcaccagagtggaaattgtcatgtgccctcagcaacattttacccctcccttccagaacagacacaggcatttcttccacaagcagtattccacagatgaaaaaaaaaaattataaaagcgaaaccaaaaatactggtagtatatttttttcccttcaaaagaatgataatcatcagtaaaaaccacaacaacaaaaaactaagcaaagcagcctgaagataggctgaaagcacacatctacggatggcttgttgttgttttgtttttgttattgttatttttgagacacagtcttgctctgtcacccaggctggagtgcagtggcgcgatctcggctcactgcaacccccacctcccgggttcaagtgattctcctgcctcagcctcctgagtagctgggattacaggcttgtaccacccatgccccatgcccggctaatttttgtatttttagtacagactgggtttcaccatgttggccaggctggtcttgaactcctgacctcaggtgatccgcctgcgtcggcctcccagagtgctgggattacaggcatgagccaccatgcccggccaggatgttctgaatattaaactagctgaccggtggacattagctgtgctgtggaaaagtgaagcagaatggctttttatcccttgtgtatgatcatcaagacacaggacagcacagagattcaaaatacaatgcattccccttgctcgtctggtcaggctcaccttcctattgcacagggttgattggttggaggccgccaacctctagctgaaaggcagagacagtctcccctgttatttcggtaccaagctgtgtttcttaggcattaaaatggagggaaagcaaccactggcccctcactgggattgttcttgaggattccagacagaccataagtaattcattgagtcgctcacaaagggcctggccctgaaggtttgtggctgcagcatccaggcgagccaaaggtgtcagtgccaccaaaatgcagagaaaactcttatcagaaagatgtcatttttttcccctaaatgtcatatatacaatttttattggagtgtgatgacagatagtgaataaattaacataaatttgcataatacaatacagctgttaatttatgatcatattaaaacacaaagttttgtcgtttgaagcagttaaaagtcttaatcttctgaaaatttccctcttgtttgttatttgtttatgagttacttagggttattagataaaatacaggcttctggttaaatttgaatctcagataaactgtaaataattttttagtgtatctcatgcaatatttgggacatacttatactaaaaagttaatcttattgtatatctgaaattcacatttaactgaatggttatattaatatttttatttgataaatcaggcaactctgtatttcataagcagtttaacctctctctactggctcttctctggcagggcagaggggtgctgttttatggagaaaggcacttactgctgggaccttgatatctttagactgtgggggaggctggctctcctaggaacactaacagagtcaaagagatcagacaagagaggtgccagtgcaaagggggaaactgaggcaggcagcatgcctgggctttcttgacagtaccaggggtattatagccctgttttccagattttttggactacaatctcatcataagaaatataatttataattcaacccagaacacacatcccttataaatggaacaaaaagttttaggaaacatgtcaccttctatgtacaatctgctcgacatcctgttctagttgatttcatttctttaaatgccactcttaaccccctaaattgaattcatggattgaattcatggtcccctaaaggatcacagcccacatgttgaaaaacactgggttagagggtcacagttcaggaaaatgaacgaggaggttttttaaaatctactttacaaacgaggaaatgtatcgggttccttaagagcctttccaggaaaatttttgctcatttgtggccaaactcgaaataaaacttaggtcccccaactcccaaccctgcgttttctggtttccttccaccactctttctagtatccattttcctggtctccaagttgtaatacacattctgggatccacatttacttgttttattttacataattatattacttgtatactatttccttatacttcatattcttctcaaatttccatgttttatatcatttctgatgcaaactgattacatcattgcttatggcacattcttgactgatatcaacattttaaaccaaattgtcttggtacgcaccctctgatctttggcatcttactgccctgccccatcttcaacctcggctcactattttggtgcctcaggaggtctcaaccatgaaccttccatgtgctctcactgggattggtgccatctgtgacataagaaaaacatagaaacataaaaacataagaaaaactattatttgttgtgatttgttctccctaatctatgaagtcggtagggtatctgttataaagattcccttctagagtcgagaaaacagaggctcagagaggttaagtgtttttctcagggtcacacagcaaatacagaactccagtcttcttgctgtgtctcttaccctctgtcatcaggatgcaggggctgctgagctgagatgcctgcagatgagtaaactggcgggaagaaagacaccaacccaatagatctccatgtattttatatattttctcacctactcagtctagattttcaaacaacatacagaactttctgggatcttgtcatcattcagtgtactgtcctctggatcctctccaggagccgcccactccgcacacatttttttttctagttgtcataaacaaatttcaaagaaagccattttcccagagccctttcttgtgactctaccacagttcatcctggtttgcagaatccaaactcagggcttccttccaatatttttattagttcagtagtcgatcagtttgcacagagaagtggattggagctccccttcccttggagctgccagtggagaaagtctcctccaaccctcaggctcagcaccactcagggccagtgagatgcacaaacagcatcttgcaggtaccacaatgccttcatcacttgtatcttccccgaccctgtgatgaagtaggatgaagatggctgagggtatggacgttgggcccacctccctggcttaaagctgctggaccccttacccggccatgtggccctggggcatgacacagttccccctaagcctcgcttcttcactgtttaaaggggataataatagcatctgctctgttagactgagggctggttaagtggaataacatacttagcacatagcctggtacccacttattttttttattttgctactttgtttcaaatcttcaaatcttcctattattccttttttacagagccatgtcagaaaccttagattcacgtcccttccatgtgtcccttccacatgtccctccttgacctgccacaatgcctctgctccacccagagcctcagcacctgcgttctgccccctcagtaaccagggtccctcacctgccactcctgggttgctctctccttttgaactagaaatttttctaccctcctgcccctccagccaaaattacctttttgatgtcccatttccccaggacactattttgtcctagggatcaaaaataaaaaaataagaaagaaagagagagagagagagagagagagagagaaagaaagaaagggaagggggaaagaaagaagaaaagaagaagaaagaaagaagaaagaaaaagaaagaggaaggaaggaaaagaaagaaagaaagaagaaaaagaaaagaaagaaagaaagcaggaaagaaagaaagaaaagaaagaaagaaagggaagggggaaagaaagaaaagaagaagaaagaaagaggaaggaaggaaggaaaagaaagaaagaagaaagagaaagaaagaaaagaaagaaagcagcaaagaaagaaaggaaagaaagaaagaaggaaagaaagaaagaaagaaaagaaaagaaagaaagaaagaaaagatcaaattaccaggatctgaggacctgggaggatttcagaaatcgctggtcagtcccagcaactaaggctcaaatgccctccccaggattctgctggagatcattctgccagtcactccaggagcgaggggctcacctcttcctaaggcaggactttccacgaggctagaccagaccagtgtcctccaattaattcatttccctgtgtcttccatccatggtttcaaactctgggaccccaaagcacagtggccctttacaaagttgaaggctatgtccctctggcttctgcagcttttcctgatgtggcagggtttcaggtcccctgcccatccaccccccacccctctagcctgactgtctgtgtccctctagagggtgacatgccttgaatggcagcgaaccctggtgtgggctgatggtgtggagtacagagcggtagccgctgccctgttatcagctgcttccaaaggccagggtggtcgttagtgcatcattaataacccattatcgggttgtcatctctgaatttatctaaatttatctcaattattgtaaccctgtagactgataagccctataagtataaaatacactggatgaaaaagctacttcctattatttgttctaaaaaattaactccttcaagtaatctagagtttggtgaccaatttcttattttaccctcctcacatcttcaaaactcagcactggtgatttcacgtctgttgatgggattcatctgtccccctccactagactggaagctccccatagggtgagacccactatagcatcccccaatgtccagcacggaactggagcatcacaggtgccctgaggaatgaatgggtggacggcgcttacagactcgggtgccacttcctcttgtccagctccatgccctcccccatagtgtgtggaccatcgggggcctagaactgaggtcctggttggtagcacccaggagcctgttcccaacatggccccatggcagggcctggtctccaggtgtggcatgaggtgctacatgagcattctgtgagcatcttcagggagaaaacaaagtgttggccaggcccaccggaacagcggcccacctaaacaggctggcgggcggaggagtgccacagaatggacatggggaggccttacaaggtctgtagtagcagaggtagtgaatgtttgttgagttctctctatgcgctagtgttattctaagtgaggtccatgggccacgctttttgctgactacaactctgtggagtaggactaggattatccccattttcctgggtgagaagctgaggctgccagagttaagttgactagggccacacagctgagaagtggtgaagcataaattgaaacttgggcagtctgactcccatatactttaaaagaaaatatttccatagattattggggaacaggtggtatttggttacatgagtaagttctttaggggtgatttgtgagattttggtgcacccatcacccaagcagtatataatgaacccaatttatagtcttttatccctcacccccttcccacctctccccccaagtttccaaagtccattgtatcattcttatgcctttgcatcctcatagctcccgcttatgagtgagaacataccatgtttggttttccattcctaagttacttcacttagaataatcgtctccagttccacccacattgctgcaaatgccattaactcattcctttttatggctgagtagtattccatcatatatatatatatatacatacatatatatatatgtgtgtgtgtgtgtgtgtgtgtgtgtgtgtgtgtgtgtgtgtgtatatatatatatatatacaccatagtttctttatccactagttgatgggcatttgggctggttccacatttttgcaattgcgaatttgtgtgcaagtttgcttttaaccactatgcgatcttggctctcaaggtggaaatttgatgtggaaagcagagtcaggccctggaagaatcccccaggctatctgtaagagctagaatcggtatgatgttctagaagcaattggcctgggcagtgccctgagagcttagcagtgcagtcatgagccagcactctgcctgggtctctgtcacagagtttctcgtgcttggctgcagcctggagccaccttggggagcttgatgcctggggctccccacggattccagtgtcatcggcctgggcatttggcatttgggatattcacaagctccttggtgactccagggtgcagccgaggttgagaaccattgggaatagaaaagcaagaggaagctgttctcacctgccctttccacaccagagccccagggtcccggggagactaaagctggggtctatttctattcccccaaccaagacgggagcttcacatccccacacactgagaggccagaatgggtcagaccagagtgagtgtgctctggctaagactggccgacagctctgttcccctggggtggggactggacgtggccctttggtttaactgcattttactctttccagcctgtctggccattattcttgcaggagcacgcaggactaaagtccccttcctcagcaccacgcatgtcccatctcaccctgtgtcttccaacttcacttgccataaatcagttgtcaggacccccgaccctaaaacagtcacctaatgataaatcatgtttaattctaatggaaccctcccgccaagactactcatcagagaggaagctaattcgcagggatatgaagagctttctaaaattagttccagacgttttttgtcttaaatctgtattatggctgccctatttttaatttactttttgaaaaaccacattgggacactaagtaatctgggggcccaaaagactttgggggccacgggaacctcccaggccctagggggcagtagcaccaccatgcagatcaccagttccacaaaagaacggaactccaccagtacctagtgttattagtataagttttgggaaaggtccttcttttcttagctcattagaaaaacaatcacagcatcctatggactgggccaaagtgggcagacattgcagtccagcccaaagaggcctgtcccagcaggacgccaggggacagggtcagaaagaggcagcccacaagctgagcacagctgcagaggttttagcttgcttactacatttgaattaattgccaaacttttaaactcaggggaattccgcaaaaatctaggtaccagcttttcttgaagacaacggaagctcaggccaccctgaggccatcacctctggcagtcacctgccaagcacgtggctccagcttagcccgagcgcctccacctgccccgtcaaggcccagatgcagtggcccttacccatcacacttgcgctgttctgaccacagactcacagtcatggtcccacctggccccatggacatttgggtttgcatcatcatctaatgacacagtgaagctccttggcctaccagctccctttgtgttcaccttgaccagcccccagctccttgcttctgcatcttgacttctgccgtggtcctgcccagaaccctgagggctgtttctcttccctactcccctccggcttctccttcctacctttccacgctgcaggatggggtacttctgcttgcctcagctgcctggcccctccaaagcctcctttgaccatcagcccagcttgcatggatgcccgggacacatacagcactttcttggtcttggtttacaaagtagtctgccccagtggtcccaccacacctccaatcaactccagaccccagccagccacttgaaaatctgtagtccaggccagagggcaaaaggcacagtcgaggacaaggagcaggcatcccgtgtggcgggagcaggaacactcttgctcagggtgctgtgcgatgggccattggtaggtagtcccagctggtctggtgtgtgaggggagaggcaggttcacccagctgtctgtgcctgggcagggcaactcccgaagtgggctgagggagagctctccgtgatctctaaggagggaggcagcgcattgcagggttagcaaacctttagaagatcctcccggtgttcttcctcccgctcctgccctgcccatagcagaaatcaacaacacgtgggcactgagctcttttccagaaactttccaaagagacccatgggtctggccaagaccctcaggggttgccctcattggcctggggacagtttttgagcgactgctctttgagaagaagtcagcatcagagggagtcagagaagaggggtaagcaagctaggttggggagctgctacccccaaatcagactgcaaagacaggcaagggtcatggccacttccgtgggcccagtgccagacagctccacagaggctcagagagggctgaagggccaagcctaaggaaaacaacaaggctgaaactccccatgtctaacgacatcgtgagcgtggctgcagagctcccacatggcttcctcctccttcccaaggggctgccccaccgctttgccctcactagccagagcaatctaccttgttcactttgcccaagacacagggaggacccttgtggtctttgcaggggcttcacccagttgagctgggaagagacctcacagcatcctccccatctccctggcccgggtttagaatactgaagacacatagtcctgtcctccgtggcctacgcagatccttcctgttcctgagatctctggccccatgcgggcccatctctgcattcctagcttggtggatgccctgcctatctggcttctacctttgattgttcccttggtcactccgatgccatggtcctatagcaatcagggtgctgagtgagtccctgcctgtcctgccttataaggaagagacaattatttgtgtcctgcccatctttgctcatcattgtcatgggttttagaatcaagccgacttggcttttcactcccttaacactgtgagctcctccttatgcaaaacaccacaggcctgcccgccggccttaagcacacacccttctgagcctcagttttcctgtctgtaaaataaaactcaatgaaatgacacaagtgaaactcacctggtgcctgccctcttctcataaatggcccattgcttctgttctcctctcctcccccaggccaggcctcccctccctagtcctcatcttatacccacacctccctgcccctcactcagggccttggctctgaagggagaccccgaggccatctgaaagtgtgagcacagctggcggtggtggctggcatccaggggacgtgagggcgcattcgccccagcgcagcattcctccttcctaagcttgcacagggcctggtattgaagggcagcagattcattccagcatgactactgcagctacctgtgtctcctggcggaaggggcagcctcaggagtgtggagttcagggatccagctttgacttggccacgcccagagccagccagcctcgagcacctgtttcctgtctgggggcacgggaaccctcctgtcctccagggaccccagcctcctcatctctgctgggcagtcatctactacccctggttctgacccctgagacctcttgtcctggagcccgcagggtccagctcagctgtgccccctctcggggccgctctggtggcttctttgctgccaccctccccacccccggcactgtgctctccctgcccccactaccactctcatctggttgcccagtccatgattgtgaacttgacctctacccctggctgcctgggcctacgatcctgcaaaaacccctccaaccagctggccccacccctcaggacttccctcctgtggcagagtcacctgtgacacctggagggactccagtccagtgtgtccccaccttcaggctaacccccttggagaagcctcccgacggtgcaggcacgggggcacagaggcagcaggacattgcaggagcagagacacgaagacaaaagaaacaaatgattccttaagatccatggccaaaacaaattgccgcaattaacacgtgccactgccacgatctatgggctgaaacgtggctggaacgacgcagaagcagaaaccacagagagcgtgcgctccaataaaacggcactaaatggcacggctgtgatggaactcgtttcgattttgttccaaaaccttgtttaagtgcgtttattgtttctgtgtgaaagaacacaaatgctttttgaaaattgcttcagcataagcctcaccttctccagaaagtctttctgatccctcccatccctaccccatgcaggtccgtgacccccacgatgcccccatatgttgcccccctatgttgccacggtgcccacacttccctgtcaccaccagtgtcctcctggcttctccacccccagggactgtgcatcacccgtctccaccccaccccagaacaatgctctgtacacagcagacagcaggcagcaggtgacacaggcccaatggaatgactgtcaaggttaagggagaggtcatttatgaacatcaagggaggcacgcaggctgctaaggggacccttgcagaacagatgaaattcttattagaaagagtcagtgttgatttctcaaaaaatctatcaatcaataaaataaaagcataaagacatagaaacacataaacagagaatcgttttacatggaagatggggagtggtgacttggcctcatagggccataatcacccttttggggttttgtcccacattagaagagcagccccatagcagagataagaaaaccaaaaaagggtaacaaaaactgggcacagagtcaggactggactgaagccccggagagcacgggcagctctctagcaggtggggcaagagggactttagctgggagcacttggcccccagcctaggcaccagagctcgaggggagacccttcccattccctgagagatggagtatgggtctcacttgcaggggagcctcgtgggaatccctcatatgggaagaaggatggcatggaatggcctttctctcccccaacgcccagccaagggaggcaagccctccctgtccgctctagcaatatggcacaagggggtatgatctgccagttctcccttgagaggcttggtggggaccacctgcaggccagctggcagccccccttcacctgctcacaactagcaggccagggggtgaggcatggaccagcatctccgctgctttgagcaatcatgaaaactccaggtccatggaagataagaaattggctatcaaggctctgaggcatgtgctatctgcgatttagtaaatctcttcccacccccaaatttaattttttaaaaaacctccctcctcaagaacttcattctcatgtatcctaatccaccccgccagctcccagcagaggggagggccactctcttgggtccaaaggcccacactagcggggaagctcgcggagccatgtctctgggggccgtttttactttgttttgccactgtagaggccactcttggcaagaagcctttttcactaaaagccatcagctgcagaagaaggcaaagggctgaaatagcatcaggtggaggaggcggccctggagagaggcctggtttccatcccagctctcccaccatctgcctgtggcctctgcaagctccccaagccctgggggccttcgtttcctccctgcaaagggagctgccctcagaagcactcagctcggttcttggcatggggagtgattagctctgcacaaacctggtagtttcacgagaagccatgtaaggtagagaagtcgctgaaggcatctccctctcagagttaaaaggaaacagaaagactggatcttgtgtctcttcctctttttaaaaagggaattaggcctggtgcagtggctcacgcctataataccagcactttgggaggccgaggtgggtggattacctgagatcaggagtttgagaccagcctggttaacacggaaaaaccccgtctctactaaaaataaaaaaattaaaaacaaacaacaacaaaaaccattagctgggcatggtagcgcacacctgtagtcccagctacttgggaggctgaggcaagagaattgcttgaacccgggaggcagaggttgcagtgagccgatccagcctgggagagagtgagactcggtctcaataaatacataaatgggaagtcatatcatcacgaggtccccacttaccctcatgacctcatctaaccctaataaccttccagaggccccgtctccaagtatatgatcatgttggggaatagggtttcaacacataaacctggggaggccggactcacacattcagtccattgcacaatgtatcaaaaattctaattgtattgggcaagcctacactgcccaattgtaagcgaagtccctgaggccggagaaatcaaggtatccatcagtgaatacagggtattaagaaatgccaaagcttactgctcaagttcatctcctgctgaccctgcggccctgctgcctgggcctagaatggacgcacttctccacaaggccttgtctttcttgagattctcacagtgtgacccgagaagcatgctccacaatttcttatcaattgaacactaaaaatcccatctagctatgggatgcctagtttctcctcctggattttgtggttaaacccttctgtctccaatgcaatgtagcagtgagcacagctctggacccgcatcccaaggcctgaggtctaacgctgcctctgccccctcctttgctgtgcagcttaggcaagtcacttcacctctctgggctgtggttcctcatccatccaatgggagggttgaactgctctttgtttgctttgctttgctttttctttttctttctttctttttttttttttttttttgagacacagtctcactctgccacccaggctggagggcagtggcttactgcagcctttgcctcccaggttcaagtgattctcctgccccagcctcccaagtagctgggattacaggtgtgcacaaccatgcccagctgattttttttgagatgaagttttgctcttgttgcccaggctggagtgcaatggcgtgatctgggctcactgcaacctctgcctcccaggttcaggtggttctcctgcctcagcctcccgcgtagctgggattacaggcacctgccaccacacttggctaattttttgtatttttagtagagatggggtttcgccatgttggccaggctggtctcaaactcctgacctcaagtgatctgcctgccttggcctcccaaagtgctgggattacaggcgtgagccattgtgcccagctgctcttccctttttactgtcctatgactggtctcccaatgccagctgagagtgttggtctgatctcttttcttctaagctggccacacaaatggacctcagttactcagtagcccttaaaatctggtaccagtcaccatttaggcctctggacatcatccttgggcaaaggaggctttttttttaagcttgggcctagccctccccacttatatcctggactgtgaaaatggaccgagtgggcaatagggaattcaggatgagctggaaaaaaagaaaaaaaaaactcctgctgcaataaattacatcacagtggagatctctttctacccagaaaattctgagcccagacaatggcttatttatttcagacaatattcaatacaacagaattccaggtcaatagaaggatttctgcaggttcttagagttggtagcaaagggatttaacccacggagaaaagagagctgttcaataatagattcccaggcgtgagggaggccttattaataaatccatcggtggtctgctgaaaatgctgccccctcccttgcgggcatcccacctgacgacagtgggggactgatgcacccagggccctgaccagggaggacgtttgggtaaatatttgggcagagatggctgctgctagaatggtgagcagagctggggagcgcaggaaacggcccctttctcccaggccctcagatgagacatttttataaacatccaggcaggcagcctctgaagactcctgggctttacaaacacatctcgtattctatagtcagctgagaccatgctttgagcatgggcggtaagaggagcaggaagcaggaggggcggggaggggtctggcaccagctttctaaatttaacatgcagttgcttttaggccagtggataaaaaataaattccagtgcttaaagctcttatctttgtttaccatttccccaaacagctagtgacctgctctctgactcctacagcaaatcatcaacgagatgcacacgaagatgagggatgggaaatgcaggaggggtgtgcggagggcaagttgatggctctccgccttcccgtcacgtttatttggcctggcagagtgaccaggatctgctaaggtcatgaggctgtccctgggtgggtgggggcgtggccatgctgcatcagaccagtccagaggtggagggcaccttggggtctctcgtgtggctctcctgttgatgagggacctatgaatatcccacagcgaccttttcagatgctccataacctcgtgtgaaaagccccggtggacctgggcttgcctattgcattgtgaagttgtagtcctttgaaaatcctgccccacgtggagtcagaatctttctttctgggactgatgccatggggcctggctccacccccacaactgcatggcacagcactgccttttccttggccatgggctcgccctgcagatgggtgatgatgcgctcctgcctcccttcagtttgttctgttctcccaaattctttcagtgtgcctggtagaagcagtctgccagtctcccctcgctccctctcattcatcccctctctaactactcatcctgcgaccccactgacttggttttggccttgtccctgccacagttgacaaatataatggcgcgtcttcttcttcattattatcattattattactggcaatcatagtccactctgcctcaaactcctaggttcaagtgatccttccacctcggcctcccgagtagctgggattacaggtgcacaccaccatgtctggcattttttttttttttttagagatggggtttcactatgttgtccaggctggtctcgatctcctggcctcaagcaatcctgccacctcagcctcccaaagtgctgggattacaggcgtgagccaccgtgccagccatcaatggtctctcttagtcttgaatctcccaggcactgtccaggagatctgagatgttttccagggtcccttactttccagttgccctgccaccttcccctgggaagcattaaggttcaatgcttggctctgtgcttgtttttcttacccctatcccagaggactcatccccgtctgtgcgacaccatctccccacttctacgccaagctgctcacggtctcacccaggtggggtggtggagggggcctccagcaaaatcctgcaaaagctgatctccttcccctggaagatgctgccccacccatgtggtcctctttctgtgtttctctcagccacttaggaatgaaaccagggaatccctttcatctctcttcattccctgacccgttaaatcccaacaccctcacctcccctggtagagcttcctttatgacagtgattctgaaatccaggctgcatgtgataatcccttgggggacttctaaaacaataccaattcctgcaccccaatccagaccgattaagtggaaatgttttgggatgggccccagcatcaatagggaacagccaagatagacagccactgctgataaggcttctctctttcagccccttttcccattctgactactggccttgtgattggagcacctcacttttgcctggactattgcaagaacctcctgtcttattgacctatttcccaactctttctacctcagccatcctacatgtcgttgtcagatcacacaaagccattttcagtatgttatcttgactcatcaaaaaccttcagtggctccctattaccataaaaataaatctgtgaatgaacaaataaatggtttcccaaatacagagtaagttctatatggcacagaaccgtatcttatcccctctctttccctgcccctcaccccacacactctgctaatcggagtaaatagagggaaccaggatctgtggggtgagtgaacaaaagcattttctctgcaaattaaatgtggtccactcacttcccagtgcagagaaagtgggctaggtgatttaactatcacttacttaggggcttatttctttcaacatcatatacagtcagctgtgaatgttccatactaatggaaaaaacagaatcctaaatattaccaaacagcagataattcaaagactcgaatctagttgatgttggaatgcgtttttgcttatgagtgctgagtgcttgtgtctgataattggggcaatttttaaaaattaggtaattagatgtgttttatttgttcctatttccccctccccccactatacacacacactatatgaataaataactcagctcccaaaacaatgccctatttctttctctcagtcctttcctggaatagagatagtggttacatttcagaatattagcaaggaagggagaagaaactggggaggagcctgcagttagagtaaatagaagaaactaggatgtcaacaggctgcttttcaactgattcactgttaaaattttaggcagtgtgaacaacctgtctgtcaaactgtttgcaatatctactaaagctgaacatacacatccctcatgacccggcagtgccatgcccagatgtacacccaacagaaacctgtactctgttcaccaaaagccataaacaagaatgttcataaggctttattcataatggcccccaacctgggaacaactcaaatgtccattgacaaggaaaaggatggataaatccgggcagctcacccaatggagcaccaaatcatgaggatgaacacaccacaacacacaacatgggtgactgtcacagacatgaaactgagcaaaagaaggcagaccgaaaagcctgcatggaaatatttcatttataggaagttcaagacaaagaggcaaaagtaatctctcgtgttagaagtcaagacagtggttactactgaggggcatgtgaccgggagaggccacgggtgtgcttccaagtgctggaaggttctgtcttggtctaagtgctggttacacaggaatgcttacagtgtgaaaattcattgagctctaagtttgtgtttgtgtcatatttttccatatgcgtgttattcttccataaaatgtacaagaggaaaggaagggagggaaggctggagggagggaaggtaagaccaggtaggcccaggtaatggaaaaggcttggaatttgaagacctggattcagttccaactctaccattaactggccgtgcgacctgggacaagtcacttcacctctccaaatatctggttttttttcatctataaaatagacaataaaagctgctctacctacctcacagtgtggttgtgaagaccaaatggtataatggatgtaaaaatccattggtgagcaataaagtgtttcacaaggcaaaacactattattattctagatctctgcagacagcaatttctgcagcaggtcagcactgtcagtgaagctcagcccagagccatcatggagaagactgatgccccgtgggttgtgtgtttgtgtgcgcacgcagcctggtttatgttttttcattacatctctgcacctaatcccttaatggcctgggcctcagagtacaaaaacacctggaaaaatctctgtgtttttatgagacgggttctgtccccttctaaagcaggtataaatagatgccatgtacactctcttaattactttttctcgagtatggatgaatttcaacatctaaatctgccaaattattgaagctagcacagagaactttctgggcattggccagggaagccagcaatgtggatggaaagatttatcaccccctctcataaccaaacctccatcgtatctccctgcaagccttgaaactgctcactggacccactcagacaacagagctatgggatctagaaggtgaaatgtcagagctcagagaacctcagctccctcccaaccttgccataagaactcagggctggccgggcgccatggcttacgcctataatcccagcactttgggaggccgaggtgggtgaatcacctgaggtcaggagttcaagaccagcctggccaacatggtaaaaccccgtctctataaaaatacaataactacgtgggcatggtggtgagcgcctgtaattccagctacttgggaggctgacgcatgagactcgcttgaacccgggaggtggaggttgcagtgagccgagattgtaccattgcactccagcctgggggatagagcaagactctgtctccaaaaaaccagttgcaagggtgaggggctttgcctctggtttatggtcagaagggcaaagcgaaggtcaccccattttccacggcttggtttcatattatagtcccacggtccctggagaatcagagtgaatggaaatctttattcttcatatggctgtattgccccaagctgtcctcgtgcttaagggatttccagctccggcttctagagggcaagggccagcatcacttggcctacttcttagtataagaccaagtctagtgacagctgggtaggcataactactacagatgctgctgttcctactgctctgaagaagaaaactgaagccacctctgcttctatttcctttaacaacatagaaaaatgataatttttctattaggtccgtgaatctccaggaaaaatctttgtgaaagcaatgacatttttattttctttttctcatttatactccagatgacatctgcacacacacccagtgtgtggcgtatgtgtaggtgtgtgactgtgtgtgtgtgtctagctttcagagaaaatgatacacaaaatgataaatatagaaaagagattaataggagagggcagtactgttatttcctacataaaaggatttatcgatagattgcccatagagttagttccctaaaccatcaggttaatctattgtatttaaatgtatttaaatattgggccaggcagagtggctcatgcctgtgatcccagtactttaggaggctgagactggaggatcactggagtccaggagttcaagacaagcctgggcaacatagtgagatgtccccgcatctctacaaacaaacaaaaaacaattagacaggcatggtggcttgcacctgtagtcccagttactctggcggctgaggcaggaggatcgcttgagcccaggagttcaaggctgcagtgagctatgacagcaccactgcactgtagcctgggccacagagcaagaaaataaacaaacacatattggtttctagatcctaaactatatgatggaaagactaagagaccaagaatcttaggaataaaattagaagttactgcccattgaaaatcaactacatatgaaaaagtctcccccaaaatgaagaaactctggtttgagaatgtaaatcactaggtaaagattctgtttattttctttatttccatgtttcccaatatttaattttcaaccctctaagagcagttattttataaaataagtcccagctgaaatgaatttgataggattttagaatttctttctcccttaacacatcctattagcctagttcaatagagagagcagagcgcctcatgttgaaataagctttcccgccactgaatgtgttcaaacagaaatatcacctgcttaggaggtactttccagttgccaaagacttccaccttcatcttcttgttcactctactctgcaagatgggtgggacagcattacagacgaggggtcctgtagatactgtcctgacgactggcccaaggccatggctaagggttacagacccggaacagaaccctgccctttgcctcccttgtgggacccaaagccaggccaaggtcaaggggaggcgctgcagggggggcttcctcattgggtgtggacagcaaaggttgattttgagatttccccccagctctaattctcagtaatttggcctttgaaacaggaggcagagagaaccctgggggatggcttttcatgttatcttttggaaacatagaagcttcaggtgcttcctggcttgaaataagagaatattctgctcagtcccccacatttttgagacactccaggcccagcagacccacagcaccctcactagctgttggtaacgttggtgcctggatgtactgacagaggaccaggtgtgccaagggcctgtcacccaggctgtagtgcagtggcactatctcggctcaccgcaacctctacctcccaggctcgagcaattttcctgcctcagcctcccaagtagctgggattacaggcgcccaccaccatacctggctatttttctattttgagtagagatgggatttcaccatgttgcccaggttggtctcgaactcctggcctcaagtgacaccccctgccttggcctcccaaagtgctgagattatgggcgtgagccaccgtgactggccgataagaattcttttctaaacatgaccacaataccattatcaactaaaaccaaaatgaatgttcattccttgagagcatcaaatatcctgttggattcacagttccctgattgattcatatttgttttaggttggttgcagcagcctctgaacaaggccatccacttttcactggcttattctcactcatcctaaaaatctcagcctggacattgtcgcttcctcctcacagagtccctgatcccaaatgtgggagatgtgtgtctctcatctgttctcccatctcacccttatccacttgtttgcatcctgatagactggaagctccgagaggctaggacatgtccgtgcattttaaagttacgtctcccgggcctagcacagtgcctggtgaatcatgctcgccaattccatatgtattccttgaatatgtaaatgaaggatctcctaaacagaactggttttgcattcctcgtaagcacattcgataacactttacacatccatgtcatgatttgtttaggaatcggtttcctcaatggacagagcctccttggacccccagcacctggtcccgcacctgacccatccaaggtgcccgctgaggaactgctgaatgaaagaggacttataataaattctatgttgagactttgggttcacaggccttcctctctgggcctcatttttctcctctctgtcaaggaaggatggctgggaggatttccaaggtcctttcccgggacggggagtcctcatttagcatgcgcttgttgccctctgctggcagaatttgctcaggaccgttctgtccctgctattcctgaaagctgcagacaaagccagcaactgctgggtggaccagccagtgagtgggatagggacttgagttttgttgtctcgctggttcgactaagacatggaggtgtgtgcgtccttctgcctcatccgttcattcctcaggtgtggagaagcgctagggtaggtctcagacagacagtcggaaagacctatgcccctgagtgcacattaggacagccagggggctaaaaagggagagctggtgcccaggccccacctcagaccaacactggggagtagggcccaagcatccatctatactaaaacatataaaaatctggctgtttctggctgggcgcggtggctcacacctgtaatcccagcactttgggaggccgaggcaggcggattgcctgaggtcaggagttcgagaccagcctgaccaacacggtgaaacctcatctctactgaaaatacaaaaattagccgggcgtggtggtgggtgcctgtaatcccagctactcgggaggctgaggcagaagaattgcttgaacccaggaggcagaggttgcagtgagccgagaccgggccattgtactccagcctgggcaacaagagcgaaactccgtctcaaaaaaaaaaaaaaaaaagctggctgtttctaacatgcagccacatggagaactgctgaaccaagatggtctttacatacgtatctttttgtttgtttgtctgtttgtttgagatggaggttttgctcttgatgcctaggctgtgatctcagctcactgcaacctccacctcccggttcaagcgattctcctgcctcagcctccagggtggctggggttacaggcacccaccaccatgcccagctaattttttgtacttttagtagagacagggtttcatcatgttggccaggctggtcttgaactcctcacctcaggtgatccacccacctcggcctcccaaagtgctgggattacaggcgtgagccaccgcacctggcctacatgtgcatcttgatctaaaagcctagaagcacagttaaaaagagaaaagcctatctagggaaagagtaaagactttgattttctaatacaaaattcgcttagcctatctttaaaaattttctttctttgacaaaccgtgacaacttacaagccatacagttttcttcggggaaccaacaccatttacccattagggatgctgcttccagatccagtttttctttttgagatatagttccctatttttgtgtaccgcacctctgtttcttgtttgatacatgcatattcctgcatttgttaagattcgtttggttgcagacaatggaattcagaatgttgctaacttcagctgcaagtgagaacttgttggaagggaccaagatgccacccacagggttacctgccaggagcagatggcaacaggaactggaactccatggggcaccgagaaatggtctctctgtcctttgcttctgctttgttgtatacatctgattcatttcttctttcttgaggccaactgctgttttctgctcattaatccacaaggccgaatgtggccaacaatgggtctccacttccctgtgttcaatcgccacctgctggagaaaaacttttttctttgtcccagatcgaaatttccagactggcccctttgggccagtcaatcttggcctgcagggctggctacaggatctgtgaggcccagtgagaaataaaagcgtggtagcctttattcccaaagcagggggacgtgtccatcgtggtactcagcgagcttctttgtttcttctgcagtctctttttcgacttgtcatggtgctttttattttccatttactgttgttctaagtaaagaaaactcaatgttaaattattagcaagcattttaccattcatctttatatcaaacaatgccagttttaaatgtaaatttcagagcgtttaacttatatgcagaaccactgaaattacacaattggtgtttgtgacttgttggccagaagagacaaacacaaaccaaactcataaagattggaagcaggaagacaagttgcctccaggtttgcccaacggggatgttctttcaggcctggacatactggatgagcggggggagtccagacccttccaggcatccaagggccctgtcagccaccagacacatgcactgagacccagccagggaggcaggatctagggaaattggtccagctgtctcccctttccacagccttccccagccagccacagcagactaacctccaaggatctctaaacctctgtgctatgacaccctcagtacctgggctaggggtgggcagaggtttgcccccatcgagaaacagcctccggccggccccgccacatacactgtgtgctgccagcctagggcagggacggccaccaccatgccaacccgagatgctgcagggtgcatgcaccctatcctggccctctctgtgcctgtacccaggaccctgtgaagtgtggacagcaacagtggccataggtcagggcagaaagggggaagccaggtggagagcacaggcagctgagagctggtcgtgggaggcagccacaggtggagccatgcataagccaggcttccaaagcacagattcaaagataaagttacgtccgggtgcagtggctcacgcctgtaactccagcactttggaaggccgaggcaggcggatcacttgaggtcagaagttggagaccaacctggccaacatggtgaaaccccatctctactaaaaatacaaaagttagccaggcatggtggcagatgcctgtaatcccagctatttgagaggctgaagcaggagaatcacttgaacccgggaggtggaggatgcagtgagccgagatcacaccactgcactccagcttgggcgacagaaaaagactctgtctcaaaaaaaaaataaataaataaaagataaagttatgaagactctcaagacagcgccacagaggattaacccccgcacagagcccttttcattggtcacttgctcagccagctgccccagtggcctgtgatgggagtgggaagtgtggggttgggtgataaccttctaaagttagaaccgttcccagaaatgcagacgggagagctttgggaaaaccatccaaaccttgttattttttatgacaaagtaggaatgccaccctggccctctaaattcataaacagtcacagacatgggattaaactacatataatttctgcaacgtggcttataggcatcattaaacagctgcaatatgttgaatggctatgtcatcatagattagctacgatactggctatggacttcaagactccatgtgtcctggcccctgcccttccacccctctgacccgagatgcagttctaacaggttcccgggtgatgctgctgctgctgacccttgcccatcccggagctcactttgagagctggctgagatcccaggcagggtggccagtggctgctccagggctgtgaagggctccccctgcagacggaggaactaggcctcccagcgcctgtaactggaacgttggcggcttgagaatggacttgccctgaaggccggcctcctgctgctctgggaaaaagagggaacagaagaaagcaatccgccaccttggggactcctcctggattagcattatctaggtgaagaaagtgagaccatcacctaccaaccagataactcattccacctctgtgggcaaactggcagagcagcaaataagcttccttaatcccagtgcgcccacaccctgctcaagagctcatgggcacgtgttcatcttcaggccaaagatggggagccagggagtgacagactgtcactccaggagagtcacccgggggtgttaggatccccacatttgcaccccctgaaatctaatcagcattttccagctgttcctaatctgacctgtgcaaatggaatctcattggaacttgcatttttcattatagtaactcatatggcctctgtgtttcgcctgttcatagcctttgaccatttttctagctagttgtcttttcctactgactgatagtagctctttggtttttgttactgttagtcctttatagatgtggcaaacttttttatttgctatttcactatttgccttttgacttcataatgtgccatgactacccatgtgacaggctctttgagcctcagttttctcatctaagagatggggaaacagtcaccacactggcttagtggagcatcaaatgcggtaacgtctatgctgcacttggtcggccacatcgtcagctcccaataaatgctggcggctgtggttgccgctgcagttttataaccaaacttctctgtattacgaagacccctgagccccaggctagcaccgtgaaatataagcacaatagaaccactgagcgccaatcagatgcaatttgggtcataccgactttccattttgtggggtttctgtttaaatgtttgccaaagttggaaacgagattgaaatttaaggaaaagacaaaatgctgtgagatttgggctaacacgaacttctccctttgtcacgacccctccatcagatggcccctgagttctgcagcctcgaggaaggcctgccctatctggacatggtgattgcagagacgctgaggatgtacccgccagctttcaggtgtgtggtagccccctcccctgcccgagtccccacctcctacccctaccccctgccccagcctgcaggtcagggccctcctccatcagttaccacttgtgtttctggagggcaacgcctgagtcctgggttcctttgtatccccatggcacctcagatatctggcccgctttcctacaggttaacaaccttctcaaagcttcacaggcattttcttaacaccgccttcctccccagcccaagctggccctttggtctcctagcctttgctggcttttgccatttcccctgcctgttcgttcattcattcattcattcgttcattcattcattcagcaattgtttattgagcatctactctgtgccaagcattgggaaatcagctgtatataaaacagataaaagtccctgactgatcttggagctggcattcagacagtaggggactgtctgagtcctgggagctccttcctgccatccaacacccccagctgtcccatcctggagctccaacacgactcaccctccaaaacgtctcactgcccctcaagacgtctgtgttgggcttgcctcacctggtcctccctgcccttcctcctcagcactttgagctgtaactatacacttcatgttatattcttggacacatatctgccactccatgacatttcactaatgtacacaccaaccagccggtcacaccaacctgtgggtatcttgagagcaaaaccaactattgtgcttcgttcaaactctcccaaacaaggcactccatagagaagggcatcttaattcatgtccccagacccctacagagagtgaagtaacagccagatttcaggctctagaaacagaagcagcacaaagcattaaccgtatgtgataaattccactcaacacttttatgaattaacagatcacataaaccatatggaaatacctttcaccatttttaaagacaatatgtggatgatttgagggtatctcaaaacgatatttcaacacaaaagcattacaaagaatgcaattgtagacattgtccaaatgttcaagtccagaagcaaatacagaaaattccggtggcgtgattcgaactgcattgtcctcaagcacacaaggttttgggtctcagtgtggaagcaggccagtcactcaggggctctgtgccccctctccccatgccagcattaagacctgatgtgcagcccttccctgatctcctttggagcctcttgcaaactgtcatccaattctttcttttattcttttttttttttttttttgagatggagtcttgctctgttgcccaggctggagggcaatggtgtgatcttggctcactgaaacttctgcctcttgggttcaagagatcctcctgtctcagcctcccaagtaactgggattacaggtgcccgccactatgcctggctaattttttgtatttttagtagagacggggtttcaccacgttggccaggctggtctcaaactcctgacctcaggtgatctgcctgccttggcctcccaaagtgctgggattacaggcgtgagccaccaatcccagccttatttttttcataattgatatccagctttcttccaaggggattgtgggaagctggtgtacatgttaaaatgaagttcaagataaagcattcagggatcaaatagaacaaaggccatttaaaggaaagaaggccttacagggccccagagctggctggtagctggggtccagctgtggcttggtgaccagggctcctggccaagagggagagcagccaagccaaacaggtgtgttctccagcaagaggacagcacagaaactgatcaatggacacagtacttcctggacctaaactcagccacgaatccatcagacaagaccttattagctgtcatgttgaataacaaagggattaggctcttcaacatgaaaatgcggtggccgattctccactgacccgttataaacagcagagcagaaaaggaagttggtgcaggtggaccaggaagctggtgatctcacctgaggaccagacagaaactagagaacctgggtgaagtagttagaattcatctaacaggtctagagggcacgtcagaagaccatcttggccctggccttggcatactgcgtgatcgtgagcctcatgctgctccgtgcctctccttcctacgggttaaatggggacacacacctgcttggctggccctgcagaagcaggcaagaggcagtgggtggcacaggtggaactgtagtgcccgctcagctgcctgcagcatgatgtgtgcagggaggagcgccggcactggtcggacagtggaatggacagcttccatccagcctcgctctcctgagccgccccttccccacacatgccccacacccgccccacaccttccccacacccaccccacacctgccccacacccgccccacacctgccccacacccaccccacacctgccccacacccgctccacacctgccccacacccaccccacacctgccccacacccgctccacacctgccccactcccaccccacacctgctccacacctccatacctgccccacacctgccccacacccgctccacacctgccccacacctccatgctggccccatacctgctccacacctgtcccatgcccgccccacagccgccccacacctgctccacacctccatgcccgccccacacctgccccacaccttcacacctgccccacacctgccccacacctgccccgcacctgccccacacctgccccgcacctgccccacacctgccccacacccgctccacacccgcttcacacccgctccacacccgccccacacctccacacccacaccacacccgccccacacctgctccacacccacaccacacccaccccacacctgcctcacagctgctccacacctgctccatgggcatttttcaccctatcagctctgctggcttttcttattgatcaccagatatgagagagacaaggtgtcacaattctcacccagaccagaggacaatctgcttctgctcaaaggatttgggggtgaatgtagggagagtgagcatttttattttattattttatttcatctcaaaaagcgtgttgacttttcccaagtgctgacacaacttggacttattcataaaagaaaatcagaatcgcccttgtgggaaacacagcagccctgtctgagcgccactgaggtgactcccggatgctgtgcggtgcagttctgaagcttctgttgatctcttatgaggttcagtttacggggaagggaaggccctattttccagcttccagggggtctgcctccaggtccaggctgtttccagaaaagatgaacaagcagggtgccagggaacagcttcatctgacccctttggaactgcgggtacagacatcacaaaccccagctgcctgccctggtttcagtgctggtgtttgctatcagctccaagcacatataattgcattagcagcttagcatctcaatgggttctccacgccctggcctttttctgttcctgtctgttacatgaaaggctcataacagagagggagcagcaagaagccacaggctgcttttaatctcttacgggcaggaacagggcataacagtaattactgtaatcattgcatttcctttaggatatttagggaagtccaatcctacagcttgaagtaaaatccagcatagaattattttgaatttttaattatttatattgccaaaatagcatgcttatacaaacaaaacaaaaccaaaaaaaaaaaaacagtcccggccgggtgtagtggttcacacctgtaattccagcactttgggaggcaaggagggaagatcacttgagttcaggagttcaagaccagcctgaccaacatgatgaaactctgactctactaaaaatacaaaaattagccgggcatggtggcagaaacctgtaatcccagctacaagggaggctaaggcaggagaattgcttgaatctgggaggcggaggttgcagtgagccaagatagtgccactgcactccaccctgggcggcagagcgagactctgtctcaaaaaaaacaaacaaacaaacaaaaaaaacagtcccctaaacaatgaagaataaaaaaaaaagaaaaaaaaaggccccctgccattctccatcccaatcccatcccctagagaagagaaagatagaaatttaagtattcttctagaaatgttatgttcatatacaagcatatatagtctaccctttaaaagtaaagcataaatgagattgtgccattgcccttgggtaaaatgaacaatctgatcaaatattttcctctctgggagaagaagctatcggtagagacatagacaacagggaacagattttcaaacccaaatttccttccctcaccaggactcactcagaggagccaaattaacaaagaaagtagaaggctgtctgccagggaccagggagaggggaggggagggagttagtgtttaagggatccagaatttcagtgggggaagaggaaaaagttctggagatggatggcagtgctggttgcacaatgaatgtactaaaaccacagaactgcacactgaaaaatggttcaaatggtccattttatgttctatatatatatatatccacaatgaaataataaacaggtgagcagataaataactaaataaacccagcctcaccaggaccaattctgatgttccaatattccagaattatcatggcatttgatggacggtttgagcctgtcctcattagatgttctcatgtcctgtgttaaggacttaagactcagaagatttttcatggattccaggcacgtgggagtggtacagacaggagcaggagtgggagcccgtgtacgggattcattagggaaacagaactttgctacgttgggagggtatctcgaggacaagccttgacagagggtgtgaccagcgtctcctcccaacccccgtgttacctgggataggaaatggcctgaagtctggaaggtaggaggcaggaagtggggcttggttttcttgctgtgagccagatctgttggagtgggataatgctgaagtcagagagagacttctcaatcgaaccctatagtcacaaaagtagttgggaagggggtgggctgagaggtgcagggaggtgataaagagaagctggggctgtaattctgccctcgtcctaaaaggctctatctcatcctttaaaatcccaaatcacctgtaaccagaactttttttttttttgttttgagacggagtctcgctctgtcgctcaggtgtacagtggtgcgatctcagctcactgcaacctcctcctcccgggttcaagcgattctcgtgcctcagcctcctgagtagcagggactacaggcgcacgacaccatgcctggctaatttgggtatttttagtagagacggggtttcaccatgttggccaggctggtctccagctcctgacctcaggtgatccacacacctctgcctcccaaagtgctgggattacaggcatgagccaccacacacccggccatgaccagaactcttgagagcgtgtgctcaacactcgaagtccaaaagtctacccaagttcaggaagagagcggttcttcacctctccacctcgaattttgtttctagaatgttgcatgtaggtctgaagagtgacagcacgtttgtttaacaggaactcaaagccagcagatcaggaaaggacacttataaggtttggagtttgggttacagaggtttaaggtaggtcttttgtggcaaggaatatttgaaattgggcaagatgagtgagctgagatcgcgccactgcactccagcctgggcaacagagcgagactccatctcaaaaaaaaaaaaaaagaaattggggcaagatgtatgacataacaatttaggaatgagtgaatacaggtaggtgagttgaagggagttctgacaggtaagactgttgtctggcaagtgaactgtttgctcacgcaagcaaaccattgtcctgataggaaagtggtttgctcagacaaattagtttgcattaatttcctgaagccaacagtgaagctgtttcttggttcagaggtttatcttcctcggcaagaattttctggagcagagaggaagtcactgacacaggtggtctcgatgctcactccaagagttgagttgtgtggctccaggtagactcatttcccagggtcacctgctgggccataatcaacaaggtacaagcttaagagagccatgccgggatttcaagttgcaaggaagagagattcaatggtgctttcttgagtcacgggtgttggttgtaagaaactggtggggtaaggaagctagaactctcccaggaaccaggaacggctctcactggcaggcctcacggaggagacccaagctgggggactggaaggtggttcagattgttcacaagctgcagtggctccagcagtcagattggggtgtgatctcacagcaccaggagccctgaacaccagcctgaggctcagccctgaaggcagcttgaccaggcaaacctggagactgcatcaacaccagcagcctccaacacacctgacctgctcatggccttaatcccaaacccaggtcctaaactacctctcactgtgcatcgcaagtcactgcccatcttcctggcttctgatctgctgccgtccccgattcatggcctcacttcacccactgattgcccttgactttgagctacaggtttcaccagctaactgcgactctagcctcagctctggggccatacagcctcaagcacctgggtcttgctccagctccagctccctgttctaggcagcccatccttgggaagaagcagacaaaactgcatgtcagagacatggctctggttgtcatgagaagactggattgcaaagaggtcaatgagagacgagaatctaaactaaggagatggcagtaaaactggagagatggcaccatacgaaagaccagtgatgaatctgcagacggggagagacgagtacaggatggcttctggtttccggctttctcaagcctgtgtgggaaacagaaggaggagaagattctgatgacctgctgctgctcaggccgacttcgaggattctgtggaccgcccagggaagaggccgggtctgtgggtagaaattggaacctggggttcaggctggggctgaggtaggaggcttaggagataatggaagttgaatctgggagggcagacgaaatccctgggaagtgccaggatttaagaggctggtggatgcagaagagcctgccaatgagggagaaatcaaggaaagaaatgtgtgtgtgcatgtgtgtgtgtgtctgagagagagagacagacacacacacagagaatggtaaagatgatggacacaggccaggtgcagtggctcatgcctgtaatcccagcactttgggaggccgaggcaggggatcacttgaggtcaggagttcgagaccagcctgaccaacatggtgaaaccaccccccgtctctactaaaaacacaaaaattagccaggcctgttgacacacacctgtagtctgagctactcgggaggctgaggcaggagaattgcttgaacctggaaggcagaggttgcagtgagcagagattgtgccactccagcctgggtgacagagcaagaccctgtctcaaaaaaaaagaagaagaagaaagaaggaggaggaggagaagaagaagaggaggaggaggatgcagcaaaaaacagcaggtgaatctgggtaaacgatacatgggtatctaatgtactattcttcaacttttctgtaagttcagaattatttcctaatgaaaattaaaacagaaaaacaaacaaaccaaagaaatgtgcaagaggaagacaatcaatgacatagacagaccaagtcagatgaagactgaggagtattcatcagatgtacccataaatattctttggggatcttggcatggggaccatccacaggagggaggggacagatgccaggcagcagggctagtcagtgaaatgggaggagagggagcgagagggtgagcaagggcaattttaagaggcttggctgtgaatgggaagataggataggctgtggcccaggaatgaccctccaggcccccactatgaaagcaatccttccaaagcagtttgcaccccgacatggggcacaagaggggccctttgtgcttgacaaatggatgcatgaagggatggatgagtacattttcatcaaggaccaagtgagcctagcctcggggctgcaggctcctgggcagtgagtggtaatggggtgggggcttggtcaccctgggaagggggctgagcagggggtcctctgtccccagcctcattccacacaccatgctgcctgcccctgatccccttcacactcagactctgcctgcccagcacgccccaagctctgctcctcatctcttctctgtatccacccccgacctggtgtttccctcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcggatcacaaggtcaggagatggagaccatcctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcagcagccctgcatgcaaggaacaaggcaatttcaaatgattgtcttccattcattcaagccaggacatgggatacaggattgtatttcaggtctgcactggaaagtaacggaacatcatttcctttttaaaaaacgggcatctatgccaaaacaacagcttcagctgatgtctccatgaatctaaattcacgtgatccactggttgacctgggtccccgccttccaccacctggctttggttcattgtctcctttcatttctgggctctgtgattggaaacatctgagcaggcggcccacactctggtcctcatcagaaccagtcaatatcctgtgtgtgtgatctggcaagggaagggctggcccggcaccagttgtgttttcacctttcatggctccaactgagttcagcccaagcctacgacccagtcactgggaaaacgtgagcaatgggatctacacaacaatattccacagtcagcagctcctgaacgtgccgcagccacagggcttacagcctcacaataaagcccaggggtagtaaaaagtgagctcgctgttacagaacagtgagtgccacctagcttcactgtcatgggacacacgctgcaggcaaatgcactacttggtaggagattcagcagttctgaggaagggcctccagctctccaggtactgcagcttccagtggttcaagtgtccagtgcaggggcctgcaaagcaaacacgggcaggagaggggctgccagtgtggcccaagagacctgcagggcaagccagcaggacacgccccccagggagggcccaggaggtgctgaggtgcccggtaccctgccaaggaagcaggtggcggctgggtcatcctatgggaggggaggtggcgccatgggcccaggtgagggtgatcaccaaaccctggggttcagggatgccgtgtttagactctgattgtgggcggcggtgagtctgtgggcttactagccacacactgaattcctaaggagaggcagggagggagctgtggacattccaggtgattctgcgaattcagctctgcctctggggctgtgcaggaagacaggaggccaggagcagagagggactgaggctcaggaatgagcagccatcagctcccagagccttggagacatccttgtctcagatgcaggggtggctcagctggagcacagggctgcagaggggagggagcgggtgttctgggccagccctgaccacacggacctgcaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtgaggcccccctgctcagaggcaggggcaggggcaggggtgggagggccaccccagttctctgcgtgagagcaggccagcctgggggcaacatcaggctctgcctccgtgagcttgggcaagctccttaacctctctcggcctcagtttcttgattcgtaaagtgggggtgataataataacaccctctacctctcaacatcctgtgaggatccagtgagttcacacagcgctcaggtaagccctggcaagccaacccgagcacgtgttaaccattgttattagtattgttctctgcacaccagggctggacctcaccttgctgtagctcttcccacttccacaaagggcacacagacaatggcatttgcagttgtgacatgtgcctgcctttgcggggtggggggtgcatggcttgtcctacagaaggtggggacacttcctctggctcctcctgacagagcaaggtgctgtctgcttggaggggaagctgaagggtttcagctccttgaagggtacccccagctttgccttccccccttgtgcagacactcacgtgtccccatggccacagcctggtccctctcacaggtggtgacacagcctcttcccaacaacatatgccttcattcctgaggtcctagactggtgcacagaccctgtcctcacccagagagctgagctctcctgaaatggggcctcacccacttttccagccctatctcccccccacatcacacactccagaaccagcagaccaattcctcaacaggtcagggagcttatatcccctgctttcacactcacagcaaccctgcagagtaggagtgactattcccattctttagatgaggaatcaaagctcagagaggttaaataacttgcctaaggccacacagcaggactgcaggcttcgtgatggcagggacccagtctgtcatattcattgttggactttccagcatctagcttaatgccaggcgcatgacaggtgctcactcattcattcaacaaacattaatgagcaaatggataagcagccagagatgagagaaacgggggtcctcacccagatcctgcccactcccaagctctccctccttcctgacatctggctacgtctctgcacagcgttagctattccctgcctatcctgaccactgctgtcccctgcacctatcctcatgcttgtcctgccacccggaacccactgttcagctgcagacctggacaggcaggcataggaaggcataaggacacagttgacagatagcaacaattctagattgagacaggcagtgcctctgacagagaacctgggaccagctgctggtcctggaggaataatgagcttggatgggggacatagagtctgagatactgaaagtgaacgcatccacatactctgggctggagacagggaggggcagatcggcagagcagagccaaaccaagtgaggtcaaggggcagacggaggagcagccccactgcatcggggcttccacgtgtgcggggcttgtctcacttccccacgatctcaacatacagtacagcagccagaccagtctcccaaaacgctgcttatgcctggcactccccggcttaagaaccagccaggagtcaagggctccccgttcttccttgtctgctcagacaagtgctggggcctgcagctttttcagatgcctttgagggctatggctcccacaggagacacgtacagccccaagcactaagaccctggtgactctttgctgtcacattagccactggctcatcattttactcagctccagaggaaacccaactcctcgagtaattctttggtttttcttcaaagtccccagtccaccactggctctgccttttaagctggacataggaaagctttctggatgtcagtgaggccagaccacagcacacatgagcaggaacagcatgaagctgctttccccagagcccctgggccagagggcattgctcagttactggccagaactggagagtgagatggggaggatcagcagggacggctggagtcactgaaagataggtttggggctttgctctctgctttcttcttgtgtgaccttggacaacggacttggccttcttgaacctccaagtcttcatttgtacagtgagatgctactatctctttgacaaatattttaattttctctattttaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatgaagaattgctgataaataagtgaaaatgtagttttgacaaaacaactgagaatgtggggttttaaaggaagtcccaggcttgtgctgaaaggaatccatggtgcagggcacatgaggacccccaggtaagcctgtcctgatggcactagctcgtggctctttcagcttctcgtgcattgtggagttgtagagaatgacatttatcgaaagttcaacctcagcagtggttccaaagctttattatgctttgattttcctaggtagggtagtaccaactttacagtcaagtttcaatcgacagaaaaatgagagtctgaaaaatgatatactttttcttttaaagaacactgtatcggccgggcacggtggctcacacctgtaatcccagcactttgggaggctgaggcaggtggattgcctgaggtcaggagttcaagaccagtctggccaacatggtgaaaccccatatctattaaaaatacaaaaaaattagccaggctgtggtggcgggcacctgcaatcccaggtacttgggaggctgaggcaggggaattgcttgaaccagcgaggtggaggttgcagtgagccaagatcgcgccactgcacgccagcctgggtgacagagtgagactccatctcaaaaaaaacaaaaacaaaacaaaaaacactgtatattaattttgatcaaagaatcaaaatatagaggtgattttttttgtaaaaataagtattgtgttgctaagcagttcacattcaaccaagcacttgcaaggtcagtctcacgatcagccaccagcagctgcgcattcatggctgctggtgaagagccgtatcacctccctgtgcctcagagacctcttctgtaaaataaggaggctggcctcgatcaaaagaccacttgtcctctagttgacacctgagcagctttaagaggttgaatgttgtatagagaacgatcttgtagaaatctgtaagccccttatgtgacacccagatgctgacgacccacctttagaaacttcaggccattttgggagagttggcagaatgagtttccacatattcactgctgggactgctgcttccactgtttggtggtcccccatccccttcagccaggagcacccactgtatccctcaaaatcccccttggggggccccttctcttattctctggccctccaggcaggaagaggacaccccagctgcccagcactgggccaggcctgtgagtgactgctgcctcaaggtgtagggctgtcctgtggccctccccacacccttgttgccaccacctgcccttctccatcacctggcccctctgcaatgcccagcctgggactcagactcactggagaaaaccatccacccctgggaacctgtcggcctccctgcctgtcccacaatccctgacctccccacggctgccgccaccatagaacctcagcctgcagacaggcccaatggcgcactcagctccctgcttggagcacagccccacaacctgagtcctcccttgggacctccggccccgccccccggcctgtcagctccatccagcttccctcgccttcccagctcagttggtcaccaccttcagacacagtggtagaggcttcctcatgtgctggggtcactggactccagtccttctactgtgtgaggccaccaaccccacctctgcttaaatcccactgttcacatccaacaccaggtatcacagggcagggaaccgcaccgcctggtcctccaaaaaaccctcttgctagattcccaactgagtcctcacaaagattctggccaatcccacacacatacacccatgtcccagaccctaccacctcttggcaccaaacatcttgagagtcacagtcatttccaccccttcccatcacaatgcccaccctttctgcaccggcaggaacggctccctccccgtcatcaagcaatct

SEQ ID NO: 17033 - DNA, 194937 bp, Human; identical to SEQ ID NO: 17032

SEQ ID NO: 17034 - DNA, 33536 bp, Human
aaatagaaaaattagccaggtatggtggcacctgcctgtagtcccagcaacttgggaggctgaggtgggaggatcgctagagcccaggagttcgggaccagactgggcgacatagtgagatcctgcctctattttataaaaaagaaaaaaaagtcacaccgactctgtatgatttcttgattttgcttacaaaacgttcattatgcatatcaaaagataactaagaggaaatataccaaaatatttgcactttcaccgtctaatggccattatctccagaacctggtacaaagcacgaggcatagcactaaatacattaaaaacaagtaacagaaaatgcatatgcgacagaggagaacatgcaacactttttttttttttttttttttttttgctgtgtcgcccaggctggagtgcagtggccagatttcggctcaatgccacctccacctccccggtacaagcgattctcgtgcctcagcctcccgggtagctgggactacaggcatccacctccatgtccggttaattttttgtatttttagtagaaatggggattcgccatgttggccaggctgatctagaactcctgacctcaggtgatccacccaccttggcttcacaacgtgctgggattacaggtgtgagccaccacacctggccggcaacacattttttttggctgaatggacatggttattgctgagtaaacgtatggtgtatgattttattcttccttatagttttagattccgaattttctaaaaggacctaatgtcattgcagatagttatcacataaagataatgaaacagggggagtcaatgccctccaatggcctcaagcaggagttagtgacaaggaacatggctcctgcaaccacaggttcctttttttttttttttttaagacggagtctcactctgtctcctaggctggagtgcagtggcgcaatctcagctcactgcaacctccgtgtcctcggttcaagcgagtctcctgtctcagccgccctagtagctgggattacaggcgcctgccaccacatccagctaacttttgtatttttttagtagagatggggtttcaccatgttggtgaggctggtctcaaactcctgaacttgtgatccacccacctgggccgcccaaccaaagtgctgggatgacagacgtgagccactgcgcccagccaccacaggttcctcttttttttttttttttttgagacggggtctcgctctgactccaggctggagtgcagtggcgccatctgggctcactgaaaccaccgcctcccaggttcaagagattctcctgcctcaggctcctgagtagctggaactacaggcgcgcgcctccacgccctgctaatctaatttttgtatttttagtagagacggggtttcaccatgttggccaggatggtctcgatctcttgaccttgtgatccgccctcctcggcctcccaaagtgctgggtttacaggcttgagccaccgcgccctgtctgacaggttcctcgtttttgtttttgtttttttttttgagacggagtttcgctcttgtcgcccaggctggagtgcaatagcaggatctcggctcactgcaaccactgcctcccgggttgaagtgattcacctgcctcagcctcctgagtagctgggattacaggcgcccaccaccacgccccgttaattttttgtatttttattagagacagtgtttcaccatgttggccaggctggtcttgaactcgtgacctcaggtgatccgcccgcctcagcctcccaaagtgttgggattacggacgtgagccaccgcgccgagctgacaggttcctcttaaagccctgagtcccagggaagggacctgcaggcccggccacgcccaggccgctttagcgcgccaagatggcggctgccacgccccgcggccggagccgagtgggcccgagcgcttccgagcattcccgaagtccagagaaactccgggagcggcgcgggcgggagcgggcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacgggtgagtgcgcggccggggccgggctggaggccgcgggatcgggcgcggaggggggttgggcccggactggggcccaggcaggccggcgtccgcgcggtctcgcgtaggcggtgggcctgggcctgtgtcgcggggcgggggccgcggcgggcgcccccaccggaccctgacggcccgggcggcgcgtgcctggttccggctctcgatggaggagggcctcgccgctcgccggctagagggaaaagtgaactccaccctccggctttcttcccggacgccgcccgccgccctcctcgggagcgctcgtagagcaagcgctcttggagattttgaccatttttccaaaaagggaccctttattttttttgcatgaacctctcgatccccttttgagaattgggttgggaacgcggcggtcaagtcgatcatatttgatgcatgcttgattgtacgggccgctttggtgcccccaaacttttctttaaaaaaatttttttttcatagacggggtctcgctgtgttgcccaggccggtctcgaactcctgggttcaagcaatcctcccatcccagcctccaaaatgctgggattacaggcgtgtgccaccacgcctggctaatctttaaaagttttttgtagaaatggggtctcactgtgttgtccaggctggtctcgaattcctgcgctcaagtgattctcctgcctctcagcctccaaaagcgctggggtgacaccgcgcccggcctctcaacttattttcgacaggttttttgacttacacttctgccactgttaggattcttaaaattgttttcgccctttccgtggagaaagttttgaagatgctggctgggaggagccggctgtaatgggggactgttttttcttttctttctttcttttttttttttaaacaacgtggtgtggtcattgacaaaaaaactgttctttgcttaacgcgttaggtatgggatgtagcagaactggccccctgtgactccaggcattgcttttcatgattgtccgtgatggttacaggccctagaggaagacaaaacttgtcttatgcagtttttttctcccatagaaacaagaatctcagtgtaacccgagcaaaatcgcgcgtctcagcgttgcttgtataggttagtgttagcgaggaagaattactaccagtttaatcaaactcaatgcaactggtacatgttgcagtaaagtccaaggaaagttctggcatcacggttaactggattgatattcttcaaacttatcattaggacagattttggttcttgcaattcagatgcaagaaggataattagacagctgatttttgtaagatgcccatctgtcggatttgtcttggaagtgtgaaggagtattagagtatgtaggctattcaggcttttttttttttttttttttttttgagacggagtttcactctgttgcccaggctggagtgcagtggcacgatttcggctcactacaacctccgcctcccaggttcaagcgatcctcctgcctcagtgtccttagtagctgggattacaggcacgcgccaccgtgtccggctaatttttgtattttttagtagagacggggtttcaccatgttggcctggctggtctcgaattcctgacctcaggtgatccacccgcctgggtctcccagagtgttgggattacaggcgtaagccacggcgcccggcccaattttttttttttttcttttcttttttttttttttgagacggggtctcactctgtcgcccaggctggagtgcaatggcgcgatctctgctcctgcaacctctgcctcccgggttcaagcgattctcgtgccttagtctcccaagtagctgggattacaggcgcaagccaccatgcccagctaatttgttttttttttttttttttgtatttttttggtggagacggagtttcaccatgttggtgaggctggtctcaaactcctgaccctcaagtgatccgcccgcctcggcctgtttttttttttttttttttttaagtcatattgctgataattatttgaaaatttctaaaactaaaacataagcatagcagatacgtttatttaatactaaccgattgtggacctctgctgtttgaattggctgttttatctagtcaaataacttgttgaatgtcatggaatctggaccgtcccttcaaatccccaccccaccgcttacatggggtaaccctaagcacatcccccacctcccaagagaggcggttcaatgggaggtcaacaagactaaacaagatgttggttattaactacctcgcaggtgccccttgctgaatgcttagtaaatgccaggtactgttattgcggtttctactactgagactctgtgagggagtattaggcttaaaagtctgtggccttgagttttcagtctgttttttttttttaattagttatgagcatttgaacaagcacagttattttttaatactatgtttagtattgatgttgactacagctaagtgatattagaagtgaaatgtacctggccaggtcaggtggctcacacctgtaacccagcattttgggaggccaaggtgggtggatcactagagcttaggagttcaagaccagcctgggcaacatggcgagaccctgtctctgctaaaaatacaaaaattagctaggtgtagacacatgtgcctgtagtcccagctactcgggaggctaaggtgggaggatcgcttgaaacccaggaggtggaggttgtagtgagctgagattgtgccattgcactccagcccgtgcgacagagtgagaccttgtctcaaaaaagcaaaaacaaaaactattagagatacgtctttggccgggcacggtagctcaagcctgtaatcccagcactttgggaggccgaggtgggcggttcacctgaggtcaggagtttgagaccagtctggccaatatggcgaaacctcgtctctactaaaaatagaaaaattagctgggcacgcctgtaatcctagctattcaggaggttgaggcaggagaatcgcttgaacttgggaggtggaggttgcagtgagccaagattgtaccattgcactccagcttgggtgacagagggaaactgtctttttttgtttgtttgtttttaaaggagatacatcttcatctgttcctgctttgaccctttgcctggaccatggcagtgtcctttcaggctgtacgtccctccatcctgccctcctgtgcctctgcttacactgggctcttaaggaaactcctgctccttgtctcatcatccctagggatggttctgtcttatcatttctagaattggatgccttgccatcttgtttgctccttaactctgcatacagggctgtgtaaataattccttcatgaaaatctctatttcaatcttctgggatgagttttttccttctgggaccctgactgatagagactgataatacacccgtatgaaaatatgtctgccaggtgcggtggctcatgcctgtaatctcagcactttgggaggccgaggcaggcggatcacctgaggtcaggagctcgagaccagcctggccaacatggcaaaaccctgtctctactaaaagtacaaaaattagccgggcgtggtggtgggcgcctgtaatcccagctactcaggatgctgaggcaggagaatcacttgaacccggaaggcggaagttgcagtgagctgagattgtgtcactgcactccagcctgggcgacaagagcaaggctctgtcttgaaaaaaaaagaaaaaaagtcagaaataatttgcaaagcatgttagaaaattctagatttcctgaatagcaatttaattgagattggccaagaaatattacatagggttgatactcttttattctaagatagtcctttctgagcatggggtctataatttttttttcctccaccttactgctgccccaccttttaactttcacttagtggacctttgccccaagattttctctcagcttttcctaggtaagacagcatcacccgggcgcgatggctcatgcctgtaatcccagaactttgggaggccaaggcaggcggattgcctgaagtcaggagttcgagaccagtctggccaatatggtgaaaccctgtctctactaaaaatacaaaaaaattagccaaggatggtggggggcgcctgtaatcctagctactcgggaggctgaggcaggggaattgtttgaatcaagggaggtggaagttgcagtgagccaatatcgtgccactgcactccagcctgggtaacagagtgagactccgtctcaaaaaggaaaaaaaagacagcatcttacattcaggtatttataaacaacttttattatttatttgtttttattttatattggctcactgcagcctccacctcctgggttcaagtgattctcctgcgtcagcctcccaagtagctggaactacacgtgcctgctaccatgccgaggtaattttttttttttttttttttttgagaaggagttttcgccctttttgcaaaggttggagtgcagtggtgcgatctcggctcactgcaacctcctcctcctgggttcaagcgattctcctgcctcagcttgtcgagtaggtgggattacagtcacgctccaccacactgactaatttcgtatttttaatagagacgaggtttctccttgttagccaggttggtctcaaacgcctgacctcaggttatccacctgccttagcctctcaaaaagtactgggattacaggcatgagccactacgcctggcaattttttgtatttttaatagagacagggtttcaccatgttgaccaggttggtttcgaactcctgaccttaggcgatctgcccgccttggcctcccaaagtgctgggattatgggcgtgagccatcgtgcctggcctaaacaacagttttattattttattttttatttttttattgcttattactattttttgagatggagtctcgctctgtcacccaggccggggtgcagtggcatgatatgggctcatggcaacctctgcctcctgggttcaagcagttctcctgctttggcctcccaaagtgatggaattacaggcccgagccactgcgcccggccacaactattttaatagtgttgttttggtgttggttgattaaaggaatgggaacgaatgacttgaagccctctctgtttcactctttatacaaagtggagtccagattgggctagtggcctgtctagcccaatgtctgacttggacatacattactgtccaggagtttcttagctgaatgtgaaaaatgccttccgtgacatcatccttacaggaacattctttacatttattctttacttctgttgaacggtggtggcgtgaaccatgaatttgtttaagcttttcagctgttttgtgtgttttcctctcaaggcatggggtttcatatttttgacctgtggtaaaggtatttgaattctgcactggcctccaaatgtaggtgtagtatatggctctgatctttgttgatgattttatacataatgtggttttttttcttgataagccaaaaaaattatacataatgtgtgtgtgtgtgtgtgttttaatttcaaatgatagttacagtaaaagtttggagttgggctaagtgggaggagcatcaggaagccatttttagaaaccttaaattcaccctttataactttctgtctttttgcattagtcatctgataccttagtactgcctactttttcacatctccatcactacgtagctcttaaaattgtagtcttccttgaaaggagatgtttttgtcaagagtctttgccaccaaggcaggattgcatgtgatcagtaggaatattttcctgcaatgtcttaatatgaaaaatttcaaacagactagtggaaagcattgtacagtcaacatgcacatacccatggcctggattctatgacagtattttgctctacttgttcattttgctgtatttgctttatcatgtcttcctgttatcagagggaaccttttaagaggatttatagaggagttgattttgttttttgttttgttttgttttgctctttttgaggtggagtcttgctctgttgcccaggctggagtgcaatggcatgatctctgctcactgcaatctccgcatcccaggttcaggcgattctcctgcctcagcctcctgagtagctgggcttacaggcacccaccaccatgcctggctaatttttgtattcttagttgagacaggtttcaccatcttggccaggctggtctggaactcctgacctcaggtgatccacctgcctcggcctcccaaagtgatgggattacaggcgtcagccaccatgcccggcctgattttgaaaaagaatagggactgtgtgcagttacatataaattcttatttttgaactcttgtgtgttcagctggcttgtatcaactacaccagggttagccttgattctggaagggtggattcagacttcagctcagttgtacatagtgtcttcagcctaagtgagaaactttatgcactatcttaattttttgaagcttctagtggtaataattgctggctttttttttttttttttggtagaaacagagtcttgctctgtcgccaggctggagtgcagtggcacgaaatcagctcactgcaacctctgcctcccaggttcaagcaattctcctgcctcagcctcctgagtagctgagattacaggcgtgtgccaccacacccagctaatttcttttgtattttagtagagacggggtttcactgtgctgcccaggctggtcttgaactcctaaggtcagacagtccgcccaccttgccctcctaaagtgctaggattacaggcatgagccaccgtgcctggcttatggctagctttctttacattgattgtgaagtcagatattggtagtagaacatcataattttagattgggttttgtgtttatttagcactgcactactctagtggtgtatttttctggacagattttatctgcatagttaacgcagttatatataaggcctaccgttacagaatccccataccttgtttgtcagtgtaaatcgaggaccttcatgcgaggtctttaatttattcaataagtaggaatatatatttgacagttactaaattctactgccttgtccttaagatctacatacttttttttgttttttgagtcagagagtctcgctctgttgctcaggctggagtgcagtgatgcgatctcagctcactgcaacctctaccccgtggcctcaagcgatacttctgcctcagcctcctgagtagctgggattacaggcgcctgccaccacactcagctaattttttgtatttttaatagagatgcagtttcgctgtgttggtcagtctggtctcgaactcctggcctgaagtgatccacccgccttggcctcttgctgggattacagggaagagccactgcgcctggccaagatctactcacttttagacagcaatatatgctctgtattttggtttgcaattgtaattgtcattggaagagtttggcttttctgtcctgagatcaacgtgtctttaaaagaaggcagtgcagaaagttgttattttttgagcttcttggatcttttatttttttaacgtgaggaaattcctagcgtttctagatttgttgattgtgcttttaagttttggtttatagatttcaggaagtaacactaaagtttaccctactctcctcaaaaagtaagtaaaaagttctcttggctgggcgtggtggctcacgcctgtaaccccagcactttgggaggccgatggggtggatctcctgaggtcaggaattcgagaccagtctggccaacatggcaaaaccctgtctctactgaaaatacaacaacaaaaaaaaattagctggatgtggtggtgcttacgtgtagtcccagctacttgggaggctgaggcaggagaattgttcgaacccagcaggcagaggttgtggtaagccaggattgcaccattgggctccagcctggaagacagagccaagactccgtcttaaagttctcttaatggaaaaatgaagaacataatagcaacataagttatttgctttcattgtggttatttctacaggacagggcaggggaagcacagataggttaaaaaaaattgtagcatcatgagctagggggaaatccaatgtagaaatggcatgaactttcttccagccgactcatgttcgtttcctagagtgatgacattgctcgatgattgaaaagaggttgaactgagcagttaattatataaagttagaaattccaaagaagtagtaactaccagaaattctccagcagtatcagtcaagacttgtggccaaatacggcttccattcttcatgagggaaaggccatggaaaggctgtcacattgcccagtgcagatgttgacttggtttgtggaagcgcagcgtggacaaggaatgaatatacactaataggagtggaataacctttttcttttacctatttgaataaattaagtaaaagttttaatcagaagacttaaagaggagtcgattttatcttttgattgcactaagcttaaatataaggttgcactttaagaattctgtagtttaataatcatattcttataagacatagatttgtaacaaatagtgattggtaataaaatttcagtcagtatcagattatgccagtaccttgaatttcttcccggttgagcctttctcagctaaagatgtcattcaggaaaggaagtttagaggattttagacacagctggttgcctttatattagtagttttgttcctcatatacatagagacttaggacagaatagtaaaagaagtgataatgacattttatcataacagtcaaaaccttcatagcagcttatccttgacactgagtggcaactattgttaaggtttttacacaacctttatctttttttttttttttttttttttttttttttttttgagacggagttttgctcttgttgcccaggctggagtgcaatggcgcaatctcggctcactgcaacttccgcctcccgggttcaagcgactctcctgcttcagcctcccgagtagctgggattacaggcatgcacgcccggctaattttgtatttttagtagagaggggtttctccatgttggtcaggctcttctcgaattcctgacctcaggtgatccgcccgccttggcctcccaaagtgctgggattacatgtgtgagccaccgagcccagccaacctttatcatttttaaaaaggtcccttagagccttaggctccactttcttcctcagctgccacatccaaaccatgggtaagcgatgcttgatctgcctccaagttcaagcagtccaggaaacagcccacttatgttcactgtccagtccccattcttggtccaggccaccatggatggctcctggactgtagcaacagcttccatgtgtgtctgccttgactgagtccctggcgtcctcaggcttcctgccacactgcagttggaggcttcttctaaaatccagtgctttctgggcaatttaaaacctgtgactttccaagtaggatctagtccccatgtccttaacaagaagaggtaacgtatttccctatgccactgcccacttatttttttattgttgagatgggatcgtgctttgtcacctaggctgggtggagtggtgtgatcacagctcactgctgccctgaattcctgggctgaagggatcctcttgcttcagcctcctgagtagctgggactacaggcaagagccaccacttatttttgaattttttgtggaaacaaggtctccctatgttgcccaggctggtcttgaactcctgggctcagcgatcctcccacctcaggcccctgtgctgggattatagcctcctgtgctgggattacaggcctaagccactgcaccaggcttttattttttaatttaaaaaaatttatttttttgagacagggtctcactttgtccctcagactggatgcactggtgcaatcttgtttcactgcagccttgacctccctcctgggttcaagtgatcctcgtgcctcagccccccaagtagctgagactactgctgcacaccgccacacccacctaatttttgtatttttagtagagaacgggtttctccatgttggcccagctggtcttgaactcctgggctcaagcgatccacccacctcagcctcccaaagtgctaggattacaggcatgagccaccatgcctggcctaaaaatatttttttcagctctagaaatgttagctcttttgctgtacatttccagagctgctttaataatgacagttatcacacgcataatttcatgtgatgattgcattcttaatttttaaatttaacaactgcacttacttcatgaggtcttgttcattgatacatctttagcacctagtgtgcttctggtgtagcacacggttgatataaattgaaattgaattaatgctcacagtagtttggggatggagctggtagttctgcattaattttgcaggtgaaaaaaaaaggcatgaggaagttgaaacttgccaaaaaatacagccagtacgtgctagaattggccctgggtctcaaatctgggcttctgactccaaagcttaggctcctgctcatacaggtttattttcacattctaagcttttaacgaaatgtatgtccaatgagtcatttctgtttagaaagcctttaggagttggaagctacttcctggtgatgtaatgtttgactctctaaagtctttggaatggggagttccaacttttgttaagccctcaataatgtcatgagtgaatgaatattggcaagactggctgggcctgtaatctgccttgagtgtgagggaaaatggaaaagcgcttaactttatggtgaattctaatttatagtagttgagattgaacgacaaaaatcttaaaattatgatgctgatgtgtcattgtgaccttggtaaactgacagcacagcagagagaagggctcattaaggagagcacttggctaactgaaccctcaggatgccagagacttgaattctcatgtaagcccttaagcttgccttgtcaatgctgtaaaaattggagacctttatgttttgctaatgatgtggtgaccttagttattaggtgatagcctcttgaaaaacattccaggtggttgggagactttcagccaccactcttctgcctggcggcacactggtaatattaggattagtctctacccattgccagttgtgcaggtggtgctcctttctctgaagtatttctacacacttctctgtttggcaagtttaactcccatcgtctctgagctgttaattaaatgtctgggatgtattgtgatagtccctgcttatagacttatggtgctgtgtgaggattggggctgggggaggtggcatttaaatacagctgaatcaatgtgatggcagttacgtgtggtagtttattgactaagcactttctctcaagagaacagtcattgctgattgccataggggaggctgtagggatgtggtgggattttgagctgtcccacttaaggcagcagaataagttacttaaagaggaaggctgtgtttgtatattagtgttaattaaaatacctttaggctgggtgtggtggctccagcctgtaatcccagcactttgggaggtccaggtgggcggatcacttgaggtcaggagttcgagaccagcctggccaacatggcgaaaacccatctctactaaaaatacaaaaaaattatccaggcgtggtggtggacagctgtaatcccagctacttgggaggctgaggcaggagaatcgcttgaacctgggaggcagaggttgcagtgagccaagatggtgcctctgcactgcactccagctggggcgacagcacgagactcggtctcaaaaaaaaaaaaaaaagaaaaaaaagaaaaaaagaaaatatcttcaggatcaaacttaagattcttgatgagaggctctacagatgttcacagaagagacgtgaagttttaaaatcttgtttctcttgagtcttgtagctaggtgacaactgtttcttgactattaatgctaacaccgggtacctaaacagaatgtgatggctcctgactctatctttctgagaaattctagtttgtttactttaaatttcagggtaccaatgtgtatgtggtgataaagggttatagaaaacattttctttaatgctaagtatgtgatgtatatgccttgattttttttctctagaaattattttaacttaatagtgaaagctaagattacattcatgttgactaagcaaccttttttctctttctctttagagctgtaggtaaaacttgcctactgatcagttacacaaccaatgcatttcctggagaatatatccctactgtgtaagtatcttaaattgggaattaacctgtttgtgttacgggtttcacatttctttgaccatttgttttgctgtaaagccatctttaatcctcatatgaacagatactaattttttcttaaacattcactgaaacctaattataaggtatattaggcttttaaaaaatagggctgggggtggtgatctcagcactttgggagactgaggcgggtggatcaactgagggtcaggagttcgagaccagcatggtcaacgtgatgaaaccccatctctactaaaaatacaaaaaattagccaggtgtggtggcgggtgcctgtaatcccacatacttgggaggctgaggcaggagaatcactcgaaccgtggaggcggaggttgcagtgagccaagatcacgccactgcactccagcctgggcaatgagagcgaaactccatctcaaaagaaaaaaaaaaaagaaacttagggtaatataaacttttcacaactttgctagttgatttttagacatccagaaagcaaactttaactgtctgtgaggtacagagactggatgatgttaaagaaaaccatagttggacacaagaactctgaccaaaagtctgatcagaaacagtccttgtcagtgcacgagtttcagatacactggctttctgggaactggaaagggaaagattccattacgttttaattggccttttctgataagtcatcagttggttacatgtccgcattgaggtgtagggctttggaattgaaacttgggtgtgtgtgttgaagggggaatgggagggtggaattggctattgaattgcttactccctataggcagcagaattgggtggagacaggaaagtgctgctctggtgatgggttacccgggagcgcacgtagctgagcctcataatgcaccatcctgcagctgctgtgagtcctccctgtgcaggctggggaggtgtcgcctcctccccacctgtgttcacctcctcaggcacaacacacacccaggtgctctctgaagtgtcgtacccatgtttttgttgttgttgttgttgttttccttttttttttttttttttggagttagtctctctctcttgcccaggatggagtgctgtgatgcgatctcagctcactgcagcgtctgcctcctgggttcaagtgattctctgcctcagcctcccaggtagctgtgattacaggcatacaccaccacacctggctaatttttgtttctttagtagagacgggtttcaccatgttggccaggttggtctcaaactcctgacctcaggtgatctgcccacttcagcctcccaaagtgctgggattacaggcgtgagccacggcacccattttttactgtaagtggaatcatgctgtccctgttgtcctaaatttatgggggagattttccttatctacatatgtagataaaggtttaatcattaatgattaatgattttgaagtactataactgatttaacccactggtcacttggactcttggtgttaacaaacattgctgggttcagtgttgtcccttatgtctttgtgtacacttgatagattattagaagcaaaatcgtgccaaatcaaaagacaatggatgttttaaattttggtagatacagctgggcgtgattgctcacgcctgtaatcccagcactttgggaggccaagacggaaggatcacttgaggtcaggagttcgagaccaacctggccaacatgttaaaacccccacctctgctaaaaatacagtagttagccgggtgtggtggtgcactcctgtagtcccagctactcaggaggctgaggcatgagaattgcttgaacccgggaagcagaggttgcagtgagccaagattgtgccactgcacttcagcctgggtaacagagtgagactctgtctcccaaaaaaaaaaaaaattaaaaaattattttttggtagataactaccaaattgctgtctataaagctgtcactttgctggccttgacttaagtggcctcttagtacacactgccattaacgtgggttgaagttatctaaccgttttcatttccaatcacagatgtggttaaaatcttttgaattttttttttttttaattaaaaaagtttgctcacgcctgtaatcccagcacttggggaggctgagctgggcggatcactgaggtaaggagtttgagaccaacttggccaagatggtgaaaccctgtctctactaaaaatacaaaaattagctgggcatggtggcacatgactataatcccagctattcgggaggctgaggcaggaggattgcttgaacctgggaggtggaggttgcagtgagccaagattgtgcctctgcactccagcctgggcaacagaacaagacattgtctccaaaaaagaaaaaaaaaatatgtgtttttgtagagctatgttttgctatattgcccaggctggtcttgaagacctggcctcaggtgattctccaccttggtctcccgaagtgttgggattacaggcgtgagccaccacacctggctcttttgaatgtttactgtacatttttagtctcttgtgaattgtctgtttaaatcttttgtatttttctactgaaattttttcttactgatggaacatttccttccttccttccctccctccctctctccctcccttcctcccttcctttcttccctccctcctcctctccctccctctctccctccttccctcctctcctactccttccctccttccctccttccttctcctttcttttcccctccctcccttgctccctccctccctccctttttttttttttttttttttgagatggggtcttgcagtattgcccaggccggacttgaagtactggtccttccacctcagcctattgagtagcatgctccactgcacgtagcctgatggaacgttttgtaaataatcctcagtctgtcatttgtctttgtacttcattatggtgtcttctgccatatagaaatttagcatttaatgtaaataataccaccttacccgggcacggtggctcacacctgtaattccagcactttgggaagctgaggtgggcgcattatgaggtcaggagatcaagaccagcctgatcaacatggtgaaaccccatctctactaaaaatacaaaaattaaccgggcatggtggcgtgcacctgtaatcccagctcctcaggaggctgaggcaggagaatcacttgaacccaggaggtggaggttgcagtgagccgagatcgcaccactgcactccagcctgggtgacagtgagattctgtctcaaaaaaaaaataataataataatgataataccacctctccctcagaattgtatgttgtacttagaaaggcctttcctacttaaataatgcaaaagtatgctctagtatttttttctaggatttttgtggctaaaatttttatctttaattcatttaggacttatttttggtatagaatgaggcaaggacctgattctttttcccttatggggaaaaaaagtcacaatactatttatccaataatttttttcttatggaaatataattaacatgtccatcaccatcacaccttttctttcttcttcttcttttttcttgagaccgagtttcgcacttgttgcccaggccggagtgcagtggcgcaacttggcccactgcaacctctgcttcccgggttcaagcgattctcttgcctcagcctcccaagtagctgggactacaggtgcctgtcaccacgccctggctaatttttgcatttttagtagacacaaagtttcgtcatgttggccaggctggtctcgaactcttgacctcaggtgatccgcccacctcggcctcccaaagtgctgggattacaggcgtgagccaccgtgcccagcctctgctttttattatatttttcctttttttttttttcttttttgccttcctgtgcagaggaaacactattttcttctaaagcttggtttctgctgaccagtagcaatttttaacatcagtctgatttccctctgtcagcctataggctttgctgggttatctctcctgactaatttgtgtagcaacttcacatgaatttaaacatttgtatcatcagttaacactcactttgaaaatgttattgggaggcttgttaagtcaggtgtattttgtgtgactgctctacactcaggccttctggaaaccctgcagagggtagctctagtggccagctagctctcttgctgaaaatgagcaacataagtacatgaaaaacccaacaagtaggatttgaaagcggggctaattgtacccttatttcttctggggataaaagtcttaaactttgtttaaagtaaaatgtttttatttctgacggtgatttgtttcacttaaatagcttgttgtttgtttctttcatttctcttaagttttgggttgggtttggtttgtttcccgcaagttttgcccgtgccgccttcctccttgtgcctgcagggacatttgctggtgtggcagcctccaggcccgtccccagcctttttcttggcacaccttctctaggatggctgggacagtgacttagcttctacacctgtgactaaccattttcattccattctacagctttgacaattattctgccaatgttatggtagatggaaaaccggtgaatctgggcttatgggatacagctggacaagaagattatgacagattacgccccctatcctatccgcaaacagtaaggattgcagctgacttttaatgtgtcttttagagtatataattctcgagcgcttaattagtgcatgttacctatggacttgcttatattgccatcatttgggtattgagtaaatagcaaacagggtgggattggttccatgtaaacatccccctagatgcaagcccaggggttttgtgttttgagcgttaccagctgttccattgttgggcattttacagtcttccatttagctttagaataaccgtatgaaagagctactttttgtttttgcaaaccagtttttaacaccaattagtttgaaggcaggtttgctgtgtgacatttttgtaccacagaatcaaattaggcagttaagattcaggtttctttaaaccaagttagtaactaatctcacaggtttaatacattttttcccacaaaatacataatttgtatggattttgtgaaccatacaatagaacctaaatttattcaatgtagattgaagttttggttttgtaaaatgtatccactgtgtctaatcagaaaaaaaagtttacttttgcttctgtatcagacaactaagtgatttatttaccaaagctaattagagcagtagctggtgaaaatgggtacttagaagacattgttgtcgttaaaagttacttttctttaagcagcggttttacttgtgtatcatttgcttatcttgttacatgtttgttcttcatttttaaaagtatctttggaagcaaaagttaaatatgcttgagattccttgggttgataacctgtgtgcatgtcctagctctgtgacttcaggcaggcttcatcctctctccagtctttgcctgtttccttgtagggtgagatgagtacgtgtcacgcacgcataacagtcctgggcacatagcacacactgtggggccagccgctgtcagaattctcctgttcctcagtgtgcgggtgggtcggcctaaagagtgctgctttccacgttgtgcccaaatgagtggaagttgtgtggtgctcagcacacctgggttggccggagggattggggttggggttgggttgaggtcaggaagacatcctagagaaaggctggctttgagccctgattgatgatgaggcagcctgtgattgattcaaccagtacttcgttgtagggggtaatatgggtgaaataacttagtggttaagtctgctgtattaaaaatcagtctataatccccagacaattcaaattcttcagtatcttaggaaactcttctatacccagtggatgtttaataattcagattgtaaatggatttaaaaacatactggctggtagagtaggagacttcagcccactggacacatgtggaagggtgtggtgtcattctgagaaacaagagccaccctgctgtgactcagggggtaccgggcagggtgaggcctctctaaggaaggcctcacagtaagtcaagggtgacttggcaggagtcccactttgtgttctgaggaacacacagataaggaaagagaactctcctcagcttgaacaaagctgtagagtgtgacgcctggtatcaaagtaggtgttgtcctcatagggctagaacttaaacttcatgtttcctctgtgtgagactgtggactgctttcctataaaatatttgaggagcaaggagggagtgggacatggttcttgccctcaggtagttcacagaaaagtcccataaactgtgtaagacaccctgtgctagcaagggggtgagccgggcgcttaaggagcaagaggggcgagcacccacccagcagtggaagcattcctgtctggactccttcagagataaggaaattatcttgacaactcaggggcaggccacagatgctcagataccagtgtctggaaggtctcatccctttgagccacactgtcctaagaagaactggatctggtagtaacatgctggcacctgggtctcttgttgataaaggggaaacctctaaattttgtactacatggaatgtggtccctgattgctggctctgtggtctgcagacctgttgatgtagctcatccaagactgcttagacactctcctgaaggaccagttggaagatttcttatctagggtgtcctaaaaagagatgttacatttcttgtggtcatttaacattggcatcctctctattgggcagctctgtcgggctaagtctgttcagaccattcatttcttcttcgttctccaaaagatggtgagcaggtagtcgccattcttagttgaaattgcccttcaggtttttatttcccgaattacgtaatccttacattattttctcttgaaaatctttgctaagttctgcatactcatcttcagttgctatgcacagaatcaagtcttgtcagagtaacgctcaagtccagcatcttcccttgtgtagatcacctgtatttatttgcctgcttgtaccagcattggtggtgtgagtgggagcctaagtgacctgtcagtgtcacagcgagtcctgagccctgtgtgtgtcctgagactcaggctgtgcagcgggttcgctgagatgctgagcctccatgttggggtcagccaggaccccagtgcgtcatgccagttgtttcattttctctctaggctaaaagttgttgttgttgttgttgttgtttgagacagagtttcgctcttgttgcccaggctggagtgcaatggtgtgatcttggctcactgcaacctccgcttcccaggttcaagtgactttcccgccctagtctctcaagtagctgggactacaggcatgtgctaccatgcctggctaattttgttttgtattttattttttttgagacggagtcttgctctgtcgcccaggctggagtgcaatggtgcgatcttggctcactgcaagcttcacctcctgggttcacgccattctcctgcctcagcctcccaagtagctgggactacaggcgcccgccaccacacctgactaattttttatatttttagtagagacggggtttcaccatgtaagccaggatggtcttgatctcctgagcttgtgatccgcccgccttggcctccccaagtgctgggattacaaattttgtatttttagtagagacgggggtttctccactttggtcaggctggtctccaactcctgacctcaggtgatccgcctgcctctgcctcccaaagtgctgggattacaggcgtgagccactacgcctggccagtgctaaaggttttaaagtggtgggctagactcctgtgatggtagataaaaagaaaaactgtggtgttcagcttggcagttttgagtttcaaaaggcctcagcttttgtgaggttggctgttacaagtgcagccagagagcaccaggcacacacatgtggttccgcagaactagagttgttactcttcgccgcgagggaaacacgcacctgggggctgtgggaattcggccctcactcttactggccgggagcaggagatatttggtgatttttgtggtttgtatgatgatcttggatttgtcactacttagaaacgattatgagttgttttttttaaagtttacttacttttggtcctatttcagcacagtcacacaggtgaccttctctgatgttagtgttctgcgagattattctattcaatagtaacacctccaccagggcgaagctgcgagtgccaggctggttctcatacgtcagggctgcctgacccttttacaggattacaggcgtgagccactgcgcctggccagaatgtctgtgtgttttaaaattccaaacttgaaagtaaaatccaggtggatagcatttggaagagaataaaacgaagtagaaacaacactacttttttgtagtgagatctcagctgtccagatgcccgccctgtcttactccatggaaagtggacccatctgttgtggatggttccaccagtgggcaggaggctgtgggaagagcagccctggctacacttaccaccgaggagggagtggtgtgtgatgcaggagtaacaaaggcgttgaaggcaccacgtgtgtaacaggcacgcgggagtctgggttagtcagaaaggggaaagcagtgctcaggttgactggaaacataggccggtgaccggagacagcctgaggctccagaacacacaagtgacctgtgaggaaggaaactgagagaccctggagagacaccggtggtgccctctcaggtcctcttgagtgttacaaggacggggaagaaatagagcctcccagccagggtcagccagcacagcctctgtatgtgaagcgtcaggacagcgacggccgggaggaggggatgctaggaagtgagtaccagaagcactagacagggttttgggaagctatatttagctggggacgaagaaggaacaaggaaggaacaggcagatggcatagcacgaacgccgggtggaaagtggaactgctcgctcctgtcgtgtgtgtctcttctccatcaaaaaagaggctcttaaaaatcgaaagcatgccacagatacgatcagaggctctttggaagctgcatttttgtaactggttctcgatgatcctctcccatggtaaagatttggcaccatatgaagtccttgggaggacaaatcttcaacagtagcccatagatgaaacccagatagctgtggaaactaatgtgctctttgaatgttaagtcaggaaagcttgagtggcctggcacggtggctcacgcctgtaatcccagcactttgggaggccgaggtgggcggatcacgaggtcaggagatcgagaccatcctggctaacacgttgaaacctcgtctctactaaaaatacaaaaaattagccgggcgtggtggcgggcacctgtggtcccagctactcgggaggctgaggcagggagaatggtgtgaacctgggaggcggagcttgcagtgagccaagatcgtgccactgcactccagcctgggcgacagagcgagactccctctcaaaaacaaaaaaaaaaaaaaaaagaaaagaaaccccgtctctactaaaaatacaaaaaatttagctgggcgcagtggcggatacctgtagtcccagctactggggatgctgaggcaggagaatggcgtgaacccgggaggtggagcttgcagtgagccgagatcgcgccactgcactccagcctgggcgacagagcgagactctgtctcaaaaaaaaaaaagaaaaaaaagaaaaaaagaaaagcttgagtgagatgaaattaaaataattttctcattttgagacagggtctcgctctgtcacccagactggagtgcagtgtcacaatctcgcctcactgcaacctccacctcccgggttcaagcagttctctgcctcagcctcccgagtagctgggattacaggtgcctgccaccatgcccggctaattttttgtatttttagtagacacagggtttcaccatcttggccaggttggccttgaactcctgacctcgtgatccacctgcctcggcctcccaaggtgttgggattagaggcgtgagcgcttttcttaaaagagttccagggttctatgttggaagagcgagtttgtcagtttttattggaacaaagaaatgaattgacagcattgtgataaacactggaagtgtcacttctaaaatttgtccatggctgaaagtggtggctcatgcctgtaatcccagcacgttgggaagccaaggtgggtggagcacctgaggtcaagagtttgagaccagcctggccaacatggtgaaacctggtctctactaaaaatacaaaaaattagctgggcgtggtggtgtgtgcctgtagtcccagctacttgggaggctaaggcaggagaatcgcttgaacccaggaggcagaggttgcagtgagctgagatctcaccattgcactccagcctgggcaacagagcaagactccgtctcaaaaacgcttgtccttaaggggtggcttcccccagacctacaaagtagcccagaattggaggtcttagtgtcagcaacagtgctgattttgataatgcaagtctgtacattcaaaccagtctcccagaactaggtggaagataggaacatttctgcataggagacttggaatgttctggcagcattaaaaccctgaggcccggctatgttctgggagagccctttgtctggcaggcatcatttacagacgggtccttttcctgtatgctgtggcttcaactaggctgtgtctgagaactcggatggagcacttgaaagtgcccgtggctcccgcctgcctttgcggtaagggacagtgcagaacatctccggctgtgccagctgttgtagattctggtgggtgctgccatgggaggaggagcacgttgttgccccccctcaggatctccctgacctctgtcttcaccatcgttgaacttaacgcctgcttttgaccaggtagcgtggagtgtttcagtggcatttgtcatcgaagatatgttagaatctattgtatgcttttggatctctccggagggttaagacaaaattctaataaagaatcgataagaggttatattgatttttgttgtcctcagtctgtactaaactcaaaccaagttctcatgcattactaggttggagaaacgtacggtaaggatataacctcccggggcaaagacaagccgattgccgtatgtaaaactttcagtccacttcagtttcaagctttctctgttctctcatttcacttcgttttcctaggattttttattaagcctcaagctccttgagtgttttatatttaattcactcaaggttggggttttgcttgatgaaataaacttcattagagtgtgatagtttacccaccggcttgaattaaagcagtttgtgaactgtgatcttctcctcccaagtgaaaggaggggacagtgagagggcccctctcctggctggttggagatgcagatatggagactcctcccggaagcccacctggctgtgagccgagccggagcaggactaaccttgttgccggggccttctttctccgcttgggtgtcccgtgtggtggggctgtctgggcgtggctgtgcagtgctgctgagctaaccccaccgtgcttgagatggtgtgctgggtgccgcggtgattcttggacgagcttgtgcatgcgccagcattcttcaaatgccagttataaaaagctgttgtgtgggatgtttctttccctttcaggtacaaggtatcagctggagggttgaaagtgtagcttgggaattgtgtgcatttcataaagtagcataattgcctttttccaggagaatattttagaaatctagcattttagaattcttgggcatttttaaatacaggtgaatatttgaatttggtttgacacaaaatacagaatggatgaagcatgcagatgtttggcgtgtgccccgaagcaccctctactctgtcctctgcacccaccctttgcgcctctgcgtcagccacagctgccccgggagcgagttctcctgaggccctggctgtgctgactctagggcagcgtgagggtggttgtcagctgtgaaggtgccacttacacactaagtcctccttccttgtggagggaagggctcaagtagcaaatattggagcccccgcttggtgctgggagctgtgacaggcagctcctgaagaagcagtttaattggaaccagtgaccatctaaaactgtttgtactctaaaccagattttacagaaatattggaatcatacctttatacttgattttttctttttagatagttaggcgtaaaggaagcctcctgagggtctggtctgatcctcctgatccttgaagagcttccagcatcattctcccttcatgctccccattttcataagtaactggtggcttgacatgctgggtttggtttgggagccctctgacaaactgaaagggtggatcaggaagcgtctgaccacaccactggtagacacgctctgcgtccaacaagtccttcccagcaacatgtagaaagcaaagtgcatgcttcattctaaggttgttgtctaaatgtttccctgtgtttcctttttgtaggatgtgttcttaatttgcttttcccttgtgagtcctgcatcatttgaaaatgtccgtgcaaaggtaggtggggatttaaaatgtgtatgtaagttatagaatgatcctctcagaaataaatactttaaaatatcacttagcctaggaatttttagttatttaaattggttttagcaatttgctacttaagtacatgattgggtttttttttttcttttgagacggaggtctcactctgttgtgtccaggctggagttgtagtggtgacatcagagctcactgtagccttgaactcctgggctcaaacagttctcctgccccagcctcctgagttgctgggaccataaatgtgcaccaccatgcgtggctaatcttaaaagaatttttgtatggctggttttgtagaccctggcttgtctcaaactcctgggttgaagtgatctttcagcttcagcctcccaaagtggtgggattatagctgtgagccactgcatctggcccatcagcagtttattttatttatttatttttgagagagtctttttttttgtttttgtttttgtttttgagatggagtttcactcttgttgcccaggctggagtgcagtgacgcaatcttggctcactgcaacttccgcctcctgggttcaagtgattctcatgcctcagcctcccgagtaactgggattacaggcatgcaccaccacgcccggctaattttgtatttttagtagaaatgtggtttctccacgtcagtcaggctggtctcgaactcccgacctcaggtgatccgcgcgtctcggcctcccaaagtgctgggattacaggcgtgggccaccgtgcccggctgagacagaatcttgcactgtcatccaagctggagtgcagtggcacaatcttgggtcactgcaacctccccctcccggttcaagcaattctcctgcctcagcctccttagtagctgggattacaggtgcccgccaacacacctggctaatttttgtacttttagtagagacggggtttcaccatgtttgccaggctggtctcgaacccctggcctcaagtgatccacccgccgcagactcccagagtgctgggatttcaggtgtgagccactatgcccggcctaatacgtggatttttaaagcttcaggttctggttcagaagtttcctgggtctcattaaaataatgaggcactcagaattggtctaataaaaataacgaccatttctttctactccagtctctttcacaaacttcttagtgaaaatgacaagtgaggcccttcagtaggggcattttcagtggagataatagcggcagacctgagaccttgggctaggtagtttattctcatttctgaacagatgatgaattttctcagatgaccctaagaaattgttttaccaaaaacaaagtgatctatttgctttgggaggaactcccttccttttgtttctcttcccttccccccttcccctgcggttgtagagcccgttctgtccggtcgtggttctgtccagccatgatccgggagtcctagcttgctaatggaacacctgagatgttccttatggctcaaggcttgaattgaaggtgggaaccacctgaagcctccgtggggaggccttgcctgaggttaggtgtctggcatgagtgccgccggctgggtgtgatttaggtgaaggacatctgtaaaggagcgtgtcacaacctctgttccttcttcacatctagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtatggaatcctgtgtttttcctcctccttgtacctcttttattgtagtgacagagactggagtccagtctgggaaaggagggtgtgtgtctcccactcagggcctggtgtactcttggggaaccagctggcaaggccctctgggtcttaacgtcagcgttggaaggtggaagcagggctgggagccggcagaaggcgcccgggccccaggagctgcctcccgctggtggtgtgatcagaagagagtggggtcgagtgtacattgccgtgtggtcgtgtttcctgtaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaatactggtgtttttgagacttgatgaacaagttcctggtgtgtgtttgtttgccttgctttaaagtcctgggttgttggagacagtcattttcaatgcgtgtctccacacaggagggacagggagtgccacctccaggggagaactgggtgagcccaaatacggcaggagtggaggtgacattcatgtttggacctgtcgaacagtggcgaagctctgagggagaagcgcctatcggggtgtgtgtgcacatcctggcccagagctaggggctgaagatggagatgttgggaccctagactggccctggaagagtagaggttggtgaaccacatgcccttaagatcctttccagaggctgagtgcgtggcttacgcctctaagcccgacgctttgggaggctgacacaggaggagcgcttaagcccaggagttctagaccagcctggacaagaaagagacctacccaaaaaaaaaatgcaagagcctgaacttgtactacataaaggttcatgttagaattcgttttcttaatattcctttttattgctttgaagattgtttttgagtttttgttttttttttaagatggagttttgctcttgttgcccaggctgggagtgcaatggtgtgatctcggctcactgcaatctctgcctctcgggttcaagcgattctcctgcctcagactcccgagtagctgggattacaggtgcctccccccacgcctggctaattttttgtattttttcaccatagtttcaccatggccaggctggtcttgaactcccaaccttaggtgatctgctcggcctcccagagtgctgggattaaaagcgtgagccaccgcctccagctgagtattttttttttaaacagatataaataatgcagattttgttttttgagataagatctggctctgtctcacaggctggagtgcagtggcgtgatcttggctcgctgcaacctatgcctcctgcactcaagccatcctcccacttcagcctctggagtagctgggaccacaggtgcgcaccaccacacccagctaattttgtgtgtattttttgtagggttttgccatgttggccaggctggtcttgaactcctgagctcaagcaatccaccagcctcgacctcccaaagtgctgggactccaggtgtgagccaccatacctgtcaatatgcagtttttaaaagtaaaagttttagtggtttctaaagaaaaacacttcccccttcgtagcctctccagaaggaatactttgtttgcttacctgatttttggtattttacctgctgtgtctaaattaggctttttgttccagtgtaacttctgagttcagccattctcatcgacattcccagcatggacgatgagaggcttgctttcccgcttgtagccctctccacccaaaacctttctcatcccctcaatctgatggttttggtggactcagtttagtgccggcatgatcactactacataaactactcactggccttgccatgtagcaacaaaactgtgtttcctgcagaacttctggttttctttgggataattagtactttgcttactttcctatgtactgaattcaattgtgaactttttttttttttttttttaaggaagggtcttgctctgtcacccaggttggagtgcagtggtgccatcacagctcctaggctcaagtgatcctcctgccctagcctcctgagtagctgggaccacaggtgtgtgcaaccatgcccggctaatttttaaaatgtttagtagagttggggggggggggtctccctgtgttgcctaggctggtcttgaactcctggcctgaagccaccattccacctcagcctcccaaagtgctgggattacaggtataagccactgtgcgcggcctcagctgtgaactttcatctattgtctaaacctctcaagatattcagatgtgttgttattttgccaatacccattttcctggagtcatctg

SEQ ID NO: 17035 - DNA, 33536 bp, Human; identical to SEQ ID NO: 17034

SEQ ID NO: 17036 - DNA, 51101 bp, Human; identical to SEQ ID NO: 12859
  misc_feature (1)...(51101): n = A,T,C or G

SEQ ID NO: 17037 - DNA, 260286 bp, Human
gaggacagtatttcctacttttatgtagttgggagcagtaaatggaaatgtttgtggaaagctcctcataaaatttcaaggccttttgtagatatagtgttttaaaggcccagagtctggagaaaagaagagataggtacaaataatgaaaagggagactagatgcaacttcttccttattccatgcctttattttcaaaatactataaatgttgaatattatagtatttgtggtttctgaaattttgagataattttaagaagaggaataattaataactgttccttccttggctcaaataatatttaggaaatactagtaggtgtggaagagcaacacaataaatgtttttatttaatttccctgagcataacagagagcagatggggaattctgggcctgcccttttttactgttagccaaggagagcagaaaaaataaattgttttccagacatggagccagttttgtgttctcgttgctgatgtactgtgaaaggatttgaagggtgtgcatgcacttgtcacattcatgtggcttagatttgtagtggaaaatgttattctagattgtcaaaattgtgagaagccatgctaacctggtctgtgtaaaaatgtcattattattgttattattactattttcagtgattcgttcaaagagttaagacttaaaattctgataataagtatttctgaaaatgagacaaagacaaaatgctaataaaatttttggcttataatttgtttcagccaaatgcttgaacttgttttattgtgtttttgcttaacgatgtcagcttttcattaaaaggactcagtgtggttgcttgccttgtctccattttccttggtctgagagcaaatactcaggctcagtaagtccatgcatatgataggtttgaaaatgcaggatggaggaggatgatgaaactagggagagaaagaagaaatcggaaaagagagccaaaaataaccaacaagcttaagctttcctagaacatggtctaacaggttagctttgttggtaagatcagtgtgcctcaaagttaaggagtatatgaatgccctggggcttggataaaaatgtaatttctgatttgttaagtccagggtagggcttggcaatgtgcatttccttccacctcccaggcgatgatgatgctgctggccttagaaccactcttggagtgcaacaagggtcaaaagttgggttggacctcttggtgggggcatatttaaaaaatctcaataaagataacttctcaaaagtatagctaaacatgatttaattttataccaacttatacactaaaatatattctaaaattcaaaatcattgaccaaaaataaaagcatttgtttggccatgtcaccctgattgttttcattcgttgctttcttaggtcaggtctcttgataaatactctgtgaacaagttaaggagtcttcgtcttccagatagcatcctaacccaggctgtcatctggttaacatgtaaaatgtccaggtggtacctgtatcatcatggatagggctctggagaagcagacagaccacctggcttctatttccagctttgccaccaagctctgggactttgaactccacacgtataaaatggaaagcatctagtgtattgcccataataggggtttaggaaatgtgtaaggagaccctcttaagagtatatctaagtagtttcatgtcttccatgctttgagtggaacaggtcagagaggagaggtgttgaggataaaaacatgtcccgtaacttttaaggactttactgagatgccccatcctttcttcttgtgattttagttgttcaaactttcttctactgcatatctaatcttttgttttatttcattaaatgctagttgcaacctgctcagagcacttacctttggttttcttttatctgctcttatagagatgaggaaatagatcaaagcatagcattgttgaacatttctcttgttacccttcctttgcagattattcttctgctgttcagaaattttcccagacgctgcagtcatttcagtttgatttcattggagacactctgactgatgatgaaattaacatcggtaagtcttcagctacatgtggtcatatacctgttgaggcagccctgagaccatgtagtctttttgatttgtggatacagagcacttggacatcttcatccactgtggtccaatgccaaggccctgggaggttgattaggaaggatcaggaaactttccctgccagtcccatttcctcctcacacgacagcaatcaaaagatacccttaaacttctactgagatttttgactcagacagtctgcaagcgaccttttctttaaagcatagttattttcctaaaggatatattaaaagggggacttttttggtttatttcccaaaatggttggagttagattcttctaaggaatcaaatttccctagaaagtgttaaattagcatttgtgtgtctacaacttatcaggaacaggttgcttagcatctctcttgggaattggatttaacaactcactctattagttgtataatcttggagaagatatttctgtctctgagtctcatcttgtcctctgttaaaatggggttaatatctatcaaagatgttaaaaagaggaggttgaatagtagaagtcaaaagaagtttgcgtttgtattatttgttatgaaggtaaagaggagaggttaacaaacccctgggcctattccagctcaccacctgcttttgtaaataaagttttattggaacatacccatactcatttatttaagcgttttctatgggtatttttgtggcacaagaatagcactgagtagttagtgaccaccactggatggtcctcaaagcctaaaatcgttatcttctggccatttaagaaaaagtttgctgattcctgagttaaagggttagtgtagagcatttgctagatgagaacactgaaccaaagagctattatgaatgatctattgttactggaacaagttagtaacacagttatatttattagccctggaactaaaatgtgaaaatgtattattattaataaatgcctattatagtcaattttaataatatataaaagtataagttacttatgataggaagatattcctgcacagaaatagtatcttggacatacttttatattatcctttaagtctttttctctacatatatctgttttctttgtatgcaatgtagttcatattaaatatataatattatctttctaaccaaatattttattataagcattttcccatgtaatttaagatttttcacaagttttatgggtggtttgtatggccttgttttgttcactactgttttcccagcacataaaggagtgcctggcatacagtagatgttcaatgaaatgttggtaaatgaatgagtaatggatacattcaaatttcattattatgagagctatacttcatttaatatttagctattcttggaaatatagcttatttccatttttcactattataagtaatatttcaatgaacattttttagatttagattggtgaccattttggttaaatgtgactgtgtaactagtgagtcagatatttgtatttgtattattttcttattcactccattttattttacttcagtaaatctatccaggtccaagtgcatgactatttaaaagttaacattatgggctctggaatcaagtaacccaagtttgaactctacctctacatcttaatagctctgtaaccttggcaagtaacttcacctctctaagtgttaaattttcttatcttgtaaaatggggatgagataatgccaagtgtgcatagtgtctaaatgaatgttaggtatttcaacattattattaatataagatatttttgtacttctttttaaaaataactgctacttgcctatcagttggaagattgggagatacatggtacatgaaattatataaatggctcctttttctggtataagggtctgattttgaacaggtgcctattgataccaaagccaccaacagatctgagacttttctcatgtcttcctttatgttgaactttgagccttaattctcttaatcccatgaacctcactgcaaatgtcaatgagtgctatgcaggaaaaagggtgtgtgagcctgggcaaaatgacttataaacaaaagaaaaatgactccttggtgatgccaggttcctgtgggggtctgtggggctccatcagagctgctgattatgacatctttgctgcttttttaaaaaaagaaagaaagacagggtcttgctctgtttacccagactggtcttgaactcctgggctcaagctatcctcccaccaccttggtctcccaaagctctgtgattacaggcatcagctaccacacccagtcttttgcttcttttttttttttttttttttttaagatggagtcttgctctgttccccaggctggagatcagtgggctcactgcaacctctgcctcccgggttcaagtgattctcctgcctgagcctcccgagtagctgggattacaggcacccgccatgatgcctggctaatttttgtatttttaatagatacacggtttcaccacgttggccaggctggtctcgaacacctgacctcaagtgatccaacccatcttggcctcccaaagtgttgagattacaggcatgagccatagtgcccggcctttttgcttcttaatgtatgatttataataactctttaactcagtgatcatttgcctgccaatttcagaagctcctacttatcatttgaacactgcttttaaggatgctgacttaatgaactgactttcattattgaggaccaaagagaggttttgaaaattcattggcctgtcatggtcattgtccttgttgaatctcattttgaaagctgggaattgtggtggtagtgagaggaagagccagtactccaacagctgaggctgaggctctctggaggcttcgagaaaaaaatactggggaccctactgggaggctattgttgggaaagagcagttgctttggaagctgagaacgcagagtgtgccatgccctcctattgccaatactgctggccctgagtcaatacatcttgtttcactggaaaaaaaaattgcttaaagcacactttggatggaattgtgatacccttttggatttcacattatatgtgcagagggccttctcattaaaaatttttcattattggctccaaaaggtcactcagtagcattgtaggtactcgttatttagcagaaatgacagtgcttcctagagctcatggagaaagcctgaggattctgaagagttcctccccctgacgatcagctctaggacttaccctgaatagtttatgtctaacagggacaagtgggaggccatgtgtcattgatctgaccgtgacttttttcactgctttagagttagacatctatgccttcttggcattgccttgtctttacctctatgtctctgtaaccaaaggaaatcccaggtgtctaagaagtcttgtgtctgcttagatttgagttttatatgttagctatgggatcttggtaacattaattgagcttgttgagcatctgttttccacatcagtatagtgggggagtataatccacctcacaaggtcatgaggagcaaatcagataatacttatatcagagagtgtctgtaaatcatttagctcagtgtctggcatatagttggtgctcaataattcattgttattgattctactaggaacactatagaaggtaatttgtggaaaacagtgttggtttgaaattatatttcccaaattaaccaaaggaaaatataggattgtaaaatgtccatgttggcagggaccttaaatagtatttagttcattatttctcgtataacttcatatccgagtcacctgaggatctcgtttatcctgtcacaggacctaccttatacctaaagaatcagaatttctatagcggagcccagggccttgatttttacatagtctttataacatcagcgagcattttgtaaccccaggacagatctcaagcttttccaaactgtgctccttggatcctcagtgtctcccgtctttcatgatcaaatgaaacagcggtttatattgggctttcatgtaagaatttgcttgaaaaatgggatttgtagattaaacgagagaaacagacacttttagagtgctcccaaatagcagatgtcattgtaagcactttatatagactaatgagagaaagagagacagaatagtagcaagtttatccctcaattcaacagatggagaaactgagatccagaggtagggatgtgattgtggaaggtaccacacagctacatagtaccagatttactattagagcctgaatctcctaaggcccaattgattcattcaataacattttattgagcatctgctataaagcttgtcctcatggacttcccaatcatacaagttttggcataggcaaatgacttgcaatgtcaccatagcaccatgagctagaaagaggcctgtttgccacataggcttaagagaatatgcttactttttttttttttttttttttttttttttgtgatagagtctcactcttgtcacccaggctggagtgcagtggcgtgatctcgactcactgcaacctccgcctcccgggttcaagagattctcctgcctcggcctcccgagtagctgggattacaggcatgcgtaaatacatgcccggctattttttgtagttttagtagagactgggtttcaccatgttggcccggctggtcttgaactcctgacctcaggtaatccgcctaccctggcctcccaaagtgctgggattacaggcgtgaaccactgcacccggccaggttactcttttctcaggatcccttatatgtatttttgttcattagtaaataggtagcgtgtccactaaatgacataaacaagggattcagagacatagaacacatcttcctgccttcaaggagctcatagtctattaaaggaggtggataactaaataggcaatggtaacacaatgtgataaggactatggtagaggtaagcacatggtagcccctaattcagactggtgtgtatatgtattgggggacgggatgatgcggagaataaacatggaagccttctcagagaagtgatatctgagtcagttccagggttaaggtgaaacaaggcaggtggctagggctcagatttaaggaggcacttactctcagggttgtgcaagtacaggctggcacttgagagtgaatatacctccttaaagtttacagcctgggtacctgggaattatttggtgaggatcttcagagggcctcgtattttaacttcaaatttcaatcttgtcatcagcagagcatggcatccattaggtgaaccctgatagcatagttcttttattctgtgcatctaccttgctacatcttttccagaaaatgtcacccatggggttttagtgggttgtttgtttatgcctgggggaataaaagtcatgttctaaatctcagactgtaaatcacatttccaccccagttatgctaacatatttaaagaaacacctttgtggaccaagaagattgatttaaggtcagacttctagatggaaagttccatcagccacccattactggtttctgagacatgagggtttaacattgtcagtcccctgatcctgatttttgtttaatgtgaatattattcattgctaaacaactcacagcagatcataaacctcttggttgagataaagaagggactaagaaatagtctcttgagggcttttgttggtatttttttctacaaaaccagttgaagtatcttttgagaagtggtggcaaatgtcagttgttttagagtcctggaggtcaggcatcttaaaagaggaatggctaaaatgaaaaaagaagcactaatgtaaaagattgtatttaagtaaagagccaggagttgaattctgaaggttcagtgattttcatgagattggtggggggaaaatcttttggttatacatcttgaagctcttaagctcatatgtcagttggtgacattgttcacaatattgattatctttcatataggggcatgcatgaaccaaatattttgccagactttcttagcacaggcaatagcttttctggggaaagttctagcccaatgcaccttctgctgtggtgataagcccttagaggtttatatcaagttattgggcttgagtgcatagggcttcttctcagatcctgaggaaaagagaaaatacaaggtaatcagaagtctctattgggatctgggccgtcaggttttagttctccatgactcgaagtcatatgagaaggtgataattgggctgggtacggtgcctcatgcctgtaatctcagcactttggaaggcaaatgtgagtgactcacttgagcctaggagctgattctaaatgctttcagggaagcatcagattaaaacataaaaacctatgtgtagatgagaaaggacttaaaatggcagtggccaacttattactgatcattttcaaaagtggaagacttgatgaaattttattaccagaagaataatgcaactgaaaaatacatgggatttatgtggcatataaaacaaaagaaatatcaatccataaaaagattttacaaaaaatctataatcataataacactattttcaaggaagagtgaatattatatttataaaaattggtaaacaacctttatgaagaaaaaagtcttcagacataacataataattctgacataatataccatgaacatagcaagcttatagttagaatataccaagaatatatcaataatatcaagtaaagctgggctcagcgatgcatacctgtaatcccaggtactcaggaggctgaggtgggaggattgattgaacaacccccagccacccaaaagaatatcaagtaaagagattgagaaatcttaataaaacatactgtggaaagcaagaacattgatcgttctctaagaacttcctgtatagcattcaatttctgaaatatgtacattggtaacgtttagcccatttaagctagggaagtctgaacatctcttttgatttcatggtgcttcctgtgcaactcagacgataaaacaaaaagcaccaaaactatgcactggacaattaaggaagttattgccatagggagaacctttattaatgaggaacatctcaaagaaatggaagaaaattggggtattgtagaggcaggtaaacaagggagtcacctgcaagtcttatgggaggcatgaagaagaatggagattgatgctatatatgaggtgcaaagtctatatatagactttgcagtctaaccatttttcagaacacagaaggatgtgggatgtcttaacactggctgctttcttggagccctggtctcagttccacactcagtggtccgggattcacaaagcagggcacaacccagtgtcctttcaaagctcccaggccctctgaggttccactggggaatttgagtgaagaagatggcactcatgcagagtgaggagactgctgaacatgagccccctattctcataggctttttgtacctttttgcccatttcccttctgactgatctggagactgactgctggttaagtgccagccagggtcaagtaagtggtacaaaatgatcccaagacgttcctatttgttgagagatctagcaaagtgaatgtcattttctcaggagcatcatttggcaggcccaggcttcaggcctgtctgccatttactctttctccctcattaaggtctcttggactccagtaatctttcactctgagctctcttctctatcctgttcctgccaccatattgtatccatagcaatgacccttatatcttggctcacttttcttcatggggatatggtaggatttagaaacatggtcttggatttggctggacctgagttcagactctgacctgtttatttactgactacatgatcttaggcagttttcattaaaaaaagtaataattgagtttattggtatctttgcattataatataaacatgctttattataaaaatatggaaatgaacaaaaagattattattagcttccgtatactgagtacctactgtgtgcctactgctttgtgtacactatctaattctcagagcaattttaaggaggtgaatgaggctaatggaggttaagaaacttgcccaggatcacatagctaataagtagcttaagtgggattttttttttttttaatcagggtttggctctgtcacctaggctggagtgcagtggcaggactgtggctcactgcagccttgacctcccaggctcatttgattttcccatctcagcctcctgagcagccagaaagcacacctcacctggctaatttttgtcgcttttttttccctttctttcttttttttttgagatggagtcttgctctgtcacccaggctggagtgcagaggcacgatctcagttcactgcaacctctacctcccaggttcaagcaattctcctgcctcagcctcctgggtaggtgggattacaggtgctcaccaccacccctggctaatttttgtatttttggtagagatggggtttcaccatgttggccaggcttgtctcaaactcctgatctcaagtgatccacctgcctcggcctcccaaagtgttgggattgcaggtgtgagccacagcacctggccctaatttttgtagcttttttcgtagagttgaatttcatcatgttgcccagactggtcgtgaactcctgagctcaagcgatctgcctacctcggctttccaaagtgaagggattataggcatgagccaccatgcccagctttaagtaggtctttaaatcatttcatttttgactttaaaatttatacatatatgcactccataaccgtgttaatgtcatagtaaataatcaataaatagttaagcctgagagctagatttaattaaaaaaaaaagaatcaattattttgatgtatttttttcttggcttttttgggggtcgaaacaattttctgcatatagctgtacttgtgtacaattgttgcatacagatttttatattctgtttttaaatagtgtgacactctagctattttgtcatgtacagaaaattttgtgtaatttcctttttaatagcttcaataatagtccattaagtggacatacttaataatttcccaatcattggacattttatgtgttttcaattattcatcatcagcaataatgttgaatgcctacctttggatataaaggtttatccctctgtattcagaattagttctttttgtttgtttgtttgttttttgtagagatggggggtctcacttttgtagagatggctcactgttgccatcaggcatttgagcaatcctcctgccttggcctcccaaagtgttgagattacaggtattttccaccatgaccatgccatgattaggttttaggtatggtttcccagatacgaatttacaatgtaaaagggtatagataattttaagctgtttgatccacatttgtcaatttttacaattgtttggaagacagtgcataacactgtaatttatatgaccttgctaaattaaacctcagttttctcatcactgaaattgtaatgatgaataataaaacacttgagaaacatctaccatattgcttttcccatctcacttttccgaattttttgtaatttctttgaaattttccaaggataatgttctcttgctgtggtctttttttaaaaagaaaattcttggattggtaaacattattgaggaattttgcagtaagttttataagccctgctttgtggtggtgttgcggcaggggatgttgctattattgatgatggtgttgttgtttgttatggttatgcagggctgttttcttccatttcttagccaattttcttagtcctcagtcctagtatctgaagagagggcaaaaggactctaatgactttggctccttaatgactattctctcccacactctgtaatggacagtctgatctcctcactaaagcttttattgccttcccattaattctacagagccgtctgcagggttagtttttagaagatgctgtaattaattatccatgatatttggttaaaaatagatccgtaagaggctttataggacctcaagattctgagtcagaaataacccttgtccaaaccttccgcttttgcctttttcttttgtcttttttttctttttctttttctttttgagatgaagtttcactcttgtcccccaggctggagtgcagtggcacgatcttggctcactgcaacctctgcctcctgggttcaagcaattctcctgcctcagccttccgagtagctgggattacaggtgtctgcttccacgctcggctaatttttgtatttttagtagagacgggggtctcacgatgttggccaggctggtcttgaacgtctgacctcaggtgatccatcctccttggcctcccaaagtgctgggattacaggtgtgagccactgtgcctggttctgcttttgcccttttcttgatttgctatagatatgaccaagggagagtgaatatgaggatatttggagaagaaaacaccatttgtggggccagttggagggacagtgaaaacaatgtgacatagtgctttcactatgactggggactgtagatagaacattgaaatggggtcctcttttgactgttcagctagctgtgtgaccttgaacaagtcagttccaatctctgggcctcagttttctcaggaataaaatgacatagttggactaagatagatgatctgtaaaagtcttaacctttttagaaagcaagtgattacaatcttagaatcaagaggctatcttgactttgctacatgcttcttgccctgtgccacatacttctctaggcatttgcagtcttccgatcaagcaataaatgtactcatagggctttttcaggccacatattcagcaatgaggtttttcttgactcagcaacttaattttaaagtgatttaacaattactgaagctgtatgttaattgaaagtaaggatcaagaagctctgaccaggttaccacggtgggaatagttgaaaaatgacctccaaaaattcgatctttcataaaagcagcaaaaacactggcagaaatttccaaaatcaacttttttaaaactccaaaaacgaaccaaaattttgcaacaaaacagtgcatgtttattaaataaaaatggctgaatagttgagaaaacactgagctctatgacattttaatttgccatgttcctattcctttctgcagttccatagtagctttgaaaactaacgtctgtataatcatgcaatgtgtgcaaaccaccattctagcagccatgggtgagggtagaatgggtgtgaagttactcaaaatttgagaaatatcactcacagggcttatgttatttgagttgactcagagtttactctttaaatggttgttgttgttgttttactagcgcattttctttcttttgtgcattttttttttttttttgagacagaactcctgacctcaagcaatcctcctgccttggcctcacaagcaatcctcctgccttggcctctgagattaaaggcatgagtcactgcaacccacttgtgattgttttttttttttttttaatttcttttcttttccttccttccttcttcctttctttcttcttttccccttcccttcccttctcttctcttttcttttctcccttcccttcccttccctccttccttctttcctttcttcccttccccttctcctccctccctcccttttctttctttctttctttctttctttctttccttctttcttccttccttccttcctttctctctctctttcttttttttcttcctttctttttctttctccttccttccttccttcctttcttcctttcttaatttcttttccttccttcctgccttccttccttctttctctctctctctttctctctctctcatccaggctgtagtgcagtagtggcatcttggcttactgaagcctctgcctcccgatttcaagcaatattcctgcctcagcctcctgagtagctggaattacaggcacctgccaccatgcccagctaatttttgtatttttagtagagacaagtttctccacgttggccaggctggtctcaaacttctggtctcaagcagtccacctgcctgagcctcccagagtactaggattacaggtgtgagccaccacacctgcccctagggcattttctaaaaccattcagtggcagttgtttagtactacagtttccacagacaacaaaaagaataaagtagcaaataagaagctgaacaataaaccaaacaggacaaaatggagaatgaattatccttggagagctttgaagagctgtgagatattcctggaaatctaggagtcatgcacatgagaggggctttgtacatacccagcgtttgtatctgtctagaagatacaaacaaggagattagacttgagacatctaatctcccacttctggctgaccttcagctctttgcaaggaggagtgaaggctaaggcacagttgtaaactgtctggctgaatgttgaaggcacaccccacaatacacagagagcccttcagcaaaggcttggagatatttgttcaaaccatttaaagaaatctctgtccaatcacttgttgaccagtaagcttactgaccagagactttagtggtttcatatgacaaagaatgcagactatagaatgagtccatgaagccaatgtaacaacaagcaaccacaagaacaacaagctctggggaaagagaggagttctgatttccaaagttgccacactatttagaatgttaacttttaaaaaattatgagacatgcaaagaaatagtaaaatatgacccttgaacaagggaaaaaaagcaattaatagaacctgcccccgaggaagcccttacattagattttctagacaaagagtttcaattacctatttaaatatatttaaattaataaatgagaccatgtctaaagaacttaagaaatgaatgagaacagtgtctcacaaaatagacaatatcaataaagagatagattttttttaaaggaatcaactgaaacttgcagttggaagttgcagtataataactgaaatgaaaaacttactactgggggttcagcaccatattgtactgggaaaataaatgaccagcaaatttaaagacaagtgaattgagatcattcaatctgagggaaataaagaataatgattgagaaaaatgaacagaacctcagatacctgtgggatatcatcaagcataagagcatatacagaatgagaacctcagaagaagagagtgagacaggaaagaaagaatatttgaagaaataatggccaagaaattggcaaatttggtgaaaaacatgaatctgcacatccaagaagttaaatttagagatacatgcctaaccatatgagtctaatgaaagaaaataacagagataatcttgtaaaaaataagagaaaaatgaaagaagagaaatgaatgaaaacagtcacaacatactaaatcttatgggatgctgctaaaacagtgtttggaaggaaatttgtagcttcaaattcctatgttaaaaaagaacaaagatatcaaatcaataaccaaactttccaacttaagacacttgaaaaacaagagcaaactaaagaaacaaaagtaaagaaataataaagactaaagaggaaataaatgaaatggagaacagaaaaagaatataataataaggcagccttgtcaaaataacaagacagtcattgaaaccaaacatctgttcttcataaagttaaacaaaattgacaaacccttagctagactgaccgtgagactacttgaattactaaaatcaggaatgaaataggggacattactactaatcctagagaaataaaactgattataatgaaatactaaatatagttgaccctcaaacaatatgggttcaaaacgcagaggtccagttacaggcagactttttctctttgatttggatagaaaaatacagtatttgtgggatgtgaaattcacacacatggagggccaacttttcatatgtacgtacattcacataaaacttgttcacaaatgttcatggttgcataaaccagattcagaggtcacatgtgtttccatttatgagaaatgtctagagtaggcaagttcatggaaatagaaaatagattagtggttatctgggtgttgggaggaagtggtaatggggtgtaatgctaatggggtttgggtttcttttgggggtgatgaaaatgttctgcaactgtacagtggtgatagttgcacaactttgtgaatatactaaaagcccgaattgtacactttaaaatggtgcattttattatgtctcagtccatttgtgtcaccataaaggaatacccaatgctaggtgatttatgaagaagagaggtttatttggctcatggttctgcaggctgtataggaagcatggcatcagcatctgcttctggtgagcacctcaggaagcttccagtggtggcagaagaagaaagggagtcagtgtgtcacacctcacctccaacattggggatcaaatttcaacatgagattttgaggagatagatacccaaactatattatatggtgatatcaattcagtgataataataagcacctaataaagatattgtcacaattaaaccctcaagcagaaggcttggcacatttaatgtccatgaaatttagtcttttcctttaaatgtttgaatatgatatttgtcacatttcctttagaggtaaactgatcgtgtctggaaaaatgccaattaaaatctctgactcttttcttagcataaagtatttggggacagaaggtcaataaacatttccattttttcctgtttactctttctgagtatggtgtttatcttttctatgctacggttgagctctgaatgaatttagtgttttcaaaggtgatctccctgggtatttgcagcaacttaatcctcagaagaagaaagaaatgtcattgccttgcatcctgtgttgactccaaaattcatttccttgacaccaggaatgctggacttgttcagttgttttaaggaggaaactcaatttttgattaaaaatattagtatagacaaatttgtttttccaggctttcattcagatgccagtcgagaatatacttcctgcttctggagagaagttgaggaatttgaataggcactaaagactatttagcttaacttacttttttttgtatataaagacattgaatttctgagaaaggaagtgatttgcccagtcatcctgccagtaagtggcacaattggcactagaagagtagaaagtttgggagggtggaaagggtaatgtttattatttactttgtgttgacactacattcaccatccaatttagtttttacagcaatagtctctggttggtcagtagtggaacagggatccaaactcgtttcagggttctatagctgccaattaattacacagcaaacctcttgccccttccctaatcttttagcttgtctatgaaataagagaaattctagctactcctgagtggctgtaaggattaaataaaatattaaagtgtatggggattgataaaagaggaaagaaaagaaaagaaacattcaacaggtgctgaacacctgcttttgtcctccgatttgacaccttcctctagtggccatgtgggcatagggcactggtccctacttcctgttgcacagatctctatccatttgtctgtcaagcaccatgattaatttgttttacatttgattctctccttccagctgaatccttcaaggaatttgctgaattgctcaacgaggtagaaaatgagaggatgatgatggtaagtcactaacgctgtcactgaagctgagttcatgggtgatataggggatttttcctttcctttatgcttggattgatcctatactattttgatttctgtcagatagcttcttggtgctataaaaatagttaggtaatagatctggttattatgtctcaagcttccaccctgagagtttggcattagatagagggaaattaacgtgcaaatcccatctgtgttcatttcagtgaaaaataatttcagtggatattaaactgggcctttgaacatgttgacagaaattgaggtctttagtgtttttagccaaattatccatttgttaatctttaatttgtggagtagttttacttttatagagaaaatcagtagaaaataaagatagaactcatataccacctttctctctcccattcagttttccctattattaaacatcatgtgaatgtgatacatttgttataattgatgagccaatattgaaacaatattattaactaaagttcatagtttacattagaatttactcttggtattatacattttatagatttgacaaatatataatgacatgtatccaccattacagtgtcaccatacagaatagattcatggccgtgaacatttcttttgtccaatctattcatccttctcttccttctccagtcctgaaaccctgacaaccactgatctttctttttattgtgttttgccttttccagaatgtttatagtagatatcaaacagtatgtagccatttcagattggcgtatttgacttagcaatatgcattttattttcctgtcatttatttttatcattaagtaatatcccattgtatgatttaccacagtttgtccactcacctactgagggacatcttggttattttggcaattataaggaaaactattataaacagttgtatgtaggtttttgtgttgatacaaatttccaactgatttggttaaataataaggagtgtaattgctggagtgtaaattgtcagggtatgtttaattttgtaagaaattgccaaccaacttccaaaatagctgtgccatttcgcataaccagcaatgaatcagagatcctgttgctccatgtcctcgccagctccatgttcttaccagcatttgctgttgtcagtgttctggattttagccattctcacggatgtgtagtggtatctcattactgttgtaatttgcaactccctaatcacatatcatgcagagcatctttccatatgcttaactgccatcggtatatcctttctggtgaggtatttgttcagttcttttgcctattattaaattgattttcttttgttaagttttaagagttctttgtatattttagattccagacctttatccaataggcatttgcaaagattttctcctcgtctgtggcttgtctttttattttcttaatagtctcttttgcattgcataggtttttaattttaatgaagtccaacttacacatttttgctttaatggatcatacttttggtgttatatctaaaaagtcttttccaaatccaaggtcacccagattttctcctatgttatatttttggaattttttagctttttgttttacatttaggtcaatgattcattttgaattaatttttatgaaggatataaggtctgtgtctagattcactgttttgcatgtggatatccagttgctccaacactgttttttgaaaatactattctttctccttgaattaccttttgtcctttatcaaagatcacttgactatatttatatgggtctgtatctgggctctctatttctgttgcattgatctatttatctattctttcacaaataccacactatcttcattactttagcatggtagtaattgcactgtagtaaaaagcattgaagtcaggtataagcttaagaatcagtttgttcatatccacaaaataacttgctgggattttgactgggattgcttttaagatcctagagatatctttttgattttgattaggatttgcttttaagctaccagggaaaaactgatatcttaaaaatattgacttttcctaattataaacgtgggttatctctccatttatttatatcttttttgatttttttcatcagagttttgtagtttccttatatagatattttatgtattttgctagatttctacttaagtgtttcatttttatgaagtctaattattttaacagcctaaaaataatctttttgtgtggtccttagaccggcagtaccatcatgaccagcaccagcagaaaattattggaaatactggtccttgtacccatcccagacttattggggacttaaatgttgaaatgtatgcgttgatcaatattcatttttattaggggcatgatggtaagatgggaattctgttttacttttctccatcagatgactttttgtgggcttctcagttttgttaaagctatttattccaacagccagaactaatttacctataaaatccctttcttttcaacagtgtggtactgacttctcaaaatactgctcatagaatctagactcctagagaagtaggaatgaaggcaggacttggaggtaggggaattagagaattaaggctctaattctggatctgtcactaacttgttgacttcagattaattacttcatttttctgggctcctttttcttatttgtagagtgaggaaaataatccccatctcttatggttgtttaaagtgctccaaataacatagtaaacatggacgtgttttataaggggaaaatactgattatgtaagcatggtttttagttatctttagttactcacaggattctgcttgtggaaatatgatttgggaattttcttagtttaaaatatttgcttttaaatgtactaagaagagaccaatatgtgtggtttccctggaccctcttagatggcccccttgctaatacacagtctactaaatgttcttctctgcccacagggtttgtggactgctgcctatgttgttttcaaaggcatttgcccccatttcattcagatagcactagaaagctcagctgtacttctctttagccctagttgtttctccatctcttttatttacccaataacaaagccctcacatattgaagtagtattcatcttttgagatgttgtttttctcacccttcctgctgatactttgccacatgactgactcattttcttctgtctttaattatgttgtgcccttttgtcccaacaacttttcaatcgtatattgagtgtttgctccctatttcccacttaattccaggaatgctgagatggttaggcttaatgagtgcctttcaccccatgccaggaattcattgcttgattataacttttccatttcctggctttgtagcaaaaggacccctctaccccagtctggataatttagtgggtcttatattgcattttatcctttgtaaaagaagagtccaaagtaagctttagaataacagtaagaaagttcacagcactcaagcatggaaattgcctgtgtctggtcatctccataaatgaatataaattggggaaggaattatgatggggagaagtgaggaagggcatccctgtgatgttctcaaaagtatactgttggggctgggtgcggtggctcacgcttttaatcctagctctttgggaggctgaggcaggcagatcgcttgaggccaggagttcaagagcagcctggtcaacatggtgaaatcccgtctctactaaaaatacaaaaattagctgggcgttatcgtgcatctctagtcccagctactcgggaggctgaggtgggaggatcacctgaacctgaggaggtcaaggctgcagtgagccatgatcatgccactgtactacagcctgggcgagtaaggccctgccaaaaaaaaaaaaaaaaaaaaaaaaaaaaaaaaaagagcgggggagggccttgaaaagtctgaattgcacacttcttatatgattatgaagcttgcctagattcctttctgactctgaaggggcctctgttggcaatgtgcaaggtctgtttttgaagacggccaaaagtgacctaaagaggcccccataatatttcagcctgtctttagtgctctttttttaaaaaaaaattttttttattttattttttgtgacggagtctccctctgttgcccaggctggagtgcagtggcgtgatttcggctcactgcagcctccgcctcctgggttcaagtgattctcctgcctcagcctcctgagtagctgggactacaggcacccaccaccatgcccagctaatttttgtatttttagtagagatggggttttgccatgttggccaggctagcctggaactcctggcctcagctgatccacccgccttggcctcccaaagtgctgggattacaggcgcaagccactgcgcctggcccagtgctctcttttgatatttcatttaccatcaaagattcctgagcagtcctgcaatactggactgaatatcatctctattctgctcaacaccttcagtgttactttggcctttattcaataggattctgatgatagaaactcactaatgagtttaggatgtcactcgttatggtgaagagtctacctgaggtagcaggtgggagtttttgtccccagtgagctcacacaatgaatgcagtgattagaaaagagattaaaggccaaatttacttcaaaggggagtcattgctagagttctaaggggtttaagaataaaatggagtgaaaaagaaaaaagaggaaatcctcaatgtgacttttttctacattcctaagtctctattctgaccagaaaatagtataataaccaatgagtgtcatagagaggaaaagattcagagtatctgtttgtgctgtaggagactgggagcagtgttgccaaagtgattaagggaaaatgatgtcctgcaattctagtaaagcatggactatttttcagactgaactggggtcaaacatgtaaaagtcagtggccttatggaccctgtgagagaagttgctgacacacttgcttatgcaggacaatcccctttggagcatgaaaagccagcaactctgccctcctgggggttcctgaatatgcaagggcccagctccatacagtgctttagaaagtagtatgtacacttcttattcaaaggaaaacttcctcaatgtttcacagttggccacttcttaggtattacatttatttatttatttatttgtttttgagactgagtcttactctgtcacccaggctggagagcagtggcacagtcttggctcactgcaacctccgcctcctgggttcaagtgattctcctgcctcagcctcccgagtagctgggattacaggcatgtgccacctcgcccggctagttttttgtatttgtagcagagacggggtttcaccattttgaccaggctggtctcgaacccctgaccttaggtgattcacctgcctcggcttcccaaagtgctaggattacaggtgtgagccactgcacctggcctgtattacatttttttaaactgcaaattgtctttctaattatctattgcttcataacaactttttctaatattagtggctgaaaccagggtccccaacccctagcctgcagggcaccagtctgtggcctgttaggagcctgaccacacagcaggaggtgagcagcaggatagggagcattactgcttgagctctgcctgctatcagatcagtggcagcattagattctcataggagcaaaccctgttgtgaactgggcatgcaggatctaggttgcatgctgtttatgacaatctaatgcctgatgatctgaggttgaatagtttcatcctgaaaccatctccacctccccctaccctgggtccattgaaaaattgtcttccatgattctgctccctggtgccaaaaaggttgcagattactggcttaaactaaaactaattatttgtaattattttttgggttaggcattcagacgggtcagctgggcgattcttctgctccaaatgatggcatttacctggcagatgagttgatatggagggtccaaaatggttttcctaatgtttggcaccttccagtggggatggcaggaagggcggattcagctggtatgagacattgactagaatttggcctcttctgtttggtaatctcagggtaattaaacttcttatgtactgtctcaaggctcctagtgggagtattccaagagaactgggagagaactggtgctggccttttatgacctagcttcaaatgtcacagagtgttacttctggagtactctatttgttcaaaatattaacaagcccactcacattcaaggtagaggggacatagacctcacctctcaatggaaggtatgtcagagtttgtggccatgttttaaagcttccacaatagtaaaggagaaaaatgactttctgtactggacctatgacaccaataacttaatttgtgggtatttttagtagaagaagtcttattttcaattaaggagagtcactggtgtaatttttttttgataccataattgttagtggagctttgatttcctaagcaaccaaaatgaatctttctatgaatcagacctgcatagagaagtctttactaggggctcttgcagggtggaatttatagactttcctgcctttggcaaatgagcacactcagagataaagagaatgttaagtgtcgtactgggaggtaggttatagtacgattaggactcaatggggtttcatagatccagtagaagagaagagatgtgatgagaatcagacagggtctggaaatgttagcaggcaagaggtctgattttgtaaaaatcagcaaactttgggaagggtttcatgattttttaagtctaggcttgtagcaaacaagttttagaaagccaactataaaagcactggtgatcaggagacatagagaatgactctgttctcaaggaaaacattttttttcttgcctagttttatatttttttttgctgggtgctggctgtcctggatgatagcattaggagctgcagtagatcagaatgtcagggttcaccaagatgttctcatacaaaggctggcagtgccattttaggagttttcccatttagttgaaccttgaatcatacctatacacagaacaagaggcccaaattacctgaaagacacgtataacctatgcactaatgccccacaactttccacacttttggggaggtaggttaaaaattgcttcttagattggagaactcagatcttgtcaaaactggctttttcctctgttgtctatttttgttatgaagatatatcttgtcttactgacacctatgtctcatatgacaaggaaacttgtcttttagttttctgtcttgtaattaataaaaattaatgcaatgattcccaaaatgcagccctttagatgccttctctagggtcttccattttagtgattctaactctcaccatggaggcacaaaccccacttgttgccttgaacatatacaatctcataagaggtttatatgaagaaaaagctttgtatacctttacctgcccaaagaacaaggggtcttctttgattttgatgttttcatatctccagaacatatttattattgccaatattaatagtccctgaacaggccattcctattagcttctgagcatttatatttaggtaatttgaaagcctagtctagtgttttctgcgatgctgtaatgcactccatattctgaaggaaatgttctggttttatggcacaggcaggactgtaaatgttttatcctaatgctatcactgcacactcatttgcctctgatgaaatgatttgcacttgctgcaattgtccttttcttgtatttgccattctctttctcttctctttttcacctgtccttcaggtctcctgtgtcctctgctggacatcacttcagatatttatcgattaaaaactcaggtcagactatcattaaagttacagagaaatgcccctcttattctttctcccatttcttctcaatgcatttgatttttcagaaacaatatagaaacaaacagtaacaaaacccaacaaatcagcaaaccatttaacattttgcaggttggtatataaatgaaaatgtagtaacaaggaatcttgtatctgaaccttgttaacctagaaattgttttgtttgtttttcctttttgtctaggtacacaatgctagtgatttgctgattaaacccttggaaaatttccggaaggaacaaataggcttcaccaaggtacattttctgtatatgcataagattttttaaaatagcaatcgaatagttgtatgggctactattcttcactttacaaagatatgcaccaatctgctggtgctttgctcttggcctagtcagcctcctaaactgtgcaaaataaatgtttgttgtttatgtcaccctgtctatggcattctgttatagtagcctcagctaacatgacaaagggggtggggaggtgggtgattagtttctatgagaaaatgatcacgaaagagagtaagaaaatctagaattggcctctgactttgtggccaacaggctctgtatctgtgcataagtttcttcttcttttggtgtttttgttgttttgtctggaaaactagctagctatcatgtatcaactgcctgctatattgagcactaggctaggtgctttacgttcattctttaatcacaaggactttgtgtgcttctggcattttccccatttcacaaatgaggtaactgagccttggacaagataaataacatgaccaaagttatatagctggtgatatagtttggatctgtgtccccacctaaatttcatgttcagttgtaattcccagtgttggaggtggggcccagtgggaggtgattgcatcatgggggtggatccttcatgaatggttcagtactatcccctcgatgctgttctcctagtggtgagtgagttctcatcacatctggttgtttgaaagtatgtagcaactcccccacttcttgctcctgctctggccatgtaagatgtacctgctttcctttcaccttctgccatgattttgtttcctgagacttcaccaaaggagaagctgctgtacttcctgtacagcttgcagaactgtgagcccattaaatctcttttctttataaattacccagtctcaggtatttctttatagcagtgctagaacagactgatgtggttagtaagtgatagtggcctggatttagacctaaaggtctttttagctttacgttccatactctttacattaagctatgctgtctagatctttgctgtctattatggtaactactatctatttaaataaaattaaattaacaactcagctcctcattctttctagccacatttcaagtgctcagcagtcacttgtgtctagtagctactgtgttggacagtgcagataaaatacatttccatcattgtgcaaagttccgttggacaatactgagtgccagttaatttcattcttttcagcttgaccatcacatggatctctgtgattctccaatgtctgttgaagggatgttaataattttcatttttaatcttttcagctaggtgtaggtctgtttcatgagctctcaatgtgtatccaccatgtagcaaaggtagtttcttctaccagggctaaaatacagcatcttgtccaagcatctagttttcttaggactaagagcataccaaccagtagatattatttggaatatgatgacaatcagtttggatcaagaatttgaaaacagcaagtttttctttttttaaaagacactttcttgccaactcagcctcccaaagtgctggtattacaggcatgagccaccatgcctggccatgaaagtaccaaattttgagaagaaagagcaaattagtggttgagctcccactacctgctatcatcagattgacatgggcattgttagaaatgactggtgttcaagcaaagtgagttcccctcatagcccagcaatacttgtttcactggagtctcattaacatcaatacttagttgggagaggatatgattgaagaatagaagtatatttaaaattacaactgaggataaaaatacttaaccacttgtgaaacaatttgatttactttcattcccttataagaataacactaggaaagtaaggatatgctaccatggttgccctcatattatctgagcaaatggaaatgaatttgtattatgtgcagtcatgcgtcgcctaatgttgttctgagaaatgcatcattacatgttttcatggttgtgtgaacttcataggagtttgcttaacacaaacctcgatggtctagcctaatacacaactaggctatatggtatagcctattgctcctaggctacaaacttgtacgggtgttaactgtactgaataatataggcagttataacccaatggtaagtatttgtttatctaaacatataaagcatacatataaaaatactgtattataatcttataggactgtcattgtatatgcggttcattgtttactaaaacattgttttgtggtgcatgactgcacttcctatggcccatgcctgcactgagggttttacatatgctttcttccttaattctcacagcaaacctgtgaggtaggatttttaatatccattgtctcaatgaagaaagtgagtctcagaaaggttaaatatgtatctatcttttttcatacttctttaccagtaaggccaacctgcatatctacaaagaagaccaacttagtatgagtcatgtctccaataaactatctagaattccaatagtcaaaatgaagcttataggctacccctgtgtgttatcaatttattgccaatcaattccaagcctctcaatacctgctctgtgataatggacagattttctttaagcatctttcctttatagtgagcacactcttaaactttctcagtagagggagctggagggacgttgcaggaggagggggatctcttgaagtttccagctgaggcgggggtggggcagggtggggaggacagctgatggaactctgacccagccacccacccagacacatggtgcctcaatctccttgaagccttcatgaccatgctgtccctcagcttccttctgtagaccccctaccccacatggcccacttgctggctgaagagttatcatgcagctattaccctctctgcagggccctcatacattgagcttgcaccctagggggttctcaccaaacaaggctggccccgttgagctcacctgcaactcagttttcccaccttctctttataccttctccgctggtcactgttggcctgcttttttgtaatctggtgagttgcctcctgcttacatagtaactatgaaccaccgggccaaatcagcaaacattctgctatccggagtgttaaattactccttttctttttttgtgagacagggtgggtctcactctgtcacccatactgaggtgcagtggcagaatcatggctcacttcagcctcaacctccctgggctcaggtgatcctctcacctcagcctctcaagttgctgggactacaggcacataccaccatgcctggctaattttttttttttttttgtaatttctgtagagatagggtttcgccatgttgcccagactggtctcgaatgcctgagctcaagcagccctcctggcttggcctcccaaagtgttagaattacaggcgtgagctaccacgccccaccaaattactgcttttcaagtgaggtctgaaccccattaaaatttctccttatttgagtacttttccttaaacttagagtaccatatagagttttcttatatgtcaattatttgtaaggttttctatctcctgattggacttagcctggtatacccagcactgctgctagctggctttgtgagttcactggttgtgataggtgctatattaggcccttactcatacatatccagttctcatttgaacctcagaacaatcttgcaaaagttattatcccccattaacaggtggggacactaagttcagtgaggtgtagcctctaaggtcactcagtagcttggatatgaattgagatctggttgtaagtctagggctcatttcactttgcaggaaacagcacttctctccgaaccttagttttctcatggctcatgacaacaagaacaatggacaaatattccaaatctgatcttctgttagtttgagattctttttttttaattattattataatttaagttctagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccagtgtgtgatgttccccttcctgtgtccatgtgttctcattgttcaattcccacctatgagtgagaacatgtggtgtttggttttttgtccttgtgataatttgctgagaataatggtttccagcttcatccatgtccccacaaaggacatgaactcatccttttttatggctacatagtattccatggtgtatatgtgccacattttcttagtccagtctatcattgatggacatttgggttggttccaagtctttgctattgtgaatagtgccgcaataaacatatgtgtgcatgtgtctttatagcagcatgacttataatcctttgggtatatacccagtaatgggatggctgggtgaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgtttttttcttgtaaatttgtttgagttcattgtagattctggatattagccctttgtcagatgagtagactgcaaaatttttctcccattctgtaggttgcctgttcgctctgatggtagtttcttttgctgtgcagcagctcttgagtttaattagatcccatttgtcaattttggcttttgttgccattgcttttggtgttttagacatgaagtccttgcccatgcctatgtcctgaatggtattgcctgagttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcatatggttgtatatatgtggcattatttctgagggctctgttctgttccattggtctatatctctgttttggtaccaataccatgctgttttggttactgaagccttgtagtatagtttgaagtcaggtagcatgatgcctccagctttgttcttttggcttaggattgacttggcgatgtgggctcttttttggttccatatgaacttcaaagtagttttttccaattctgtgaagaaagtctttggtagcttgatggagatggcattgaatctataaattaccttgggcagtatggccattttcacgatattgattcttcctacccatgaggatggaatgttcttccatttatttgtattctctttgatttcattgagcagtggtttctagttctccttgaagaggtccttcatgtcccttgtaagttggattcctaggtattttattctctttgaagcaattgtgaatgggagttcactcatgatttggctctctgtctgttattggtgcataagaatgcttatgatttttgcacattgattttgtatcctgagactttgctgaagttgcctatcagctaaaggagattttgggctaagacagtgcggttttttaggtatacaatcgtgtcatctgcaaacagggacaatttgacttcctcttttcctaattgaataccctttatttccttctcctgcctgattgcccttgccagaacttccaaaactatgttgaataggagtggtgagagagggcatccctgtcttgtgccagttttcaaagggaatgcttccagtttttgcccattcagtatgatattgtctgtgggtttgtcatagatagctcttattattttgagatacgtcccatcaatgcctaatttattgagagtctttagcatgaagcgttgttgaattttgtcaaaggccttttctgcatctattgagataatcatatggtttttgtcattggttctgtttatatgctggattacgtttattgatttgcatatgttgaaccagccttgcatcccagggatgaagcccacttgatcatgatagataagctttttgatgtgctgctggattcggtttgccagtattttactgaggatttttgcatttacgttcatcagggatattggtctaaaattctctttttttgttgtgtctctgcctggctttggtatcagaatgatgctggcctcataaaatgagttagggaggattccttcttttttattgactggaatagtttcagaaggaatggtacgagctgctccttgtacctctgtattctgtacctctgtattctgtattctgtacctctgtattctgtacctctgtattctgtagaattcggctgtgaatgcatctgctcctggactttttttggttggtaagctattaattattgcctcaatttcagacctgttactggtctattcagagattcaactccttcctggtttagtcttgggagggtatatgtgtcgaggaatttatccatttcttctagattttctagtttatttgcatagaggtgtttatagtattctctgatggtagtttgtatttctgtgggatcggtggtgatatcccctttatcattttttgttgcatctatttgatacttctctcttttattctttattagtcttgctagcggtctatcagttttgttgatcttttcaaaaaaccagctcctggattcattgatttctttgaagcattttttgtgtctctgtttccttcagttctgctctgatcttcattaactatttgttgccttctgctggcttttgaatgtgtttgctcttgcttctctagttcttttaattgtgatgttaaggtatcaattttagatctttcctgctttctcttgtgggcatttagtgctatcagtttccctctacacactgctttgaatgtgtcccagagattctggtatgttgcgtctttgttctcattggtttcaaagaacatctttatttctgccttcatttcgttatgtacccagtagtcattcgggagcaggtcgttcagtttccatgtagttgagcggttttgagtgagtttcttaatcctgagttctagtttgattgcactgtggtctgagagatagtttgttataatttctgttcttttacatgtgctgaggagtgctttacttccaactatgtggtcaattttggagtaggtgtggtgtggtgctgagaagaatgtatattctgttgatttggggtggggagttctgtagatgtctattaggtctgcttgctgcagagctgagttcaattcctggatatccttgttaactttctgtctctttgatctgtctaatgttgacagtggagtgttaaagtctcccattattattgtgtgggagtctaagtctctttctcgatctctaaggacttgctttatgaatctgtgtgctcctgtattgggtgcatatatatttaggatagttagctcttcttgttaaattgatccctttaccattatgtaatggccttctttgtctcttttgatctttgttggtttaaagtctgttttatcagagactaggattgcaaaccctgcttttttttgctttccatgtgcttgggagatcttcttccatccctttattttgagcctatgtgtgtctctgcacgagagatgggtctcctgaatacagcacactgatgggtcttgactctttatccaatttgccagtctgtgtcttttaattgcagcatttagcccattcacattaaggttaatattgttacgtgtaaatttgatcctgtcattacgatgttagctagtgattttgctcgttagttgatgcagtttcttcctagcattgatagtctttacaatttggcatgtttttgcagtggctggtaccggttgttcctttccatgtttagtgcttccttcaggagctcttgtaggggaggcctggtggtgacaaaatctctcagcatttgcttgtctgtaaaggattttatttctcctttactcatgaagcttagtttggctggatatgaaattctgggttgagaattcttttccttaagaatgttgaatattggcccccactctcttttggcttctagagtttctgccgagcgatcagctgttagtctgagggacttccctttgtgggtaacccgacctttctttctggctgcccttaacattttttccttcatgtgaactttggtgaatctgacaattatgtgtcttggagttgctcttctcgaggagtatctttgtggcgttctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgtttgtttctttttattcttttttctctaaacctctcttctcacttcatttcattcatttgatcttccgtcactgataccctttcttccacttgatcgaattggctacagaggcttgtgcattcatcatgtagttcttgtgccttgactttcagctccttcaggtcctttaaggagttctctgcattggttattctagttagccattcatctaattttttttcaaggtttttaacttctttgccatgggttcaaacttcctcctttagctcggagtagtttgatcatctgaagccttcttctctcaactcgtcaaagtcattcttcatccatctttgttctgatgctggtgaggagctgcattcctttggaggaggagaggtgctctgagttttagagtttccagtttttcttctctgttttttccccatctttgtggttttatctacctttggtctttgatgattttgacgtacagatggggttttggtgtggatgtcctttctgtttgttagttttccttgtaacagtcaggaccctcagcttcaggtctgttggagtttgttggaggtccactccagaccctgtttgcctggtttcggcagcagaggttgcagaacagcagatattgacaaacatcaaatgttgctgcctgatcattcctctggaagttttgtctcagaggagtacctggctgtgtgaggtgtcagtctgtccctactgggggatgcctcccagttaggctacttgggggtcagggacccacttgaggaggcagtctgtctgttctcagatctccagctgcgtgctgggaaaactgctagtctcttcaaagctgtcagacagggacatttaagtctgcagaagattctgctgccttttgtttggcaataccctgcccccagaggtggagtctacagaggcaggcaggcctccttgagctgcggtgggctccacccagtttgagcttcccggctgctttgtttacctactcaagcataggggcaatggcgggcgcccctcccccagcctcgctgctgccttgcagtttgatctcagactgctgtgctagcagtgagtgaggctctgtgggcgtaggaccctccaagccatgcatgggatataatctcctggtgtgtcgtttgctaagaccgttggaaaagcacagtattagggtgggagtgacccgattttccaggggctgtctgtcactcctttctttgactaggaaagggaattccctgaccccttgcacttcccgggtgaggcaatgcctcgccctgctttggctcatgcttggtgcactgcacccactgtcctgcacccactttctgacactccccagtgagatgaacccagtacctcagttggaaatgcagaaatcacccatcttctacgtcgcacacactgggagctgtagactggagctgttcctattgggccatcttggctttaccctgatttgcatttctctaatggccagtgatgatgagcattttttcatgtgtcttttggctgcataaatgtcttctcttgagaagtgtctgttcatatcctttgctcactttttgatggggttgtttgtttttttcttgtaaatttgtttgagttctttgtagattctagatattagccctttgtcagatgagtagattgcaaaaattttctcccattctgtagggtgcctgttcactctgatgataggtccttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataagatgtaaggaagggatccagtttcagctgcctacatatgggtagccagttttcccagcacctagtttgagattctgagggtaattaactaaatatttgtccgctgagtactagaaatacagtacacagaactcgttgcactgtaagtggaaaatataccctaaaatatactctggattttgaagacagtttgaaaaaatagaaaatattaacatttaattttgattatatgtttaagtgataatatttgaccacttatttattttttctttttgaaatgtgactactaaacattttaaaattacgtgtggcttgcattatctttctattggataacactgacctagacaaagaaattacatttgataggtagctcctgcccatttggtagatagttcatgggctttatcaggctttagaatcaagaggaggaagtatttgatgaaaattcatatacagatagttatttaattaattaaattagttaacatatataaagttcttagtacagtacctggcaaataatatgcactaaataagtttctttcatcaattatatgtgctaaaaaattttctttcatcactgtaattcttgttagtactggtaatagaatagggaggatagaaagtgctccatgaaactgtccgattgacgatggacttactgtgaattaaaaatcaaaaaagaactgagaagttaatgaatgaggcaggaacagagggataggggtgttgaacattgagtgtttcccaagtggctactggcatatgaagaggtttcatattactaggtctcccagtatgtgtctctggctttgcaggatgtgggaggatatctctttgtcatagaagtggaggttcgtagggaggaaggatgaaagcaatgaaggaaggaacaaaataacacagagaatgctctgaactaatagtgaacacattccatataaactcatcctgttattcaagcaggattaacttcttcaagtggcattgatgcttcaagtggcactttaccttggatgtgttttctatagtggaatttgggggcaacatgtcttttataacagaactctattggttaaaaatatttgtaaaccacctccttatggttaaaccagatagatcttcctgttttcaattaaataggttatgtctttcaacttctgtatggagttggtatatttatgcaatgagatggacatttgttcctttcctttcctgtcctgtcctgtcctgtcctgtcctgtcctgtcctgtcctgtcctttcctttcttgtcctgtcctgtcctgtcctgtcctttccgttctgtcggactttcgctcttgttgcccaggctggagtgcaatgacgtgatctcagctcaccgcaacctccgcctcccgggttcaagcgcttcttttccctcagccttccaagtagcttgaattacaggcatgtgccaccacacctacctaattttatttgtatttttagtagagatggggtttctccatgttggtcaggctggtctcgaactcctgacctcaggtgatccacccaccttggcctcccaaagttctgggattataggggtgagccaccacgcccagctggacatttgttttttttctaactttaatgtgtgatctgcagtttcatcagactaaccctatttcacaatccttactttttgagaaaataattaatgctaacttttccattttaaaaattaaaattttataacagatatatgcatagacatatttttaaaaataaaatagtaatacagagtccacaaagaaaatcaaaagtcttctcatgtttatccactactcagaggtatccactgttaaccatttatgtttcattcttagttatttttatattttaaaatgcttatattgctatgttttattttagtttaaaaattatttctccatgctgagaatacaggagatcattgctcacacttcccccttactttccctcttcttccactctttgataattataagaccattttacttcttgtactgcttacttctgttattttaaataatatacttaaactcttatttcttatttcatcaacttttgactctagctttgtaagatgaagatattagcacttctgtcttgcttaacccttttagccctcaactcccatcaaccacaccttcatttttcattttaggggttataacattactattctagtctggaaccttaatgtaatcttattgatattattaatagacttatttgacagtggcaaaaagaagtggacaatccaggatttgaacccaagttctttggctgcgagtccatgaattttgacatatcttatattgggttaatgtaagagttaatttctggagccaacgatagatgaaggatgattcctttctttgcccctttttcctaatttcttctctactatgtttaaagttctttgagcagccacactctagatttctttttggttcactcctatccctcccacctctcaaaattcccaacacatgcaaagtttgtgcatccttccccatgtgtacactttatcacttgatttgcagaactgttctcaccactattcgccttcctataatcatgcaacttccccgcctccccccaccgacttctctgacccaagattaagggaggacaagcaagtcttagtccagctctgtttataatgggtctttcatcccgcagtgtagaatgctagactgtccagtagggatggcagaataaagactcagtcatcccctctagccttatgacagggagggtatttgtaccctttgattcatattttttgggtcttgtcagagttgcccacagtatgatgttttcagttctttttcaagggtgcccttgccagagaggaacagccactgaattgagcttttttgtggtttctggtgggaccagggccaaattgtctgactaagacatctgagtctgcatttaacccacttcatggagagtgggagctagtgtggaagctatgatatagtgtgttctcacccaagagatggcaggcaagagggcattgatgacaggacatgggattgtcagtcttaatgatgtttctcatccatgtacagttatcacagaaagaactttaagaaaaggacctgttctggaggtagatgagactgaaaacgtatcaaagatggcacaaacctgacagtgtagatgaagacaaaggtgttagtgttggtctgcattccaaaggccagtgcttgctctgggaaagaggggaaggaaacatcagcaaaccacccattgatagatccaaataatttgaatttccatgtttgggtttcaatggctaccagagtgcattagcagggaagatcaagtggccaaggtgctaaagaattaagctatgtgacagtaatccgtaagtgatttccaagtctgtagcaaacattttataagccttacaataataactaccatgtactaggtacttggtttatgtcctttcaattattattatttgtatcctacagatgtggaagtcaagacccataatggccaaataacttgtagaaggacacatagttattaacagaagctagtttaaaacagatttttgttactccagggactgtgctctttctactaccctgcactctgaaccctgctttgtggggctcgtatcagaagattaaaaaaaagattaataatgcctgtcaccagttcaatggatatatacattgtggcaaattgtcattattctatagcaatgagaacaaatgaactagagctgttgttcaccgtaacatagatgaatctgagaaatacaaggttgagttaaaaaaaaacagtcacgaaagattacctgctatatgagtccatttctataaagtgcaaaaacaggtaaaactaagtgatgatgttagaagccaggttagtggttacctccaagagtcggggtgttactgaaaaaaaaaaaagaatcacaaaggggctttcaagggttcaggtaatattttgttgttttgaccttgggtgctgatgacatgggtgtgttcagtttgtgaaaattttttgacatttgtatagtgtatttttcagagtatatgttataatttcaaaaaatggaaaagaacattagaaaaccttaatatctcctttgtagcaccttccaccagcaatccgtgtttcttcatacatggagacaatggctttatgggtttatcctcctgattatcctcatatatggaccttcttcctctatgatgactttccttcccttttatctcataggtgaatttccctaagcagtatatagtattgttttacataatatactggttaagacagtggactctggagccagactacctgggtttgcatcttggctcttcaacttagtagctggtgagtgtaggcaagtcacttaacttctttttgccttagtttcattatctataatatgggataaattatagtacttaccacatagagttgtggggataaaatgccttattatgtgtaaaatgctcagaatagtttggtacatatagtacataacatacaaatgtttgctactactgattttcatatttataaaaaaggaatgatctgcaggtgctcttttatatattgctttttttctcatgatttcttaaacaattatcttttttttgagacaaggctttgctttgttgcccagggtggagtacagtggcacaatcacagctcactatagccttaaactcccaggctcaagcaatcttcccattgcagccacccgagtagctgaaactataggcatgtaccaccaaacctcacaaatttttaatatttttgttgagatgaggtctccctgtattgcccagactggtctcgaactcctggtctcaagtgatcctccagccttggcctcccaaagtgtttggattgtgaggcattgtgccaggctcattctcttattgatggatgagtcatttgcttccattttttatgtgagtgcaaacaatactcctgtgacagtgatttacatgtctccttgtgcatatttcaactcttctcctgggtatatacttagaaatagaatttctatgttgtagaatctatgcatttttactagatgtgttgccaaattggtctacaaaatggttgtgtcaatttatatcatcactcatcactagcagtataaaagtgttttatttgctgcatatccaaggaaaatgagttagttcagaaagatgcaagagaatttgattcagcaagtgtgtattgtgtctctaatctgtatatagagaaggaagcagtcactggtggaagagaaatttgctgtacagacacagagcagctctacttaataccaaccacatatgtaaagtatctggcatagagtaaacccctttgctcaagcaatctgggaatgtacccacacagctgatgtggtaatgttattaccctcttacaaggtaatctatgtctgaaaaataatgtggcacatatacaccatggaatactatgcagccataaaaaatgatgagttcatgtcctttgtagggacacggatgaagctggaaaccatcattctcagcaaactatcgcaaggacaaaaaaccaaacactgcgtgttctgactcataggtgggaattgaacaatgagaacacacggacacaggaaggggaacatcacacacaggggcctgttgtggggtggggggttggaggaggggggaggggggaggggtagcattaggagatatacctaatgttaaatgacgagttaatgggtgcagcacaccaacatggcacatgtatacatatggaactaacctgcacgttgtacacatgtaccctaaaacttaaataaataaaaaaataaataaataaaagaataatggccacatttagcctgaagagtagagggtggaaagggaatattatcttgttgtcagtgacatagaatggaccatgacccaggatgaggtcatattttttccatctcccttgccatccttcactagagtagaagggaattgcatcaaagagcggagagacactagttttctcttcccgtctataaccaaagtgaaactgttatctgccccttctccctatcccggtgccctttctacttgaactatttgagagcatttttgtaattacaagggtgatctcgctgaaatgaggtttccttttgtgagcttgtaactcggttcctaatattagctggcttcaaagtcatgtctggagttgacaggagatacaggaaatcaagagcatgtatctccctaaattggattgtaatttggggattccctgtttttggaggaaatgtcaaatgttctatatctgagttttccactacaatagcttctagcaacgtgtagctactacatacttgaaaggttactagtgtaactgaaaaactgtattttaaattttagttgattttagttaatttaaggtaatgtagccacctgtggctattggtagctgtgtaggtctaataaatattttgttggtagaggaaggtaagggagctaatatttttttttcagtacctgctatgcattggggtctatactgccatctaatttttacagtaccctgtgaagattttatcccccattttacagaacaggaaaccagagctcagagaggatgacctacttgttcaaggtcacacaggctacaaaatggcagagccaggatttaaatacaggtctttctggtctctccaattccaaagtccattctctttatcctgaacagggtggtataattttgttcttgctacttggcttcagccatatgccagaaaagcttaaaattgaatgccttctaacagtaattccatattcttaactgttaatttgcattagcaaatgggtttctggaagctctaataaatgcataccttgcagatattgtgtgttcagttccagaccattgtaatgaagtgaatagtgcaataaaatgagtcacaaaaattttgctttccaagtgcataaaagagttacatttacaccgtactgtagtctattaaaggttcaatagcattatgtctttttttttgtctttttttttttttaattttttttgagatggagtctcgctctgtcacccaggctggagtgccatagtgcagtctcagctcactgcaacctccgcctcccgggttcaagcagttctcctgactcagcctcccgagtagctgggattacaggagtgtgccaccacacccagctaatttttgtaattttagtagagacggggtttcaccatgttggccaggctggtctcaaactgctgacctcaagtgatccacccacctcggcctcccaaagtgctgggattacagatgtgagccactgtgcctggccctcaatagcattatgtctaaaaacaaaatgtatatgtaaaattaaaaaacaaactttattgctaaaaaaatgatgctgacacagagacatgaagtcagcacatgctgttggaaaaatgatgctggtacacttgatccatgccaggttgacacaaaccttcaatttgtaaaaaattcagtaactgtgaagcataataaagcaaagcataataaaaatgaggtgtgcctgtatattaagattccagggactttggtaatgatataggagttaagaagaaatcacttaggcagatagtaagggtataggagtccttggtaagacttttctttttaatgaaaagcagcctcaaatcattttctaacaatgcgcagcctgtaaagtcgagctgcagacatagacaagcaagctgagagcttgcatgagtgaatgctggcaggaactagagactagatatgttcaagatggctcctccatcatcctttctctgccagccatgtgtacagtaagaagcagacaagatagtgcccgccaaggagaattcatttgtggaataagattagggcggtgagaccagccttccccttgctcctgatcaaaccaatctgtgagccctacctaaatcagacactacctcctcaagctggaccataaaatctggtgcattcgcagtgagcaggtcctttccttttggagacccccctctctctgtagagagagctgtttctctttctcctctcttctgcctgttaaacctctgctcctaagctcctcgtatgtgtccgtttcctaaattttcctggcaagagatgacaaaccccagacaacacagccacttcagtaatgactttctgtcctaggatatttgggaggaataataaatgcctaggaacaaagtgattgaatgagtcagttaggctttttgtatatttttagtcaaaaatcattataccatgtcttagggttcttcaaagagacagaacaaggggtgtgtgtgtgtgtgtgtgtgtgtttgtgtgtgtgtgtgtatgtagagcggggtttagtttaaggaattctcttatatgattgtacgggctggcaagttcaaaatctgtagggcaggctggcaagatggagactcagggaagagttgatgttgcatctcaaatccaaaggcattccctcttcctcttcctcagtcgtcttcctcagtctttttactcctgaggcctttgactgattagatgaggcccacatatccgcaagactactggtttaaatgttaatctcatctaaaaactatttctaagtaaatatctagactagtgtttgagcaaatgtttaggtaccgtggcatggccacaatgacacataaagttaatcatcaaacactatgagaacttttgttgttgatttaattactttccttttccgtattcacataacttttatttcagtatattgttataatttttgttgtgctattttagtagttattgttgctcatctcttactgtcgctaatttataaatttaactgtatcatatatatgtatgggtaagtgacttaagaactcttgaggcaggcagttagaagtttcagtcagtgtcctccaggtcttttctccgtggttctcttagacttcacctcagggtcataagatggctgtcacagctcaacatattacatactcacatgttagcatcccaagcagaaaggaagtgggggagctcttttttttttttttttttttcttgaggcagattctcgatctgcctcccagtctggagtggtgcagtcttggcttactgcaacctctgccttccaggctcaagcaattctcatgcctcagccccgcccaggtagttgagattgcaggcacatgccaccacgcctggctaatttttggattttttggcagagacggggtttcaccatgttgcccaggctggttgtgaactcctgacctcaggtgtttgggaagccgaggcttcccaaattgctgggattacaggtatgagccaccatgcccagccataaagggctcttttcacatggcatagtttgtcttttatccaagagaaaaatgtcttaccaaagttgccacctgactttccctaataactcattggcaatagcggagttgtgggcccactcctaggacaatatttaggaaaaagacataggagtactaaaattcccctttggcctgggaggggggctcacttttttttggagaacgttgcttgcctgcctgatatctgaagaaataggaagaaagaggatggctattgaattggcaatgaacagtgactgtcataatggccttttgagaatagagatgctggactctaaccaggagcctctggaatatattcaaagggcaggaaagagaaaaatactggttatctatctatagtactttaatataataatcacagaggcactttcaccatatcttgttttccaaagagagattgcctcaaagacccagagagggaatgtgacacctcctaggtcctacgggaagctagtggcagagcaaggaataatactcatattcttttgctaccttcatgctgcttgtaccacttttgttcctccagcaggtcttaagcactgttccacagtgagcaggtctatgcacacctacccctgaagtctaagaaagctgagaggcttaagaaagaagctgacatatccagtttctgagagagaaacatgtaatagatgtttacaaatagaagccatagtcttgggcagcagtgagacaagatggtggatccctgtgccgttaccccctagacgcagggcgtacataccacagggacggaatgtgtaggacaattgaagttgacctgcccggcaaaggcaagaatgctgtgtgaatctttctaagggcaggatctatggtcaaagttattctgatctacgggcaagactgataacagtagataaagtagaaatcttagaggcatttccagaacagaggttaatcagaagtcaatatagtagatttgcatccaagatggagttgctttagcttctacaggcactttaagaacatatttggcagtgatttctgcctatatgatgtaagcatattgtggtttaaaaattttaaaaaatttaactgaaattgacttattactatccatttatattgtagcttacatttagcagcagaagagaccttcaaagttattagtcccacctcactttacagttgggggaactgaggcttagaaggttaagtgactgacccaggagcatagatggttagcaggggagatgggatcagaacccaggtcgcctgattcctagtcagatgtaatcaccagttcttcagagatattccataaatataatattttgggcagagctgtatgagttttatttttgttcaaattatgctgagataaccttgtagacccaatgtcttggccctcatttaacccattcctgctttagccatttctcttcagaaagaatcagatgcacctttttgcatcacagtttccttatctgaaaaaaaatgaggataatgaactatatggtttattttacttataaagttctatgattaatacaagccaagactagagcctagctgagtctccagatttctgttttgaaaatcaaggggtgtatttttattttaataaactactaagccaatatttatccagacaacttagttaatataacttttttttttacttgcttgttttttaaccaaagtgggtgtttaaaaatttgtctttcaactggcactatgttgtcagtctcaccaggcacagcaatcttcgaggaggtccatcttccaaagccagacttcctctaaaaaaaaactccccaggaaactggcttctgctcacagtaggatatgcatgtccagaggattttttttcttatttacttatgtagcctctgtgtgtgtgagataaagctgcttctcacttccgttgacaattaggaagtggctggcattagtaggcaagtaaggggggaaaagccctgcaccccaaccagaattcaatagttaaaaggaaattgttatattgttttcaaagcatttactttcctctccttgattgtatcaaggaagatgccaattcatcatcatcattgctattcttatgaaacactcaatatgtattaaatatttatcatgcaatctcttttgagcctttcgacaactctatgatgcagtccctactgtaacatttattttgtgaggaaactgaggcaggaaaataagaactttaaacaagctggtgtttgagttcatgggtaaaccctctcattggaaaatgggaaattgttggtagatgatgttgcctgatgatatgtatggcgatttaatttgggctcagatttttagttctttaagacagtattattgccaggaaatacttttctgagaaccccagaaaaccttgcatattggttagatatcataagaataacataacaaagcatcccaaaattcagtggcataaagcaataagcatttatttctggctcacacatctatgggttggctgaggtagctttgttttttttcaattaggttcgatggggcttggctcaggccacaagttccatttaggtctgctgtatgtgtctcaatttttcagggatcagagggtcacctgaggcagattattctcaggatggtggcagaagtgcatggtgggtaagcagagacacgtgaggtctttcaaagctaggctcaaagccagcctaccattgcttccttacaaattcagttggccaaaacaaatcatatggccaagcccaacatcagtaaggaggtgaaatacattcttcctttagcagaactgcaaggtcacatggcagagtacatggatacagagaggtggggggaaatttgggaacaataattcaatctgccatgccttggctgaaaagtagtggcagtaggaagtcagaagatgagagctagaaaagatactctgatggagagtgagaggtgtagtgggaagatccttatggttaggagatctggttttgagtcctaactgtgacacttttttagtatgaccttgaacaagtcattttccttgatatttgagcattaagggtccatgtgatgtcttcatcttatattttcacttacctagataaggatgtagagtaaatgaatgcaatgattagtctatgttcaaacagctaggttgaatcagtaaagactggaactttgagttctttttccattcctcaatcttcattgctttagaagaatagttaatatttgaggaggggccaggtgcggtggctctcgcctgtaatcgcagcactttgggaggccaaggcaggtggatcacgaggtcaggagatcgagaccatcttggccaacatggtgaaatcccgtctctactaaaaatacaaaaattaactgggtgtggtggtgcgtgcctgtaatcccagctactcgggaggctaggtaggagaatcgcttgaacctgggaggtggagattgcagtgagccgagattgcgccattgtactccagcctggcaacagagtgagactccgtttccaaaaaaaaaaaaaaaaaaaaaaaacatttgaggaggggtgttgggagaggtttcagctctcctccttttctcatgaaattaaagctgttttactacaattcttctttccacattaccatgcttatctgttttccatttcttcaaagccctgaacaaggagaagtaggccaaaatcataataggaagaactgaagttcaggcagagtaagtgctttttgcatgtaactgtacttaaatgttatatattgttagggaaactggtaacattgctgtccccaaagatcttttagagaggcatctgttgctatgtgatgtgttaagtggagttattcctgaaagaagcacagtgggctagatatgactcatggcctcttctgtctttatgctattataacatatttatatgtgtttatttgtcagacattcatatcatgctcatatagtgccagatattcttctaagaagtctacaggtactaattcatttaatcctcaaaactatgagacagggagtcttacttatttctgttttacagattaaaataaacgcaaataccaaacacgaacaaggaacaacagcaacaaaaacctaaggcacagggaggtgacataactttggcacagtcaagcactagaaaggagcagagctggtacttgaacccaggttatgtgattccagagtccacgcctttagccacgtggcacataggcatcagaactgagcaggccaactctgctacttactagttctgtgacatggagtgaagtacttcactcctctgagccttgttttcaactctaaaatgtgaacaataattatatcagcctcacagggttattgtgaggattcaatgagatagtgcataaaaccatgcttggcattgaaacattagttctatttccgtgaaatacttctatacattttaaagatgactttataagtcttccttttaacttatagtttatgaactcttacaaggtttataatccttggcttgattgatttatctgtatgactgattccttagcagtctgtaagacaatttggccttgccatttctgtctaacataggaaaagagcaatgaggcaatttcccttggggcggagattaagagccagtgaccccatgtatcttggctgtctgagaagttgctgaactgtgccatctcctttttccacatttatccttaccttaaaaatagtcatgaatctgaattttgtatatagtgttgaaggtgaatctgacattatagtttttagagttctcattcattatgctcgttattttttctcttgacaccccagcaagaatttaggaaacctttgctggagtgcccttgtgaagaaaggccttagtttgttacatgccaaagtaccatgtcctgctgacaagaagcgttctcctcctatacaaagagtgatacagtattcactcagagctcacagccctgcctgttccgcatgctgggatcctcggggactggtgcaagtgggtggaggaggttatataagctcacatctccttccaagtgggaagaggcgagggacaacagctgtcagctccacagctggtcttgccagcccaagtgattccaactttatttgatcagagaagaaggcttctcagtacacagaggggagatttgctgatccagagccaatgttttaaaactttggcaatttgtgctaacttcctctggctaggacagatgcttattggctctggctgcctggacatggtgttctcgaggcattttgtgtcatcctgaattgggcccagccagctgctcatctataggagattctcaaggaatggtgcaaagctcattacccttagacttttggttgggcagttgctcttgcatcagtatccatttcattacattaaactaaaagaataaaataagttctcaaaaggcagatataaaacacagcaatctccataggccatttttttatttttaattttttggggtacatagtaggtatatacatttatggagtacatgagatgttttgatacaggcatgcaatgcataataatcacatcagggtaaatggggtattcatcacctcaagcatttatcctttgtgttacaaacagtccaattatactctttattttaaaatgtataattaagttattattgactatattcactctgtattgctatccgatagtaggtcttattcattcgttctaattttttatactcatttaccatccccacctccccatcatccctccactacctttcccagcctctggtaagcatctttctataccctatgtccatgagttcaattgttttgatttttagatcccacaaataagtgagaacatgtgatgtttgtctttctgtgcctagcttatttcacttaatataatgatctccagttctatccatgttgttgcaagtgactagatctcattcttttttatggctgaataattactccactgtgtacacatactacattttctttatccattcatctgttgatggacatttaggttgcttccaaatcttagctattgtaaacagtgctgcaacaaacattggagtacagatatctctttgatacactgatttcctttctttggggtatgtacccagcagtgggattgctggatcttatagtagttcaatttttagttttgtaaggaacctccaaactgttctccatagtggttgtactaatttacatgcccaccaacagtgtacctcagttcccttttctccacatcctccctagcatttgttattgcctgtcttttggatataagccattttaactgggtgagatgatatctcattatagttttgatttgcattgctttgatcaatgatgttgagcatcttttcatatgcccgtttgccatttgtatgtctttttttttttgagaaatgtctattcaaatcttttgcccatttttggtccagttttcttttctgcttcaataggaaagcactgagttcaatgcatcacaattgctgtgttctccctcctccagcagccagagatgttctctgaaacatgctgctgctgccaggagttggcagggtggtggtgtctgcaattctggactgttttatctatctcctcagtgtcctttcggcgatatgaagttacaaccaggtactttgtactatgagtgcttacatgatttttggttctgatgaaggtatttttttctgtgtagatagttgttaacttggtgtcactgcagtggagggggacaatcggtggagccttctatttcgacatcttgctctgcatctttccacaataattggcaatttattcttttaaaattttgagatgagtggagtgcagtagcgtgatctcagctcattgcaacctcccacctcagccttcagagtagctggaaatacaggcacaccccaccatgcccagctaatttttgtgtgtttttttttttttttgtagagactgggttttgccatgttacccaggctggtctcaaactcctgggctcaagcaatcctcccgccttggcctcccaaagtgctgatattacaggcatgagccactgcgctccacctggcaatttattcttgatttactgtaactctgggaaggacatggctagcacataacttaatgtcaacatttctttttacaactgaaaggaatattgggcttttgggatgcatctcttgtccttggtggactataagggtgttgaaagccagttgtaatggcctgtcctctgtagattcccctcagaactaagtctatgcctgttacaagcttagttactatatttatagctagcacagataagaaatctatgtgatggaatattaaatttatgcctgacaagcaaaactatagtaaagagaaaatttgcctacggccttaaatactttggagacagacaaatttacaaggacagtatgtgaggtcggggttataatatgatcgtgtacacagagagagtacaggaaggactgcaaacaaagataggatatggggatattgaggaagacttagagaagacaccactgagaagatgatacatcttcttgtatggaatcttgaaggacgatttgaaattagccagtgaagtggagtgtgaggtacaaggatgctaagtggagggctcagcttgtacaaagaaagttttcaaagtacgcgttgccatctcatgagggatcatgtatatcctctcaaggtgagtatacttagtcctgtagttgatatggaacgctttgcagcaggggaatgtagtaaattttagatagtttaacccacctcttactggttttttgcattgggtaagatatttaatcttcctgaggtttagtttcttcatttgtaaaacagtactactaaagtttattatacagcaactttgatcattaaatgggggtcaaatatctagactatgcatagtatattagagctactcagaaaataacagattctcttctctttatactcatgtttgatttcctgtattacattatattttaatttagcaagtgtatcttgagcacccattttcgcctatttcaatgctaggccctagggatggagttgaataagataccgtccttgactttatggagctacaagttatgtaaactaactattctaaccacaagaccatggtttcttgtctcctctgtgccactgggcaaccatcgacccactcattttctagccttctgcaaaactcctctttatcctcacctatctttgcctttttatctctcatcccagaaaacatcctggcccttctcctgcccatagatgatctcttcatttgggttttttatcccactccttgtattttcttattttttctccctccatatagcaacacacttaaatccctcttgcattaaaaacagagccccattcttactgtcaaggcctggaaggactacagcataacagttttggctaaatgatgatagtcaacacattgtagcaataggaactcaagagttgacattattttaaaacggaggtatggtacctcaggatggttttttagcagggagcaaggtgcttagttcagtggtggtaggaaggggataatggcaagtgtcaaagttgtccataaccggccaggcacagtggctcacgcctgtaattcccgtactttgagaggccgaggtgggtggatcacctgagggcaggagtttgagaccagcctggccaacatggtgaaaccccgtctctactaaaaagacaaaaattagccaggcctggtggcattgcacctgtaattccagctactcgggaggctgaggcaggagaataacttgaacctgggaggcagaggttgtggtgagcggagattgcaccattgcactccagcctgggtgacaagagtgaaactccaactcaaaaattcataaataaataaataataaataaagattttccataaccaaatatgatccagttatagagggcatgactatcaatggagggtgtgattcacacaaaattcatctggcactcaagtggtatgcaaggtagagactgggaattctgaaccagatagaagtcctgatgtttcaaatgggacacaaagtcagagtcaggctggtagccacattgacatgacagtaaatctagtgtatggggctggagttcttaatctaccctgtctcattgtagacttggtctcagcaactagagccaaggtagacctatatgagcaaattaagtagactccactcttgaaagaagaaacgagtctgctaaatgccttactatttaaataaggaaatctttgagaaagtatgttttatatagaggaaatcatatgaacaaaaagcacagtatgaaaaagtgtggcatatttggggaacatatagtaatctggtgtgattagaatatacatgtttcatacaaggagtgcaagaggtgaaactggagagtagattggcgtgagactgcagggccttgaatacgaggctaaagagtttatacttggtactgagttaagtctactagtactgtcttatacctggtgtctgtgggatctcatttaggggtgtgctgtgtccttaaagcatttccttagtgcctttccttataaaatatatggtggtttcttcacaaggttatctacttctacattgggaatattgagagtcagaaggttaagatttttgtttaaggtaatgtaagtagtaaatggaaaatgcagaatttgaacgtggtttagtgccctttcctagtatataacctagtatattgtcgaggttagaagtaagggctttagagtcaattatgggtttgaatctccatttcttttacttctattagcttgtgcaactttggaacagttcgttttctgaggctcaggctcattcctcttctgtaaaattgggataagaatagtaacattcacaggcttgtatgaggattcaaagaggtaatgcatatcaagtgcttaacataacaacttacaaataatactcaataagtggtaactatttctagtattacattaaagttatattggaaaaatgtgtttttacttgaaaaagttaactcagaatatgtagaataaaaggagttgatccagtattctgatgttatagtcatatttggataggaattcatgcttgttctgcactgaggttgcaaatttgcttcatgtgttcattcactgattcactaaacagatgttaatttggccacactctgtacctgacaccattccttgtacaatgaacaggacagatgaagtctctgcttatgtagaccttacattttagtggtgtgccagagggtgggaggcagatgttaaacaaataattagataaataatttcagattgcaacaaatgcaataaatgctttgaagacaataaaatcggtgattcgatgttacttgtgggggtggagttggtctagggcaactttagaaggagtcataatggacagcctctgaaaatgtgacacttcaggtgtgacctgaacattgaaaagaagccagtcatgagaaaaattggagaaagagtgttctagtcatggcaagcgcacaaaggtcctgaggtaggaacaagcttagtggtttgtctaaggaactaaaagaaggccattgtgtctgaagtgaacactgatgagagagtgttctggcccaggccagatcataggggattttgtaggtcatagtaacaactatggattttatcccaagcacagtgtggagtcctggaagtttttaactgtggggaatgatatgatcaatttatatgtttttgataataataatagcttttgtttattggacagatacagtgataagcacattacatgcatatatttcatcagtcttcacataacccagtaaaatatgatgttatttttgtgattattttagagattaagaaatctgaagcttagtaaggttaattttttaaaggtcacaaaattattgttatttatagaaccaagatttgagtttgagtttatctgatcctaagcctacatggcttttattaagctaaaatatatataacaggccaggcatggtggcccacacctgtaatcccagcactttgggaggccaagacgggcggattactcgaggtcaggagtttgagacctgcctggccaacatggtgaaaccctgtctctaccaaaaatacaaaaattagctgggcgtgatggtgggtgcctgtaatcccagctactcaggaggctgaggcaagagaattgcttgaacctgggaggtggaggttgcagtgagctgagatcgtgccactgcactccagcctgggtgacagaacgagactccaggtcaaaataaatacataaataaaatacatataacaacattggctattttaatcattttaagtgtgtaattcagaaatattgattgtattaaaaatgatatgcaaccatcaccatcaaatatttccaaaacccttttatcaccccaagcagaaactctgtacccggtaaggaatgactccccattttccccagccctggtaaagtctaatttactttctgtcttctctatgaattttcttattctagccaagcttgctggctcatgactgtaatcctagcactttgggaggccgagatgggcagatcatgtgaggtcaggagtttgagacctcagccaacatggtaaaaccccgtctgcactaaaaatacaaaaattagccaggtgtggtggcacatgcctgtagtcctagctacgtgggaggctgaggcaggaaaatcacttgaacccaggaggcaaaggttgcagtgagccaagatcgcaccactgcactccaggctgggcaacacagtaagactccatcttaaaaaaaaaaagaattttcttattctagatatgtcatataaatgaattcatactatatttctctttttgtgtctgacctatttgaattagcataatgttttccaggttcattcatgttgtagcatgtatcagaagttccttcatttttatgggttaataatattccatctagtgtatataccacatattttttgtccatttatcaattgatagacatttgggttttttccaccttttggccattgtaaatactacagggaacattggtcaccaagtatctgcttgagtccctgttatctattattttgggtatatactttggagggaaattgcctggttatatggtaattctgtgtttaaatttttgagaacatgacaaaatatttacctgggtgcctgtaccattttactttcccatcagcagttcacaagagttccaatttcttcacatcctcaagaacacttattttccacatatataattttcatttctaatttttttatagacaggatctcagcctgtcacccaggctggagtgcagtggcatgataatagctcactgcagccttgcattcctgggctcaagagatcctcccgcctcagcttcctgactagctaggaatacaggcatgtgctactgcatccagcttttttttttttttttttttttgtagagatgggggtctcaccatgctggtctcaaactcctggcttcaagcgatccttctgctttagcctcccaaagctctgggattacaggctattttctgtattttttattttagatatcctaataactgtgaagtcatatttcattgtgattttgatttgcatttccaataactaatgatgttgagtatcttttcatgtattcgttggctatttctatatcttgtgatatggccatatgtctattcaagttttgctcatttattttcttattgttgagttttttctttttttgagatggagttttgctcttgttgcccagactggagtgcaatgacgcgatctcggctcactgcaacctccgcctcccaagttcaggtgattctcctgcctcagcctcccaggtagctgggattacaggcattcaccaccacacccagctaattttttgtatttttaatagagacagggtttcaccatgttggccgggctagtcttggactcctgacctcaggtgatctgactgcctcagcctcccaaagtcctgggattacaggtgtgagccaccgtgcccagcctcttattgttgagttttaagagttcattttatgttttgcatactagacctttgtcaaatatatatgcataattgtgtataattttatataaatgtgatcatatagcgttctgttttgtaactttttttaatactcactaatatcatggatacccctgtaggtcaataaatgttctcttacaatttgtaatgactcataatgttccattacataaatgaattataatttagtttgtttttatttctttgttccactttgctattattaataatggtatagcaaacattttcgtgaaacatgaactgaagcagatagaacagcaatttcattggaactttttaacatttgcctttctgaaactgataataattgcccaggaaaaataagtgacaatatcaaaatcttaacaatacaataagtttgagctattttatttacatagaatacacagaactttgtatccaagaaacagggatacatgttcttttgggtacacagacaacattaagaaatataaactatgcatcaggctataaaggaagcctcaaaaattcaaaagattctatatcacatagagtatgttttctaaccataagaaaataaaattaaaaattaatgataaaacattccatatttgggaactaacaaaatggcaaatattctttgggttaaaaaaataaatatattttatgatgaaatgacaatgaagtcagtatatatccacatttgtgggacacagttcattatgtagaaaggaagttcattgctttagatatattgatcaacaaataagaaagattaaaaacaaatgtattgagcatttaaattaaaaaaattgataacaacaacaaaacctacccgaagtgacaaaacagctggacatataagacttaagggcagaagtgaaataaattaaaaaacaactataacaataaaaaatggtagaggtaattaacaaagccaaaaattagttattgaaaggattaacaaggtagactggtaggaaaatgcaaacaaacacagtagagaatatagagtaaaataaatgaaatattacagacacaacagatttgttaaaaagacgaaagaattataacacatttgaaaaaaaagagatgaggttaattcctagaaaaatgtaaatggccaaaagttggcaaaaggaaagagggagactgagtagacggatatatattaaagatattgaaatggaattcatacttcccctccccttcactccctcagaaaaagtggtccccaaaaattttaaccttagaaatgagtcggttcaaatcctttcattactagtgtaaaggagaaaaacatgtgcttattgtaatcaaattagaattgcaggaaaattaagtaaataatatttatatgataacctatagcaaacattatactaaatggagaaactttaaatatgttcatcttacgatggagaacaagagaaagatacccatttgtctactattgtttaacccagtactggagagccccactaatactgttagaatgaaaattggccgggcgcagtggctcatgccgataatcccaacactttgggaggccgaggcgagcagatcacctgaggtcaggagtttgagatctgcctggccaacatggcaaaaacccatctccactaaaaatacaaaaaattagccagacatggtggctggtgcctgtagttccagctacttgggaggctgaggcaggagaattgcttgaacccgggaggcagaggttgcagtgagccgagattgcgccactgcactccagcctgggagtgagactccttctaaagaaaaaaaaaaaaaatagaaaaggaaagaaaattaaataagtgcacaaagatgggaaggaaagatttaaaattggttactatttgaaaaacattacaaaacagcatggtgttatttgcagatgatataattatataactgggaaaatcagcagcatcagtaaactttataaggactaataagaaattcaccagattggcaatgacacgagtaatttgccaaagttaatattatttttaatacgtgcaataagtaaccagtaaatgtgataagtaatattgatacgggaggggggcaggcaagtgctaggaagagaaaggcccggtccctggctagggctccacccctgggcctgtgcccacggacctaggtgaggacaggcatttctgttttcatgccaaaatgttgcattttccaagaccaccctggcccgccatgcccccatcctttgcctataaaaaccccaagaccctagagggcagagacacaagtggttggacatcgagaggaacacacaggcggaagaacacagccgcagacaccagcagataccaggaggacaccggcagacaccaggaggacaccggcagacaccaggaggacaccggcagacaccagcagttgccagcaggtcatctatggcgggaagacgctgagttcagccgagggcggtcagaggagaggcaggagagctcggcggctgagcggcctgactcctggggaaaaccaacttcccactccatcctccttctggctccccatccatctgctgagagctatttccatcattcagtaaaaccttgcactcattctccaatcccatgtatgatctgatttttccggtacaccacggcaagaacccgggatacagaaagccctctctccttgtgataaggcagagggtctaatttagctgattaacacgagctgcctatagacaacaaaactaaaagagcacactgtaacgcacgcccactggggcttaaggagctgtaagcatttgcccctagatgctgccttggggttaaagcccacatgccccacaacctgcccatctgcatgcgccccctagaggtttgagcagaggggcaccgaagaagcgagccacagcccagtctcatgccctgtgaaggggataagggaacttttcccgtttcaatatcattcacattagcaataacaactaaaatatgcagaaattattttcaaaagaaatacacaagatctctattgggaaaaacattaaaatctagtaaaggacatggaagaaaatataaataaattctagacctttcctcttttcaaatggatttcgttaatattatacagatgttaattctcctctaattaatctataaattaaagtttagttgggtttttagcttaatatgcacaaatagctaagttaaccttaaaaaaaaaaagacaaaagaagggagattttctctaccaggcagcacacatattacaaagtcagtggagtgaaaacagtcggatattggtcctcaaacagaaggctagtcaaacagaatagatagctgaagttcaaactcacatattaatttaatataaaataaaaatcgcactccaaattaatggggagtggaaaaattcataggtgattataggaataatgaatctctatatagagaaatataaagctggattcctacgtaacatcacaaacaatgctgaattccaggcggatgaagggcctagaagtgaaaggcaaaactcaaaggttgtttctgtcctgtgtatatacccttttctgataaatatatggaacaaactaggaattcaagggaacttcttcaacctgattgatggcagctgtaaccaaaactagaagttaacatcacacataagggaaagactaaaatcttttcctctatggtaaagaacaaaataaggatgtctacgttcttcactttgattcaacattgcactggaggttctagttagcataattagccaaaattggaaagaagtaaatctatctctatttgcagatgacttcatgttgtatatagaaaatcctaaggaacacacacacacaaacacatacacacacacacagaactaatgaaggagttcaacaacattgtgtaggatacaagatcagtatataaaaataaattttatttctatctactttggaataaaattgtatgtctattgacattaataatgtgaacattaagaaaacaatctgatttaatcaaaatgattaaaatacttaggtataaatttaacaaaagatgtgcaagacttatatgctgaaaactacaaaacatcattgaaagaaattaaagaagccctaaatcaatagaaagacaagctgtgttcatgaattgaaagccttaatattgttaagatggcattactcatcaagttgatctacagattcaatgcaagccctatcagaattccagctggccatttcacacaaattggtaagatgatcctaatatccacatagaaatggaaaggaccagaatagaaaaaaatgtcaaaggcaaatttttaaatttcaaaacttactacaggccgggcgttgtggctcacgcctgtaattccaacactttgggaggctgaggtgggtggattacctgaggtcaggagttcgagaccagcctggtcaacatggtgaaaccccgtgtctactaaaaatacaaaattagctgggtgtagtggcacatgcctgtaatctcagttacttgggagggtgaggcaggagaatctcttgaacccagcaggtggaggttgctgtgagccgagatcgcactgctgcactccagcctgggcaacaagagtgaaactccatctcaaaacaaaacaaaagaaaacttactacaaagccacagtaatcaagatagtgtggtgctgacataaagatagacatatagatcaatagaataaagagtccagaaacaaacatttatggttcactaataatttacaaggatattaaaagcaatcagttgggaaagaatactcttttgaataaatggtgctgggactaccggatatttacttgcaaaagaataaaggaaacatagtacatccatacagccaaataatattcagtcataaaaaggagtggagtaccgatacatgctacaatatggatgacccttggaaacattatgtaagtttaagaagccagtcaccaaaggccataatgcagattccagttaatatgaaagatgtagaataggaaaatccatagagatgaatgtagactgtggctttttgaaggtgggtggaagggggaatggaaaatgattactaatgtgattaagatttctttttggggtgatgaaaatattttggaattagataacagcagtggttgcacagctttgtgaatatgctaaaaaccactgaattgtacactttaaaaggatgagttttatgatatgagaattatatttcagtttttaatttaaaaattgaatttgaaggagaaagtattccacagaatcttatcggtccttggtgaaggcagtaaggttttctggcccatgcttttctcaaataattggtactttaaattgattcaacagctggaggaacagtttgtccttcctatgttttgtgtgaaaatgtctacctcctgtgttttggtatctgagttagggttgggctatggaacttctcgagttgtattcctaagacgtcttgattatttataagccccatgaatgttattccacccatgataatctgggctacatggactgtgatcttggatgttagttcagcttatttgaaccttaatttcctttacaatatctgcttctcagtgttgtaaagtctaaatgagataatagactttaagtgtctatcatagtgcctggcctgatgtaggccttggttaatgaatgttagcttcctccctacacgtttcccttcattaaaaaaaaatagtaaaaagcacatttctttctttcttccctgtccaccccgcctgaaacagagtcttgctctctcacctaggctggaatgcagtggcacaatctcggctcactgtaacctccacctcccaggttcaagcaattctcctgcctcagcctcccaagtagctgggattacaggcgtgcaccaccaagcccagctaattttttttctcttttttttttttttgtatttttagtagagatggggtttcaccatgttggctaggctggtctcgaactcctgacctcaggtgatccgcccgcctcggcctcccaaagtgctggcattacaggcatgagccactgtgcccggccaaaagcacatttcttatatgtcacaggtcactcagctctgccctagcttcctgcccagcaacagattgcttgtagcaataaaccatgggtgatttttttttctttgatccgtgtgtcccctgctgtgcctcttctactacctggcacattgcaggtgctcagtgattttggatttcgcatgagacagcacaagccatttacattgattttccagcatgatgctaagagaatagtagagtgtcagcattagtctgtgacaaaggaacattgttagtgctactttagatgctgtgtttcttccagttgtgctgagtagcagagaacttaattaaatttcatactcgagaagagtaaaggctgagtccttcatctgccacaaatctttacaacccttgctttctagttaaactttccaggattttttttctctgtttttaatatcagctttttggagtgaagtgcttaaataataccaagtaatttattaaaaagagacaatcccaggttcctatttctttggaaatgttttacttattattagctgtctaagtgcattgtagattaaccttttcatgacaaatatttacttccatttgtgttatgtcttcttcctttgtaagaaaatttgaatgagtggttaatctatgtgaaaaatattggagggaagaaaatatatctactgcacaggcccttttaaggtatcattctctaaggagcagcttccatagctttcagctgtaaaaatagggactgccatttctgcaggcagaatggtttggggttatatttcaggaagctgaaactgctgagaccaatacaaagttaattctccgttgcttttttttccttccaggagctagagggattgaccacctgaaacctgacactatctccttcattctcctttctaagcagacagagttacaactacagacatttaatctttgcccttctttcccacctttaggagcggaaaaagaaatttgaaaaggatggtgagaggttttattctttactggatcggcacttacacctgtcttcaaaaaagaaagaatctcagttacaagaggtatgttcacaaagcctgcccctgccttccattgctagctatgccttagaaacagtgtgaattttgtactgcaaggcttttcccataccccgtctcagcagggaacctcatgtgatagtagcacttgtagtcaaaactgtggcctgagactcagaagccctgaatactaagccagctcttccactaactcagggtgtgaccttggataggatacttctttctttgcctcattccattatctgtaagaagaggagtcgagagtccctttcaattgcaagtccaaaatccatgcgaggataaagttaaactagtgttgtatttggtagaaatcaggaacagatcttctacttttttccctgagagattccacaacctttttttttttttttttttttggtgaggggttaggggaatgttctgttttgggactactgcttacctgggacttgcagtgccttcagttcaaataagctaccattcggtgagaccctaccacatgccatgaactgtactggatgcaacatggctacagaaacaatgagacatgattcctgcccttctgcagcttactgttgggctactaaataagaaaacacattactcttatacaaatagattttttttacatactttaatgtgtatatggtgcttttgttgggagtgggaaatgagaatagaagacttatgtttggatgtggggaatttcctttgtggaagaatgttgcccttccaatttgacgtggtcattaaaatataggtaaagtgtttgacaggtgaaaatggataaatggacctttcaaacagagaccaatggcccaaggatggaaggaacataagtagaattctattttaggaatctcaaactggcataggttgtagggtgaattagatcagggagagactagaagcaggataaacagtttaggaaactattgatctaggaaacgatctaggggaaagtgacagagccgtaagagaggcactagggaaggaaaagaaggaataaactgattgagaatttttctaatggaaggaggggtctatatgttcaatgaaagattcagtaataatggagattttaaagattcaagtatgaaaagagatatctgatggaataatatcataggcaggagctgtcatcttgtccatggtcacacagattgtggcagagctggagctcatctcctgataactggtttcatagatatccatcacatcatctgaggtgcttgaaggtaataggtcaagagcctcagtgtggccgagtgcagtggctcatgcctgtaatcccagcattttgggcggccaaggcaggtggatctcttgaggtcaagagtttgcaaccagcctggccaacatggcaaaaccccagctctactaaaaatacaaaattaaccgggcatagtggcacatgtctgtaatctcaattacttaggagactgaggaagaagaatcgcttgaacccgggaggcggaggttgcagtgagctgagatcactccattgcactccagcctgggtgacaagaacgaaactctgtctcaaaaaaaaaaaaaaaagccttagttgtggatggagttagtattgcaaaggagaaggactactttccttccataaactagaattgagtctgggatcttctatcattttccttttgcccacttttgtttttttccttttctatctattctgtgtcgcggtttctatgcagaaaacagtcaacaggcctgagactgctatgcttagaaagacctgtttacaaaattagcccttggaatggcatctgggaacttcactgttaaacagctcccaacattgatttagaagtttcccttaatgggtaagaatggctgactgtgccaagcctggctctgcaaataatgtagcttatgtcgaacacctttttcttctggtactcttgaattttggttgtgctgggcagagtgtgcctgtgtaactagccccgcagtaaaaccctaagctactcattctcttatgagcttccctgactgataacattttctctgtgttgttacaacttgttgaaggaagaattaaatgtgtcttgggtgacaccaccgtgagagatcttttggaagcttgtacctagcttcctctgcattttgccccaggcaccttttctctttgctcagtcggctgtgtacgctttcactgaaataaatcttagctgtgagtactactatgttgagtactttgagtcctgctcaaaaaagatttattaaagaattattaaaattggggtggtcttctggaccctggacacaatccaaactattggagacttttgctaggacaccttctggagtgttctaggtgtttggtgctatatctagatgtccttttattacttattcaataaaaaaatgagcagggcaatcttgagttagtcactttcaaaaaatttagatttcatctttagagaagttttaggtttacagaaaattaaatagtaagtacagagttctcatatgcccttactccctcacacagtttctcatttcctcttttaggatcatcttgcatttgtgtgatacatttgttagaattgaggagccaatgtattaaacattctatgggttttgaaaaacatatgataacatatatccagcattaccatattgtacaggacagtttcgctgccttgaacatccctggactttatccctccctccttctacctctacctctgacaccactgatctttttatggactccatacttttgccttttccaaaatgtcatatagttggtatcatatggtttgtaaccttttttgattggcttcttgtagttagcaagatgcatttaaggtttctccatatcttttcttgacttgataactcacttctttttagggctgaataatatgccattgtctggttgtaccacggttggtttatccatttgcctattgaaggacttcttcgtttcttctgaattttggcagttattaaagctgcgataaaaaattgtgtgcaggcttttagggatatacattttgatgttgtttgagtcaataccaaataatacaactgctatcatatggtaagattttatctagtgtcgtaagaaactgccaaactgtcttccaaattgactgtagcagtttttatttccatgaacaatgaatgatagctccggttgctccacatccttgtcactattctgcgttgtaccattaaaagtaatggcagaaatcacagttccttttgcaccaacctaatatgtacatggaatatctttccatttattttgacctttgatttttttcatcagtgttttgtagttctcctcttaaatatcttgtctttttgtgcctggcttatttgacttaacaaaataactttcagttccatccatgttgttgcaaatgacgggatctcatttttttcattcttttatttctgatgccacttctttgtgtatttactctcttacttatttaatgtggctaaaatattaacaattttattgatttttttcaaagaaccagctttttggttttgttgatttcctgttgttaatttcgttgatatcttcatcttcttttttttattatactttaaattataaggtacatgtgcacaacgtgcaggtttgttacatatgtagacatgtgccatgttggtgtgctgcacccattaactcatcatttacattaggtctatctcctaatgctatcccacccccctccccccaccccacgtcaagctccagtgtgtgatgttccccaccctgtatccaagtattctcattgttcaattcccacctatgagtgaaaacatgtagtatttggttttctgtccttgcgatagtttgctcagaatgatggtttccagcttcatccatgtccctacaaaggacatgaactcatcattttttatagctgcatagtattccatggtgtatgtatgccacattttcttaatccagtctatcattgatggatatttgggttggttccaaatctctgctattgtgaatagtgccacaataagcatatgtgtgcatgtgtctttatagcagcatgatttataatcctttggatatatacccagtaatgggatggctgggtcaaatagtatttctagttctagatccttgaggaatcaccacactgccttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgattttttcttgtaaatttgtttaagttctttgtagattctggatattcgccctttgtcagatgggtagattgtaaaaattttctctcattctgtaggttgcctgtgcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccttcttgaattaatttttgtataaggtgtaaggaagggatccagtttcagctttctacatatggctagccagttttcccagcaccatttattaaaaagggaatcgtttccccattgcttgtttttgtcaggtttctcaaagatcagatggttgtagatgtgtagtattatttctgagggatctattctgttccattggtctatatatctgttttggtaccagtaccatgctgttttggttactgtagccttgtagtatagtttgaaatcaggtagcatgatgcctccagctttgctcttttggcttaggattgtcttggcaatgtgggctcttttttggttccatatgaactttaaagtagttttttccaactctgtgaagaaagtcattggtagcttgatggagatggcattgaatctataaattaccttgagcagtatggccattttcacgatattgattcttcctatccatgtgcatggaatgtacttccatttctttgtgtcctcttttattttgttgagcagtggtttgtagttctccttgaagaggtccttcacatcccttgtaagttggattgctaggtattttcttctctttgaagccattgtgaatgggagttcactcatgatttggctctctgtttgtctgttattggtgtataggaatgcttgtgacttttgcacattgattttgtatcctgagactttgctgaagttgcttatcagtttaaggagatttggggctgagatgatggggttttctaaatattcaatcatgtcatctgcaaacagggacaatttgacttcctcatttcctaattgaataccctttatttctttctcctgcttgattgccctggccagaacttccaacactatgttgaataggagtggtgagagagggcatccctgtcttgtgccagttttcaaagggaatgcttccagtttttgcccattcagtgagatattggctgtgggtttgccataaatagctcttattattttgagatacatcctatcaatacctagtttgtttagagtttttagcatgaatggctgttgaattttgtcataggccttttctgcatctattgagataatcatgtggtttttgtctttggttctgtttatatgctggattacatttattgatttgtgtatgttgaacgagccttgcagcccagggatgaagccaacttgatcgtggtggataagctttttgatgtgctgctggattcagtttgccagtattttattgaggatttttacattgatgttcatcagggatattggtctaaaattctcttttttttttgttgtgtctctgccaggctttggtatcaggatgatgctggcttcataaaatgagttagggaggattccctctttttctatggattggaatagtttcagaaggaatggtaccagctcctccttgtacctctggtagaatttggctgtgaatccatctggtcctggactttttttggttggtaggctattaattattgcctcaatttcagagcctgttattagtctattcagggattcaacttcttcctggtttagtcttgggagggttcatgtgtccaggaatttatcatttcttctagattttctagtttatttgtgtagaggtgtttatggtattctctgatggtagcttatatttctgtgtgaaaggtggtgatatcccctttatcattttttattgcaactatttgattcttctctcttttcttctttattagtcttgctagcagtctatcaattctgctgatcttttcaaaaaaccatctcctggattcattgattttttgaaggtttttttttgtgtctcttatctccttcagttctgctctgatcttagttatttcttcccttctgctagcttttgaatgtgtttgctcttgcttctctagttcttttaattgtgatgttagggtgtcaattttagatctttcctgctttctcttgtgggcatttagtgctataaatttccctctacacactgctctaactgtgtcccagagattctggtatgttttgtcttgttctcgttggtttcaaagaacatctttatttttgccttcatttcgttatatacccagtagtcattcaggagcagattgttcagtttccatgtagttgagcggttttgagtgagtttcttaatcctgagttctagtttgattgcactgtggtctgagagacagtttgttataatttctgttcttttacatgtgctgaggactgctttacttccaactatatggtcaatttttaataagtgcgatgtggtgctgagaacaatgtatattctgttgatttggggtggagagttctgtagatgtctattaggtccgcttggtgcagagctgagttcagttcctggatctccttgttaactttctgtctcgttgatctgtttaatgttgacagtggggtgtcaaagtctcccgttattattttgtgggagtctaggtctctttctcggtctctaaggacttgctttatgaatctgtgtgctcctgtattgggtgcatatatatttaggatagttagctcttcttgttgaattgattcctttaccattatgtaatggccttctttgtctcttttgatctttgttggtttaaaatctgttttatcagagcctaggattgcaacccatgcctttttttgttttccatttgcttggtagatcttcctccatccctttattttgagcctgtgtgtgtctctgcacgtgagatgggtctcctgaatacagcacactgatgggtctcctgaatacagcacaatgatgggacttgactctttatccaactttccagtctgtgtcttttaattggagcatttagcccatttacatttaaggttaatattgttatgtgtgaatttgatcctgtgattatgatgttcgctggttattttgctcgttagttgatgcagtttcttcctagccttgatggtctttacaatttggcatgtctttgcagtggctggtactggttgttcctttccatgtttagtgcttcctttaggagctcttgtaaggcaggactggtagtgacagaatctctcagcatttgcttgtctgtaaagtattttatttcgcctttacttatgaagcttagtttggctagttatgaaattctgggttgaaaattcttttcattaagaaagttgaatattggcccctactctcttctggcttgtagagtttctgccgagaaatcagctgttagtctgatgggcttccctttgtgggtaacctgacctttctctctggctgcccttaacattttttccttcatttcaactttggtgaatctgacaattatgtgtcttggagttgctcttctcaagcagtatctttgtggcattctctgtatttcctgaatgtgaatgttggcctgccttgctagattggggaagttctcctggataatatcctgcagagtgttttccaacttggttccattctcgccgtcactttcaggtacacaaatcaggcgtagatttggtcttttcccatagtcccatatttcttggaggctttgctcgtttctttttattcttttttctctaaacttctcttctcacttcatttcattcatttcatcttccatcactgataccgtttcttccatttgatcgaatcggctactgaagcttgtgcatgtgtcatgtagttctcatgccttggttttcagctgcatcaggtcatttaaggtcttctctatgctgtttattctagttagccattcgtcttatcttttttcaaggtttttagcttctttgcgttgggtttgagcatcctcctttagcttggagaagtttgttattaccgatcatctgaagccttcttctctcaactcatcaaagtcattctccatgcagctttcttccattgctggtgaggagctacgttcctttggaggagaagaggtgctctgatttttagaattttcagcttttctgctctggtttctccccatctttgtggttttatctacctttggtctttgatgatggtgacgcacagatggggttttggtgtggatgtcctttctgtttgttagttttccttctaacagtcaggaccatcagctgcaggtctgttggagtttgctagaggtccactgcagatcctgtttgcctgggtatcaccagcagagtctgcagaacagcaaatattgcagaatggcaaatgttgctgcccgatccgtcctctggaagcttcatctcagaggggcacccagctgtatgagttgtcagttggcccctactgggaggtttctcccagttaggctactcaggggtcagggacccacttaaggaggcagtctgtccgttctcagatctcaaactccgtgctgggagaaccactactctcttgaaagctgtgagacagggacatttaagtctgcagaggtttctgctgccttttgttcagctatgccctgcccccagaggtggagtctacagaggcaggcaggtctccttgagctgtggtgggctccacccaattcgagcttcccagctgctttgtttacctactcaagcctcagtaatggcggacgaccctcccccagcctcgctgctgccttgcagttcgctctcagactgctgtgcttgcagtaagagaggctccgtgagcttgggaccctctgcaccatgcatggtatataatctcctggtgtgccatttgctaagaccgttggaaaagcgcagtattagggtgggagtgtcccgattttccaggtactgtctgtcacagcttcccttggccaggaaagggaattccgcaaccccttgcgcttccagggtgaggcgatgccctgccctgcttcggctgacactctgtgggctgcacccactgtccaacaagccgcagtgagatgaactcagtagctcagttagaaatgcagaaatcacccatcttctgtgtcgctcacactgggagctgtagactggagctgttcctattcagccatcttggaaccttcagtcgatatcttctttaatgtttattttttcttattttctgcttactttggatgtgatttattcttctatttctagtttcctaagaaggaagcttacattattaataagagatctttcttctattctattatatgcatttcattctataaatatttctctaagcactgcttttgttgcccacaaatattaaattgtgttttcatttttatttaattcaaaatgtcttaacatttcttattttattttatttattttttgtagaattgaggtcttaccatgttgcccaggcgagtttcaaactccaggtttcaagtgatcttcccgccttgccctcctaaattgctgagattacaggtgtttgccatgatgcccagccttacttttctttgcgtctttgactcaggtttcatttataaatgtactgtttaatctccaattatttggggcattttcagcttttaaaaattgatttctggtataatttaattgtggtctaattgtatatttcataagatttctattcttttagatttcttcaggtgtattttatgtcccagaatgtggtctatcttggtgatttttctgtgtgactttgagatgaaagtgtattctgctgttgtatcaagtgttacaaagatgtcagttagattcagttgatcaatggtgctgttcaggtcaacaatgtccatacggattttctgctagctggatctgtccattactattagaggagtattgaagtctccaactctaatagtaggtgtgtctctccttgtaattctctcaatttttacctcatgtattttgatgctgtgttgttaggcacattcacattaagaattgttatgtcttcttagagtcttgccatctttattattatattatgatttgatatcataatatttttccttggtagttttctttgttctgaagtatgctttttatgaaattaatatagctactctagcattcttttgattaatgttagcatgatatatctttctttatacctttacttttaatctgtctttgttttctttacattttaattgttatttcaataggtttaggggtataagtgttttttggttacatggatgaattgtatagtggtgaagtctgggcttttagtgtacctgtcacccgaatagtgtacattataccgaacaatgggtaatttttcagccccctctcaccaccctttttctgagtctccaatgtccattataccactctgcatgtctctgcatactcagagcttagctcccactaataaatgggaatgtgaggtatttgatttgagttagttcacttggaataatggcctccagttccagtttctgtaaaagacattattttgttctgtttcatggctgagtagtattccattgtgtgtgagtgtgtgtgtgcacacatatatacctactatattttctttatccactaatcagttgatgggcacttagattgatttcctgtctttgcaattgtgaattgtgtgaagataaacataggagtgcaggtgtcttttctgatgtaatgacttcttttcctttaggtagattctcagtagtgagatcttggatcaaatagtagttctacttttagttatttgagagatctctatactgttttccatagagactgtatgaatttacattcctacccaaagtgaataagcattcccttttaaccacatctgcatcttttgttttttgactttttaataatggcctttctgagtggagtaaggtggtatctcattgtggttttaatttccattttctttttttttctttttatttatttttatttattttttctattatactttaagttttagggtacatgtgcacattgtgcaggttagttacatatgtatacatgtgccatgctggtgcgctgcacccactaactcatcatctagcattaggtatatctgccgatgctatccctcccccctccccccaccccacaacagtccccagagtgtgatactcctcttcctgtgtccatgtgatctcattgttcaattcccacctatgagtgagaatatgaggtgtttgcttttttgttcttgcgatagtttactgagaatgatgatttccaatttcatccatgtccctacaaaggacatgaactcacattttttatggctgcatactattccatagtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcccctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgaggagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgtttgctctgatggtagtttcttttgctgtgcagaagctctttagtttaattagatcccatttgtcaattttgtcttttgttgccattgcttttggtgttttagacatgaagtccttgcccatgcctatgtcctgaatggtaatacctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatcgttccccatttcttgtttttgtcaggtttgtcaaagatcagatagttgtaggtatgcggcattatttctgagggctctgttctgttccattggtctatctctctgttttggtaccagtaccatgctgttttggttactgtagctttgtagtatagtttgaagtcaggtagcgtgatgcctccagctttgttcttttggcttaggattgacttggcgatgcgggctcttttttggttccatatgaactttaaagtagttttttccaattctgtgaagaaagtcattgggagattgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgaaacagtggggttttctagatatacaatcatgtcgtctgcaaacagggacaatttaacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcctctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgccaggctttggtatcagaatgatgctggcctcatgaaatgagttagggaggattccctctttttctattgattggaatagtttcagaaggaatagtaccagttcctccttgtacctctggtagaattcggctgtgaatccatctggtcctggactctttttggttgctaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttacttttctatttcttttaattgtgatgttagggtgacaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttatgtacccagtagtcattcaggagcaagttgttcagtttccatgtagttgagtggttttgagtgagattcgtaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtacagagctgagttcaattcctgagtatccttgttgactttctgtctctttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccgttatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgagaattcttttctttaagaatgttgaatattggcccccactctcttctggcttgtagggtttctgccgaaagatccgctgttagtctgatgggcttccctttgagggtaacccgacctttctctctggttgcccttaacattttttccttcatttcaactttggtgaatctgacaattatgtgtcttggagtcgctcttttcaaggagtatctttgtggcgttctctgtatttcctgaatctgaacgttggcctgccttgctagattggggaatttctcttggataatatcctgcagagtgttttccaacttggttccattctccccatccctttcaggtacaccaatcagacatagatttggtcttttcccatagtcccatatttcttggaggctttgctcatttctttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcatctgaagccttcttctctcagctcgtcaaagtcattctccatccagctttgttccgttgctggtgaggaactgtgttcctttggaggaggagaggcgctctgctttttagagtttccggtttttctgttctgttttttccccatctttgtggttttatctacttttggtgtttgatgatggtgatgtacagatgggtttttggtgtggatgtcctttctgtttgttagttttccttctaacagagaggaccctcagctgcaggtctgttggagtaccctgccgtgtgaggtgtcagtatgtccctgctggggggtgcctcccagttaggctgcttgggggtcaggggtcagggacccacttgaggaggcagtctgcccgttctcagatctccagctgcatgctgggagaaccactgccctcttcaaagctgtcagacagggacatttaagtctgcagaggttactgctgtctttttgtttgtctgtgccctgcccccagagatgaagcctacagaggcaggcaggcctccttgagctgtggtgggctccacccagttcgagcttcctggctgctttgtttacctatgcaagcctgggcaatggcgggcgcccctcccccagcctcgctgccgccttgcagtttgatctcagactgctgtgctagcaatcagcgagactgcgtgggcgtaggatcctccgagccaggtgcgggatataatctcgtggtgctccgttttttaagcccgtcggaaaagcgcagtattcgggtgggagtgacccgattttccaggtgccatccgtcacccctttctttgactcagaaagggaactcgctgaccccttgcgcttcccaagtgaggcaatgtctcgccctgcttcggctcgcgcacggtgcgcgcacccactgacctccgcccaatgtctggcactccctagtgagatgaacccggtatgtcagatggaaatgcagaagtcacccgtcttctgcgtcgctcacgctgggagctgtagaccggagctgttcctattcggccatcttggctcctccccaatttctattttcttgatgattagtgatgttgagcattttttcatgttattggccatttgtgcatcttcttttgaaaaatgtctgttcatgtcgtttgcccacttttaaatgggatttttttttcttgctgatttgttggagttccttgtagattctggacactagccctttgtcagctgtacagtttgtgaatattttctcccattctgtaagttgcctatttactctgttgattatttatcttgttgtgcagaaagattttagtttaattaagtctcatttatttatttttgtttctgttgcatttgctttaggtgtcttagtaatttttttttattaggccaattcctagaagcatttttctgtgttttagtctagaagttttatggtttcaggtctaacatttttgtgtatcttatttaaaatgatatcttttaggtaacatagttggctcttaatttttgtgcactatgacagtctatcttttaatttttttagatcactgacgtttaaaagggtcatagataatggtgtaatagtatctactatattgtttaccatcttctacttattgtttttgtttttatttttgtctttcagtcttcttttgacttctcttttttaagagaatattttatatgatcttattttctgtcttctcttaccatgtaaattatacttcttctttttcattttttaatggttgccttagagcttgcaatatgcatttgtggttagtttatgtccacttttcaaattccagtaacgtagttatgggttgtacaggatcaacagactatttccaatttctccatttagtcccttataatggtactatcattctttttacttatttgtaagatacaatcaccaaatgtatcattacaattattattatagacaaattcttatctgttaggtccattaagaatttgaaaaataaaatatttaatcttcatttatttcttttctagtgctctttttttctttctttttaggtctatatttccgacatatcatttttcttctactggagatcttttgtcctttcttgcaagacaagtttagtggtgacaaagtgctttaatttttgtttgtttgaggaagtctttattttaccatcacttttgaaggataatttcacagtttacacattgttaagtagttaactttttttctttcaacaccttcaaatattttatagcactcttttctttctgcatggtttcttaagagaagtctgatataactctttatccttgccctgctgtatagtaagttgtttgtttttctctctagcttctttcaagattttctcttgtattttattttctgcagctttgaatatcatatacctacatggggattgtttggtatttatcctgattggtatttattagtatttattatattattgtatttattggtatttatcctgagctttctggatgtgggtttgatacctgtcttttattttggaaaattctcagtcattattgcttgaagtatttcttctgtttctgtctctttttcttctcctattggtactctgaaaatacgtatattaacatcttttgtaattgttcaccagttcctgaatattctactccatgtttgtcattctttttttctctttgcatttcagtttcccacattttttttgacatgtatttaagcttactggttctttcctcactcttgttcaatctactggtgaaccctttaaaagtagtcttcatttctgctacagtgtttttgatttctagtgttttctctgtatactctcttgcagttttcatctgcctgctactattacccatctgttcttaggtgctgtctgttttttatattagagcccttatcatattaattataattattttaaatttagttttatgtttcttttttgtttgtttctgagatggagtctcgctctgtcacccaggctggagtgcagtggcacgatctcggctcactgcagtcttcacctcccaggttcaagtgagcctcgtgcctcagcttctggagtagctgggactacaggagtacagcaccacacttggctagtttttgtatttttagtagagatagggtttctccatgttggccaagctggtcttgaactcctgacctcaggtgatctacccacctcggcctcccaaagtgctgggattacaggtgtgagctaccgcacttggcctacagtcttatatttctacaatgtctgccttacctacatttgattctgatgctccttttttctcttcagactgtgtttattgccttttaatatgccttgtagttcattgttgaaagctagcggtgatgttcagatgaaaggaactgagtgaaacaggtctttaatgtgaggttttgtgttgaactggctaggagctaggctgtgcttagtttgctgtagctgtcattgtctgactctaaaattttctctggcatcattgtttatgtgctcagattttaccatttcttgttaaataagacttgagacttgcagttctttctgttgtaatcccctcagtattggccatagtagcatgcttctgttcttgggctttggcccttgttaatttcttattctctgtattcatgtctctgtagtgtttgagggagcagattttcctctgacttcagttctctgttgaatataataaaatgtgtggattttacacttgttcagcttttttctttttgtcagggtggatgtaatgacttcaagctttttatgtgttggaccagaaactggaatcctgtatcagtcacttttttatctcttggctttaggttctctatttctaaaataaaaggtaacatcactagttggtggctaaatgctcatctagctctagcattctgttcaatccttaagtactgactttcatgaatgaatatcccaatatgtaatgtttgttttccttcttctacaggcagacctacaggtggacaaggagaggcacaattttttcgagtcctctcttgattatgtttatcaaatccaggaagttcaggagtccaagaagttcaatattgtggagcctgtaagttttctctgttgatgaatggtctaaaaatatttatcaaatgcctggtaaatgtacaaactttgatcataaaaacagaatcccaaagaacgtgaaggataatcagtggaaatgtctagaacgtagtctaacttacgtttttcttgttctttagtatactttttttctctctttccccccaacccttttctctctttttctatggctattttctttctctttcctttttttcctttctctttcctccccccttccggaatttctctacaactcttcctgttactttgtttccctcccttccttcttcttgcgctttcagaagcttctgaaagtctttctcatataccagatactatgctagggactcatgtctcttgcagtcagtgacttctcattctactacttttacttctgtcttgtgtagttttttcccatttcacgttttttcattccatttacttcgttttgtgtagatttttccatttccatatatttgtttgagacagggtctcactgtcacccaaactggagtgcagtggtgctatctacaacctctgtctcctgggctcaagtgatcctcccacctcagcctcctgagtaactgggactacaggtgcatgcctccataccgagctaatattttgtatgtttttgtagagataaggtttcaccatgttgcccaggctggtctccaactcccgggcccaagtgatccccctgccttggcttcccaaagtgccaggattacaggcatgagctaccatacccagcccgtgtatttgatttttaatggggttgaaaatttacaccaatatatgttgtgtatcatttatatgtctttttctgcaaccctgtgaaacatttctaattttaaagttggtttagactcctttgatcttttagcattatgacagtcttcattaaagttaggtagaaaatcttgctttattcatttatctatttactttcattcattcaagaaatatttattgagcacctattgtttgtggttgctgaggatatatagaggaaagatgcagttcatttacatactgttcaaatgatgaatgtctttatatgagatctgaacaagctcagggttaataaatttgttaatagttctttttttctgaagctgagtcaagggtaaatgttcaacctgatatgaaaacagtgatgtgtagactggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtcatgctggttcttacagatgggcatgtaggcatagtgttcccatccttttcacatatattcctttacatgttcctttattcaacccacattaaacaaatgtttatggaaaaaatgaacataagctctgtgccaggcatgtgaaaggcactggacatgccatgaagatgcatgcaagtttttctgtcttgaaggaacatacagtttcttgtaggagacaaataaacagagataaattataatccattatgataagtgctataatagaatcaaggccaaaggtttttaaaaagttcagagcatttggctacctggtagagtcagagaaggcattactgagttggtgactttagaatgggtgttaaattgcatgaaatatatagatgtagttttagatgaaaaatgctggtaagttatagtgaaaataagccccccttggttgtttaggaggattgggatttacagttgttgttattattttttctttctatatactctccttgcagaaaggaactaggggctctcacattctccagaatttcctgatttacaacatcttcctactacaaccaagttaatcccatgaatcttcctctatatattacttgatatgtacaaatgtaacaataagcctttgaatgtgtacatatgggtgacttatttacaggataaacatgagccaactagatgggcagcacagatcacctttctcactaacatcatgtcataattttaagactgggtactaaaaacttatctgtagtgattttcatacccacatttcaacacatgtcttaccattgtgttttagttgtgtagatttaaatagatttattctcatcattaggttttggtatttgtgagtatgaaaacatagctactgttggcccttctcccaagagagcaccctctcgtatattttatgttcttggccagaatttgattcagtatcaactaggctgtaactttgagacacaatttggaagttgctatgagaatgctacctttgggaaccttgtctgccatctcccttgttgtaaagcagggtatcagtcatgttcagaattctaagattgcttatttattagggccttatgtgattcgtattagtaaaaagcctcccagttgttattttatgagtatattgctcgttatatttttgtttcctatgcagtctttaggaccgttagactctataaacttgttttccattcactatgccattcaccatttctttttttgctttgtggttgcacatgctgtaagcagggaaaactttgtactgagtctctgaccaagaaatactttttcatgataatgatgatgataataatgattttcatgatgatgtcttgacagacaagaaatcatttctccagtacccgggaagagatggaagaacttaagaaaaggatgaaagaagctccccagacatgcaaacttccaggacagccaactattgaaggctatctctatacacaagagaaatgtgtgtggggacataggggtatccattgggtttcaataagccaggaactactgccacttgtcggctgtgaattttgggcacccttactgttcatagacccctgatagctaaaattcccttggaacgcaggcagggaatactgaaaacaaaaaaaaaaaaaggagaaactgagaggaagttaaagatttgtcttacaaaggctgtgtagtgataagacctaaggttttctctgagattcaaaatgggtattatttgttctttaatccttctgattattcttttggaaaaaagggaagtagaggaaaggaagtagaaaaataatatttcttatacttattatgtaccagacatggtgctaagttcatttaaaacactgcctcatttaatctttgcaaccaatttatacccatacacataaggccactaaggctcagagacgtcaccatttgaaagtcacccaactaacaagtgtcaggactaaaattaaattcaggtctatgaaatgccaaagcccatgatcctactatagtaccctatgtcttcgtctgcattagggtcatatgtttgctcttttcttttctttttttaagacaggatcttgctctgttgtccaggttggagtgcaatggcaccatcatagctcactacagcctcatactcctgggctcaagcagccctcctacctcagcctcctgagtggctgcacctaaaggcacctaccactacacttggctaagttttgaattttttgtagagacaaggtctcactatgttgctcaggctcatggatgctcttatagcacttagtgaacatcatgattccagtgggaaagacagtatctgtttttcattggtgactaagtaaagtgggttaacttgtttagtcactgaatgttgcagagcattcaatctttcctaattcctcagtaacattatgcacacctgtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgatctcagtgctgttgacatttcaggctggataatttttagttctgggaagtggtcctgtgtattatagtatatttagaagcatccctggcctcctcactttgtgctcatagtaatctccaggtgtgacaacctaaaatgtctctaatgtattgccacatgtcccctgggaggccaaattacccctagttgagaaccactgctgtatgctgtgtgatccttctgtgcttcagtattctgatttgtcatatgggcataacattgctactcagttgaatgtatgcttaatgagcactgtttctgccagatactgtgcaatgcattggggacacccttgaaaaactgaatcaaccatgatttctttcaccaagaagtgtaaagtgatgggagagatagacaagtatatcaataattataatgaaatgtggtgataactgtatttggggcatatatctaaaggcttcacaaagaaagtgatatttgaactagaacttgaatgatgagtgggagtttgataggtaaagaaaaggaggaatggccgggcacagtggctcatgcctgtaatcccagcactttgggaggctgagacggcagatcactggaggtcaggagtttgagaccagcctggccaacatggtgaaaccccgtctctactaaaaatacaaaaattagctggatgtggtgatgcttgcctgtaatcctagctacttgggaggctgaggcaggggaatgacttgaacctgggaggtggagattttactcagccgagatggtgccattacactccagcctgggtgacagagtgagactctgtctcaaaaatgaataaaagaaagaaagaaagaatgaaagaaagaaaagaaaagaaagaaaggaaagaaaaaggaaagaaagaaaggaaagaaaggaaagaaagaaagagagagaaagaaagaaggaaaaggaggaagggaattccaggtatataccactgcatgagtaaaggcagggttgtggatagacatagttgatttgtagggcccttgtttgccaagaatagtcctgctttacccctgttgtcctgatgtaattattaataatactgcctcattcagtcttaaataagtcttggatttggactagaaattatatggctacctctttatgtgggaactaaaagtaattcattgagacaggaacatagaggtgaggtgccaaaagaaaaagctagaaaggtaagttttgatcatgttatcaagggcattgtaggcaggctaaggagtgtggagatagtgggaaagccgtggatggtttttaatgaggggaatgataaaaatagagatatattttaaaaataatctaggaaaagagtggagaatgaattggagtggagtgatcagagatggggacaatagggaaatcagagaaggccaatgaaataattaattggtgagatagtaaatttttgttttttaaaaatatgtttcataaaatataaatacaaaataagacactgggcccagcgctgtggctcatgcctgtaatcccagcactttgggaggctgaggcatgcagatcacgaggtcaggagatcaagaccatcctggctaacatggtgaaaccccatctctactaaaaaaaatacaaaaagttagccgggcgtggtggtgggtgcctgtagtcccagctacttgggaggctgaggcaggagaatggtgtgaactggggaggtggagcttgcagtgagctgagattgcgccactgcactccagcctgggtgacagaacgagactctgtcaaaaaaaaaaaaaaaattaaaacaaaaacaacactgatagggttcttaactaattcggtgttaaaaaggaatggagaggaggagacagttaaaagagagatgtgtagagtcatgtacaggttagaaggggcataacccaatgaccaatgacatggaacagttatagagacagcaaagtaaatgacaatagtctccagcttctgggatatatggtgatacaatttatagggaacatggcagggagagtaggttttgagcaagccagaagcagctgtgggaagcagttggtgaaggttagaatctccctgtgtgcagtaggtaggtggctatggaaggagggcggtcagggcaagggcagggctggatctgaagtttgactctgaagagcaatgtgtaaatagcttccatcttagggttgacttcctatacagctaaaatagttattctgtctgctcacttttacttgtccttgtaggggctttaggaatatcctgggtgaaatactattgccagtatgagaaagagaccaaaacactgaccatgacgcctatggagcagaagccaggtgctaagcaggtcagttcttgtttgcaccatatttttggaaatggatctatgactgtttctcagaaaagaatatatgttgacctagtatcaaatcatcaagttcatcactgttacgtgaggccatgactttatatgtacaccttggcctaagtttgagtcagatagcactgagttgagtgaaaaatttctctgttgattagagcaagccttttgaaagtgccggtagtctttcaaaccagttatttttacaagtgccagtcacattgtacagtcaactatgtaaaaatatggatgaattacttttaagaatgctctactcttggattctttaaaatagcaagttttaaaaatatgaattgaattccaaaattccttttttacaggagtgtgtttatggcccacagttggaataaccgatactcacattctatgtactactcaaatatctttaagcagttaatctctctttttctgccctccaaaccttctcttcacatcactgaaacactgacacagactaaactttaaccaccacttgaaacaaaactacgtttacattaaccttgagaaagacaccctgaatcctttatacgaaaacaacaacaacaacacaacagcacaacaacacaacaacacactcacacacactcacacacacagatacacacatgggggttccttaagataaaagctgatctttagacagattgtttatattctaaaagtagttcaatgtgcctctttcccctttaactggctctcagacagggtcttagtgcatgatttttaagcatttgcactctttacaaattgtttgttggaagtgcttcaagggttatttgttagcactgaaagtagtacatgaagacccaatttaggtagggaggaatttggagaaaaattgggacagtttctctcccttgctgatccttttcatggaagatctctcttgtgtggcttgctcatgttgaattagagaggatggaaatgtgctttcaggctactgaaatttttttggagtgagagtggtcttttaaccacaagatttagctccctgctttaatgtgctttggtgatgggatggacttgtaaaagatgttgtatcaaacagagtttctggaatcctcggctatgctttattattattgttattattattattattatttgcgatggagcttcactcttgtcgcccaggctggagtgcaatggcacaatctcggctcacagcaacctccacctcccgggttcaagcgattctcctgcctcagcctcttgagcagctggtattacaggtgtgcaccaccacacccagctaatttttgtatttttagtagagatggagtttcaccatgttggctaggctgatctcgaattcccgacctcaggtgatcctcccgccttggcctcccaaattgctgggattacacgtgtgagccacggtgccagttactgtgcttttatcatgggccagttactcattcaaaaccctcctcagtttccagtccgccagttgccaaagcacctttcagtgtggttccaataaattcatcctgtgttttagcactgatttgttccaagtcagtcagaacttagctgattaatctgactaggaagtgcttataagcaacactggcctgcagtctctttcttttatttttctacacacattacttttcaaataccggagaggaaagctccttttgtaggcagtaatttcatttaggcactttctctgaggctgctcagaggtgcttattgcaaactccaagacagagtcagcagataccactttcatatcctcctgacagatgccagcaagccctccttttagtttttctttccctcttctcttttcattgagtagctgcttgcaaaactgcaatggtggtggcctgagcatttttgatgtggtattccttatggaatggaaagaagaacttagttactcacaaggcagagggaggtggtgggggttacttggatttccccaaattggagttggaagtgatttcttcctgtcagttctctgtttcacttcttaatactagtttgtattttacaattataaattttacaaataaatgataccataataataagaacactacaaaagccactatttcttgaatacctgctgtgtgccggacactgagctagacccttctgtcatattcatgctcctcatttaccctcctagcagctatgtgaagtcagtgcccccaatttgtgtaggaagtgagaccaagttgaagatgcaggaattggccatctttctgactatggcacttactatagcgttggtcccactactttagcctgtcagctctcatctgtgttttcatggtcaattttctgatcatcttctcaaatgataatttattagatcttcatcccttccctgttaggaatttgtggtcagaagaaggagtactgcattctgaatcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgtagaataagtaagagtttagtcaggcaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaggtccctgagctgcaatgtcattgaagctgaggacattgagaatttaaagagatagagtgagtctgtgactttgctcataactctcattttgaaagactaatgtgtgacatcccacatttaggggtaggaaggcatactgaaggattaatttagagttgagttgttacagtgcaggagcaaggaaagattggcctgcaagtggctgagtatgctgatgagcaagaagtattgggtaatgagccacgtgggccagtttgtatgtcatagtatctaggcacctgggcagtgttacctaacttgagataccacagtgggttttgttattcccatttaatagattgtgaagttaagacttagagatggaatatgatttatttatttatttatttttgagacagaatctcactttgtcacccaggctggagtgcagtggcacgatcttggcgcactgcagcctctgcctcccggtttcaagcgattctcctgcctcagcctcccaagtagctgggattacaggcgcccaccactgtgcctaatttttgtatttttagtagagacggggttttgccatgttgaccaggctggtctccaactcctgacctcaggtgatccacctgccttggcctcccaaagtgctgggattacaggcatgacctgctgtgttttggccagggtcacatagctggtaaatggcataactgagacaagaccctaggtcttaaactttctagtgtgttgctatttccactataccaatttggatgactttgggtatgctgctttacttctttaagtgtcacttctctataatggttgttaacaataaaagtggcttaaaaatacctagcataggctggacacagtggctcacgcctgtaatcccagcactttgggaggctgaggtgggtgggtcacgaggtcaggagttcgagaccaccctgaccaacatggtgaaatcccgtctctactaaaaatacaaaaattagccgggcatggtgcgcacctgtaatcccagctactcaggaggctgaggcaggagaatcgcttgaacccgggaggcggaggttgcagtgagctgatatcgcactactgtattctagtctgagtgacagagcaagactacgtctcaaaaaaaaaaaaatgtagcgtaatatatggcacatagtaagtgataaatgttacttctctttcctgtatcacatggtctctgttgagataagagagggaatctgaacaaggtgagactagaattttagtctgtggacacagtgggttttaattcccttaattacctacaggactaaagtgggccacactgtccttgctgcacatatgaaatatcaaatgctaccatgactaatacacacatttgctatttcctctacttttgcgctacctttggagcgattacatttgtgatttctgtcatcctaaagagtgtagagttgggagacagaaatgtttttctccctccttcatctgccactttaatggaagcttctttgctcagctaccctctgactttctaagggaggttttagacagccacttaccccgtcacaatttccctccccagaggcctcatgaaaattttattctgtacacttaatgccattcagtcagcccatttctcctacactccccttacatgatatgtattgagcttcctattaagtcttccgtcttgggaaagagtgctggatgactctgaacaatttctcctggtctcagccattgattcttggagcggggagaaaccatctgccatcttgctgcaaatactgtttgaagggacaagattctcagtgagtctacacattgctcctgctgccttgaccagacgccttccaagtgacactgaagacactgtaggaagcagaaacagcttctgtgtctttttttaaaaattgcctgttaattcttgtttcatatcaggggcccttggacttaacactgaagtactgtgtgagaaggaagacggagtctatcgacaagaggttctgttttgacatagaaactaatgaaaggtaagctgtgccgctgtgaattggcaatgtccccacgtgccagatgcttagcctgggtaggtcttttattttcctccgtcatcccacgttgatgacaatgagtaagtctattcaggactttgttgtgagtctattcaagccagctcttctggctgcccttcccagggatccctgctagacctggcccagtgctgcttttctctgtgcaagcttctatcagctttgcctcacttgctctgggaagaaaaagtctctcctgggatttaatttgctatcagatgtgcaaaaggtcaacatttggtgatcttgcaagaaggaaaggataacaaagctcattctttgttaaatctcctaatatcacataaaagaacaaatgaattggcacacatttttgagggagggaagatggggtggagggtcgtggtgttattagaaagtcatttccccccatttggtgcaaaaatgatgcagaccttccctactttacagatactcaatgaactggaaatagtgtgattatcacctttcagatcttacagctaaggcttgcacattttggacttcgttgtgtttgtttctccccagtgccctctttttttacttgaacctgagcagttttatcagaggagaattttaaccattaaaatttcaaatgaatgcatttggcattattgtggagaaagacatgctttatagttgggtggttgtaccaaaataaacagaataaatctgtttctagattttatctcaaccttttatttctagatgttagatacttagtaatagaatagaattttgcaaaatgatcagattgctagaaaggaacttgaagggtgaattacaatatcatgtgaacaaaactagcagtgactgggatcataacaatcagactaaatgatgagggcatttttaaaaaaattggggaataaaggacttagcttgtttccttatttcaaaattgagagattattatttgaccctcacaatttcgatttgtgaatttatatcatttctttgttaaaaatggatgatcccaattgaggtggctctgaaagtacgtattgttgccagtaaccatgagactgtcactcattttcctgatagcctcagttccagtaggaaggggaaaattattgttggctgtggcttcccttttttgcaaataatatccccaactcaagcagttgcaaacagtttgtccccgtggttaggggctaggatgaatttatgtttcttgtacctggtgctatgcatggctcatgataagtactaaatttgatgtttatttttaagtgtttttttcttatcctagaatgctgaagaattttcgacactagaacccagggattaaagttttgatgcatctacacttttagttatcatatactgtgcactttacaaaacattccctcatttaatctacaccccccccattttaccagtgaggaaactgagacccacatatatttaactgacttgcccaactaaagtcacataggaaatggtgaggctgagctcaaaccctggtctgtaggtctccaaagcccatgctggtttctttttgtttgttttgagatggtgtctctctctcttgcccaggctggagtgcagtgttgcacaacctctacctcctgggctcaaacgagtctcctgcctcagcctcctgagtagctgggactacaggcgtgtgccaccatgtccagctaatttttgtatttttaatagaaatggggtttcaccatgttggccaggcttgacttgaactcctggcctcaagacatccacctgcctcggcctcccagagtgctgggattataggcgtgagccactatgcctggctccatgctgtttttaattttttatattgtctattataagcagaagaaacaagctgcaaagtagagcgttaaatataataatgaacaggtgctgaggcccctctctgcatgtggagtcttttgagtgacatgacatctgcttttctggctagtcagtctgatataaggaacagagtcaggcttcctagcaggcatcaggcagctgtactcacattccctggagcacagagcaaagggctcttggagccactttttctatgtcaggaagagaggataagattttttatttttttaacttttaattttttagagagagggtcttactctgttgcccaggttggtttgcagtggcacaggttcaagtgatcctcttgcgtgagcctcctgagtagctgggactgacaggtgtgcaccaccatatctggctaattttttattttttatagctatgggaccttgctatgttgcccaggctggtcttcaactcctggcttgcagtgattctcctgtgccagcctcccaaagtgctcatattacaggtgtgagtcactgcacctggttctaaatttaggctcttagcagtatttaaaatgacaggctcatagcaaggcagagcttgaaatgttttaataacagcaacaacaataattgtaataataataaaaacaattgctaacatttgccaagtacctcctttgtgacaggcactgttatcagccatttaagcgtataatttcctttagtcgtcaccacagtcacatgagggaggtgatgttatttgaattttggtttgtgaatctgtatcatttttgtgttaacaatggatgaccccattcaagatggctgtggaagtatatattgttgccagtaaccacaagactgtcattaagaggtgctttaatgaagtaagagaaggtaggacaggaaccccatgattccagcaggtagaacaggattcctgtgatatcagtaatggaaaggacctcccagctcctgtgttccagaaccctttcagataaagaaactgaggtctagaaaggcctagttacttatccagggtggctgaactctcttggcattgcttttatcattctatgactctaggagaggtctcatcttatcacagaatttgtggaaggaacaatgttttcctaatggctcagcaagccaggagaatgcaaggagactttataccttgcataaagtatggttaatctcaaaattccagatgagtcacaaagatctaaaaagaccataaagagcataacagcttgggatatctctgggtagttagtagtgtcttagtccatttgtgatgttatgacaaaatacctgagactcagtaatgtataaacaacagaaattcatttgtcacatttctagaagctggaagtccaagcagtttcagtgtctggtgagggcctggtctctgtttccaagatggcatcttgttgcagtgccctccagagagcaccaacaccgtgtcctcatatgtcagaagagatggaagggaatgaacctactctttcaagtttttgtaaaagggccctaatcccattcatgaggttctacccttatgactaactcacctcctaaaggtcccatttcttaatatcatcacattggtagttaactttcaacctatgaattttggggaatattcagaccacagcaggtagcctgcaaataaatagaataaaacagggttcgaagccgtgtgccaggcagaagaggccttatattgtagtaatgaagaatatggctgctggaccagactttctggatttaattcctgtctctagtagttccctgctatatgaccttggataattactctgtgcctcagtttccccttctgtgaaatagagatgattactgtaactgccttattatatatattaactgagttaatatacatagtttacttggaacaaaatttgtcacctagtaagcattcagtaaatattagttgtttttattagtcataaaattgcttattagccaaaacgcctcctccctgtgtcttagccagtactcatgttgttgaatttattgcaactcaaaatgtttcttggacatcgcaggtgctggaagaagcaaagccattttactgagagataatgtgcctctgatgttcatgctcattcctagagctcagacaaagtggctggcttccaacagagtaaggcagtgagagcctttgtttggttcaagcacaatggggccaatttaagtgtgcattatggaggcgtcttgacagttaccttcctatttcttgcaggatctgggcacaaggccaccaagataccacccccgcctccatggttcccaaagttactgttctgtaaattgcctattgttttcttgagtaaaagagattttgaaaaattagtattctgtaagcctatgcttgttcagtgtgacaaactccagggcagagagggaccctagatcacaagactccattctctcagttgaattttctgctttatacttaccatttttttccccctcaggccaggaaccatcactctgcaggccctttcagaagctaacagaaggctatggatggaagccatggatgggaaagaacctgtaagttacctgacactggggaaacctccccagcatatgccagtgtatgagtgccctctagtggtatcagtgggtctcagacaattaaatggtaatggattgtttagtctcagttttagagctgtaaggaattgtttccacatctcttagcaggtaaggcaactggagttccagaaaggttgagggacttttctgagaccaccctcagagaagacaccaaaaccgggcttagaatgcagatctctcagctccctgctctagtgttagactatgtagctatgcccatgagcttttcttcagaaagaatgaagccatttttcaggttataaaatcaatatgtgttaattaattaatatgtgttaatatgaaaaataattgccatagttataaataagcacttattaaacatttattcagaatgatttttctgcctcacccttataccaccaactcagcttattctctttgagggtacagctggtagcggagatggcattgccatcctgtatcacaagatgtaccgttccatttagaacacggttatgcaggaggacaagcaatcccttgaaagggttactgattatcatcaagcgaccaatagaaacagttggaaataattgaaaaacattctggtttcttagtggcatattaaataatatcagcttcctggtgttggaattccaaaagcttggatataggtactagttctgccattaaatggctatgtgactctgggcaaatcatttcacctctctgagattcagttttcttctcctcagtaaaagggctttaataatttctttctacctatctcacagggttgcttagaaaaaacagatggaagtcatcttgtaaaccacaatgtgctagccgatctgaatgatgggatacaaaactcctaagatccagcagtgttcagatacagtcttatttctttgctgtattcaagtgaaaaactggctaggagggaaaatgcattctaggtttttctttctatgtgtcctcagtatcctggagaatttagaggggtaactagatcccagattgcacttatagtaaactggaaggtagcaggagagacttggtattctgaagactgccatccagaaaatattccagcactgtcttccttctgtcaccttccagaaacctgctgctgaactctttcatgcttgtgacatttctgtaggcagatgctgggaagctcagcaaggcatttatctttcaattccctctcccaagtttgctctccctttaggttttcaagaatcaaaggatgcagatggctttctgtggagaatgatgtgagcacatgggcccactgaatgtggatccataccaacttgatcatggcagatttttccacaaatcccttgtttagaaaagtagcagaaaaggctggctggcacaaaaatatctcccactgaaatatctgtgggcatacacacatatgcagaacttattttaaggagaggctgttcaaacagactcttaacagatggcatatagagggctcatttcctgcaacctcacattactaatgttgttgctcctttactaaacactccagttcactagtcttacaaatctcatccatgcctttgcctaaactgtcaaagaagatcagggcttgaaggaatgtctactccaaccctgatcactttactgatataaattttgagatctggagaatggaaagggcatgcccaaaatttcctaagaggtagaggtagagccaggactagacttcaagagtcaacagtcttctttctggtctctcacatagctatcacagcacatactccaagacaacacagacaaatcttggtgtattcatggatctctttcagatggacatttgcctttccacagagaagtattcatcaaccagtctttgagggtgggagattggtgttaggaacatttaaattttataatgcccattagacaggtacatagccatgaggaaaacactttcctggtctcttgctttatcataaaaatgccccaggtgttacataagtaaatatctaagatggattagctaaaactgtagctatggtgaactgtgtgaaattcagtgtaattttcagggattgttcaagtattttctttctttctttcttccttccttccttccttccttccttccttccttccttccttccttccttccttccttccttccttcctttctttctctctctctctttctttctttcttttttttttgacagagtctcgctctgttgcccaggttggagtgcagtggtgtgatctcagctcactgcagcctccacctcctgggttcaagagattctcctgactcaacctcccaaacagctgggattacaggtgcacgccaccatgcctggctaatttttggatttttgtagagatggggtttcatgatgtttgccaggctggtcttaaactcctgacctcaagtgatctgcctgccttggcctcccaaattgctgggattacaggcatgagccaccacgcctggcctgttcaagtattttctagcaatcttggcaaagcaattatgtttagcccacttggctatctttttaacatcctggagtttctaatcatttttaatgcctatctggggaaagatatttaatattatgttctctgttttcctatattgattgacaatagccatggatctttctgtttatcttcttttgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagacacttggtgttagcttacatcgtgggtagagaaacatatccttcctgttctggaagcatgatagaaattgtatttttaggctaacatttcacatatgactttgctcatgctgaaagcagacaattcaaagggctaaatataagtattttgtgttataagagttaaaatgttaaacctcccctgaaaaaatgactctttccatttaagggtgactagaaatgagcaactaaaaacccttagctctctcaatgcagtccctttgcatggtcattaaatgtttaataggtgacacctgttgcagcaggatctaactcttttcctttgcttgaaacagtggagctaaatgaagtgggcttcaagtttgtcaggaagtgcatcaatattattgagaccaaaggtaagatctgaaccatagtcttggcattgtctgaatctcgtcactctgattttatcctgggcaatttctctgaagtagcgttttaggaatgaagactgtttataaagcttgtgtagtagatgcaagctagaaaatttcagaaaattctaaactagtggtatgcaagcatatttggataatttggattcctgcttttaaagagcttataagtttataaagtattctcaaacagtacctggcactccttaagcagtgtcatgatggttctatcctaaatgatcaagagttcaatttctgccacagtacatactggtatgaaaattgatggggcagagccaaactcagggagatgtggaatcagcattcttcctggttgccgatactccctggtttccttctgaggatatttagactgtgggcaagtgtggtatgtgaatcaagtctctttgttctttgaaatgtttttttagtctttcttggtgcaggaaatggccttttgtttcacagctgccttactccagccctctcgtgatttatatcactgcttagaagcaacttgagggttgatccttcctcctttttcaattgaatgaacttctttctaagatggcagcaccattctcagctttctgctgccgcccaaactaagcatatgcttctatttactatagagtttgttttcttctcttcagattaatgagggtttggtacactccaaatgaaaggatggataatttggagagatgctgtaggactattcccctgttacagggaaggctggagaacttggagtatgtagtgtgaccccttcctatctgaattgactctagtgtaccaaggggagatgacaactctagctatacaagtgaaattaacctgattttttcctccactagggatcaagacagaagggttgtaccgcactgtgggcagcaatattcaggttcagaagctgctgaatgccttttttggtaacaattttactttgataattcttattgggagtactttatgtgttacaaagaaatgtgactggaagagaaaggagacactgctaaaatgtggtagaatagttgaaaaaagtattttctaaagtaaaacatacacatacttgcccaccctgggcagagtcaatcgtaccttgaaaatggctgttatctctccttcctcgtatcccattcactccagaaaccctcagcaatacaacttctttccctacatctcaactggaactgtgtggccaggcttagtcggtatcttcttaccaaatccagtgaatacttttgagtttgtgtcttacttgatctccttgttgaccactttctcttttttgaaactttctccttacatgacttcgtgacttccataacacatcagcactcttctgattcttctcacatctttttttttttttttttgagacagggtctagctctgtcgcctaggctggagtgcagtggcatgatcatggctcactgcatcctcaacctgagcctcctgggtagctgggactataggcgtgtgccactacaccaggctgatttttaatttttttgtagtgatggggtctcactatattgcctaggctggtcttgaacttctggccttcaatcatcctcttgcctttgcctcccaaagtgctgggattacaggcatgagccacaatgcctgacctcttctaacatcttataggattccttttcaataacttgctgaacctttatctttctgttttttacaccttgactgtgtgtttcctacagttctatctttgttcttggtttacttctttttttttaatatgtttttctattgattgatttttttttattctggttatggctcacatttttgtttcttaaaaaacatttcttgtaatctttattggttgctggatgttgtgacttactgaatgtcttgattttgttgatttcttttaaagaggactgaattttgttttgtgggcagttatttgtggatcaatttgatttatttgagtcttctttttaagctttgttgggccagatataaagtatccacccccaggtaaggttgttgagctctttttccacatagctcactcttctctggtactgtgccttgctagttatagctgcttcaaccttcctaaactttgatccttatctcttcagctgagcaagacttccatgctcagcttgagttcccactccatctgctgcaatctaaaaagtgcttttaagaagcaagctgtggagaaggtagcagttatcttgtttgtatccctcttctcagagtcatagtcctgttttgtctgttgctcaataactacatgcaggagtttcctatatactgtccagttttctagttgttacagcaggaaggcaagtctgataccagttagtccaccatggctggcagtggtattctctctttatgctttttactagcacctctatgctgacaactcacaaaatctctgttccagacatcatctgatgagttctaaatgcaaatattcacttgcccactgcacttgtgcttctcagtcatattaaggtcatggcacatatcagaatgatcatctttatatagcatgctcgggtaaatggacatcactgaggcaagaagccctaaaggctgagggagtcaatattggagtctctgcacaagctctctttacatagatggttcacaggtatctacctgcatttctctccctgcaaacctacccttcttcctttcgtgggtggcagtgaagcatcttgtaagctgagttttcacagtgtcagagaacaaattgagtgtggaaaactgcagtttggataaaatacatattttttggtccttactgtgatgcatagctaatctctcacaagcctgcaggtctgacaaccaaccctactcacatttgaggatgttacagcactcagtcatagcaggtgtggtttttgaattccagattacatcattagtacctcatcatctgttttcattaatcaccttacattcttgacttttaaaaatttggattgcttattcctggtcaatttgcaacccatctcattagctaaggacactttttcatatgtaaatcagctgacatcgtggtccagcatattgaatctctgaaaaattattgaactcagatatttattcagataactattgaactattgaaaattctgtttccagtatcactcttatatctgttgtataataagctaaaaaatgccatgccaggcatcccactgattctcttatgggctttaataggactgaagtggctccttcaaatcacacacggcagtagaatttgattcaagtattaaggaaagtggtagagttggtgtatttcatttattcaaaaccatcctccaaatattaactctcataggaatatctaaaatatagaccaggaagttctagatataaatattgatagatgcaatataaaactgttaacttccttatttgtatatgaaagtggcaaccccgatccctgccccaaatgtatgaaactccagatgtggtgatgatcctcattcatttattcattgagcaaatatttgtgtgcctacccgggcatcaatcattgtgtttagggcagtggattgaaaagtgaacatattccctgtgttttccacctttgtggggcttacattctactgggaaactgtctctcagttacctttcaatgtctagttatgtggggagaccttccttctaagtttatttcatgtgatgtcctctggcgtgtctcactgggatcctcaaagctgtcttgcttcttttcaccctttcctgatctagtctcataccactaggggcttgttgccttggctgcatgtggacccatcatgatttatcctggagggtgaacatccattgccttttggttacgtaacatctctccctctttttttttttcttatgtctcatgctctgtgctagtcaaaaggatacttcttgttatttttttttacctaaacaaccctcagacttctttccctatgacatctcctataacttgtaactgtaggctttcttctatcgtttactaaagccttttcttcttcccctagacaaaagtttgtctttttgggaaataaaatatatcacagagtataaagtcaaaggcaatacattcataatcaatagttattttcaatcacgctgttggttggttggtcacattccttgcctacaccagatttttgtatgatgctttatgttaataggttttatgtgaggattagaatcttcactggtgctggatccattgtaagccaccttggcacagagaagccaatctgattatctcagggacaacttggaacctcgtgtaagagttctgtttcagaaggggaacatcacacactggggcctgttgtggggttgggggaggtgggagggatagcattaggagatatacctaatgtaaatgatgagttaatgggtgcagcacaccaagatggcacatgtatacatatgtaacaaacctgcacgttgtgcacatgtaccctagaacttaaagtataaaaaaaaaattaaaaaaaagtttaaatcataaaaaaagagttctgtttctctttcctttatcaagctataactatcttattaatgaaaatgccccccattgtcattatagtcttaataatcatgttgtgctccagagactcttaagtatttcacaatggagcagatgggtgagatggggcatggacagcaatgagactggttgtatcagcaggggctcttgatagagttgagcctggttggcagccataaacaggaaagtgttgttctcacaatccccttaccatgccagaggcctatggatctaaacagaagaggacctgctgtaacgagtgaagtaacaagtcacttgtaagatgttatttatgttattttcatttcctgtttagatatttaaatttcttatttcatcattatggcattagaataagatacgtggacttctcagaaactaagtggaatacctaatatatatagacagataatagagtaggaatatgcatacagtcatttttccattttcataattaatgtgaattattcagcatctggagacttaactttagcattaaattcacatatattcggacaaatagataataaatacattaatcagaaatactttcaagttatgtgacctctttgtttgaatgagaaattcagagtcccctagcaaataaaacaaaaatataccacactccacttcaggagttgcagaacttgaactctatatgttaatctttaaagcaactgtatatgttaaccgtttttctgatactgtcgtatgatgtgatctttagctttccatacatatcaagatactttattcataaagccagatccttgtatatgtgtgtatatgtatacatgtatgtcataaatagattttatataggttcattaatcattactatacttactactttaaatacattgattattctcaaatcatgcttgctttgaaatagtaccactagagtttgaagtaatttatcaatggatatttactgttaccctttccaaattatttcctatttgcatttgactatgaaactgagttcaaaaacttttagaaataaagtttgtgatatgaatatttgttccttttctattattttctcaatatgtgaataattgatagcaaattcatctttagttctcacctgacataatgccatttcctagcattcttgtaagtatgtaaacagtaggataggaatttttctcttaaaggtattttaacttagcaaaaataatttcagttgttgacatatgaatctagcaatgctgttatcccacctgcttcctgctgcagggtttctgacttggggagagtctttcagctatgtcaccatgaatgaagatccaggggattgtttgtattagtttcctagtgctgctgtagtaaattatcacaaatttaatggcttaaaacaatacatatttggctgggcacggtggctcacacctgtaatccccgcactttgggaggccaaggcgggcggatcacgaggtcaggagatcgagaccatcctggctaacatggtgaaaccccatctctactaaaaatacaaaaaattagccgggtgtggtggcgggcacctgtagtcccagctaatcgggaggctgaggcaggagaatggcgtgaacctgggaggcagagcttgcagtgagctgagatggcaccactgcactccagcctgggcgacagagcaagactccacctcaaacaagcaaacaaacaaacaaacaaacaaaaaaccaatacgaatttatcctcttatagttctggaggtcagtagcctaaaatcattcttctggagctaaaatcaaggtgtcagcaaggctactttttttttttttttggagaagacagtctgttcccttaccttttcagcttctagaactttccttgtctcatggtccactttaacaacaccaggcagagtccctctcatgctgccatcactctggttctttctcttctgccttcctcttctgctttaaaggacccttgtgattacattcattccacccagatcatcagaataatcttcctatctcaaggtcatctgattagtgaccttaaacctatctgtaaccttaattctcctttggcatgtgacttaacatattcccaggttcctgatattagtatgtggacacctttgggaaccagaaatctgcctactacatacactattccattcagagttttaggacactccctctgatgctgttaagtggaccccgaggtcattcttgattcttcctttttggaatctgtggtaagacctttaggcagtggttatcttattgacttatgactcattgtgacgttctcacttacttcctcaaaaggagcagaaataaattcctttcattggcatatgacatctgttagggagtgaatgtttgtacttcctcccccatttatatgttgaaagtgactccccagtattggtattggttttggaggtggggcctttgtggagtaatttgggttgaataagatcataaggatggggccttcatgaatgggataaatacccttataagaaggtgccagagggctagcttactctctttacaccatatgaagatgtaacctggaaaaggtccctcatcagaacccaaccatactggcacccttatcttagactttcagcttctagagctgtgacaaataaatttctgttgtttataagccactcagtctctggtaatttgttatagtagcctgaaatgactaagataccatgttttccaagatgtctcagctctttgccagccagagtatcatttacacttttctctggagaaacttgttctgtactcagtctgttcactttttttcctatggcacttctttttgccactagcttttttttttttttactgtaatattgtcaaacatgctgtatcccagagccagtttcaggtgatctgcctgaaatggattgtggacccagagcaaccaatttaccctcttgatttctgttggtaatactaggatccccagagcccccattttgagccaggttaggcagatgaactatgccctgagcatctcttatgtcctgcagtgttcattctttcattcattcaacatagtaatcttgagtacctcctaagtgccagatattgtatcaagtggtagggatgtaacagtgaagaatggggaaagaaatcaccagcctcctgcaacttagtgtctagcagcagctatagttcatagatacagtcacatatttttctcccaaaataaactctggaatatcccagatttgggattctgttgatcctcactggcagcataaggacatgaagcagtataggcaactggaaaagagaaaccatagtcttccccttggaaaaaagcagcctatttcttaaaccaagatctttcaccatcttaatgtaaagcatataaggagaatatattaactttgggagactgtaacagttttcctttttctgatgtgtaatgtataccttatttcatctgcttgaactccattggctttcaattttttccaggtcttattgtttatcttctgccttgcctcatgatcccctttctccttttctttagccttgtcttacagctctctctctcattcactgattcacacaacatttattcactgcatacgctagtgtttagggctactgcttacctccctttctctttttttttctcttattcttcacatatctcctttgcctcctattctgacatgcttatactatgactagcaacccgctttcataaaatcttttctatgagcatacattggaacccttctagatacaagtagccagacaaggtgatcataaatgaaagactagtcttccctatatcaaatgtagctgtcatctgggaaaactgcatttacaaaatgcccaggtgggtagtacatgctctgacatttctctgtccatgtttctttactagatgcctggatctctaggaatctggtattcagcatagtggatgacacgtaggaaatatttgtggaattaatgaatactttttgtgatgcatgtctcttcctagagaatgtttgtttttctcaaaaacatgagccattccatacatggttgtattttgttatgctactgcacagagtttctgttgtatgtagtttcacaaaatatagcttttgttaatctctgcagatagtattaggaccaccaagttatctgaactgacatgtaattaatatttgcaaataacgataataagcagcaaatcagtaggattttcccatgggaagccatatttctcaaagatttctacatcctagtcagaggtgattcttcatttaaactgtgtagatgataatgggcaaagggaaattgtagcttcttttctctgttggagggcatgttttatttcttcttgttgttgccttcatcttttccccagtgcttcctgtgttgaccagatgatcacatccagctttaaaaccattcatggggatagtggctcaagccggtaatcccagcactttgggagaccgagacgggcagatcacttgaggtcaggagttcaagaccagcctggccaacatggtgaaaccccatctctactaaaaatacaaaattagccaggcatggtggtgggcgcctgtaatcccagctactctggaggctgaggcaggagaatcgcttgaacctgggaggcggaggttgcagtgagccaagatcatgccattgcactccagcctgggcaacaacagtaagactctctcaaaacaaaacaaaacaaatcaaaacaaaaacatttgtatctgaatacagtgttgatccatcttcccaccccttccttttttttttttttcttttgagacggagtctcgctctgtcacccaggccggagtgcagtgacgtgatctcagctcaccacagcctccgcctcctgggtttaagcgattctcctgcctcagcctcccaagcagctgggattacaagcatgtgccaccacacctggctaatttttgtatttttagtagagacagggtttcaccatgttggccaggctggtctcgaactcttgacctcaggtgatctgccagcctcggcctcccaaagtgctgggattacaggcatgagccacagcgcccggccccattcctctttttgactcattgccttttattttttttattactattatactttaagttttagggtacatgtgcacaacgtgcaggtttgttacatatgtatacatgtgccatgttggtgtgctgcacccattaacttgtcatttagcattaggtatatcttctgatgctatccctcccccctccgactcattgccttttaaagcatgctgtggtctccctctagtggagaaattgccatttcagaaagaaaaaaattcacagcctagagtcaggttatatttgttatgcctttatatttgaacaccttgtaaattgctgcttatcagtcaattttctgtttaggtgttgtagagtaaaaaacaatttttcttcaactctcgtaagttcttagtcagaacatacccttgtaacaaaagacaagattagtaggagaaaacaagctaattaatacgtatatttcatgcatacatgggggatacccaggaaatgagtaattctcaaagaggtagctttaaatttcaggttatagatcaccttcaacaaagaatagtaattttttaattgtattttttttaaagatgtgacaagacaaagtaaaaggactttgaatctctagtggcagcaacatctgggaagccaaataaatgagagatgacagctagttagtaaggcttgtttatataaattcctctgctaccatttctaggccaataagtgtctaaagttgtctttagtggttaacctttttaacctttgttctccctggtagaaaggggtgttgggttgggataccttcgtctttgtaaatctatgttctgcttttaggcaaatagagggagggcagagagctttcctgtacctgctgcttcttaattttcttcaggtcaacaattctttgtattttggggtggcatattatgaccttccatagtattgtatcttctgaagccaaacctcatcttactcaaaacagttaatcacctcctcttctctaccagttatgtacttagtgtaatttatattattgtagatttcttgctgttatgtagttacttctgggtatatctgttctgcttcacacttcagcatcttgagtagaatttcttaatcttgattgacaatcctatccagaatttccagaatgtttagtttaatggagtgttattatgggcctttgtattttccatgtccctctgaaattcctggaaatgtctgaaatttggaacagatactgttgtcagcaagttacctgaatggatatgtaaaaagcaggggtggcagagcttcttgggcagagcctctgttttttctttttctttttatcttttgacagagtctcactctgttgcccaggctggagtgcagtgacacaatcttggctcattgcaacctctgactcccgggttcaagcgatccttgtgcctcaacctccagagtagctgggactacaggcacccgccaccaggcctggataatttttgtattttttggtagaaacagggttttaccatgctggccaggctggtctggaactcctaacctcaagtgatccgcccatcttggcctcccaaagtgctgggattacaggcgtgagccactgcgcccggccagaccctctgttttcaacaacttcagtatttccatggagttccctaggcccattcattatcttttcacagcctcagcttggtgctcttatctctgggtaccttttagacattaacaacccatacctcttagatttctgaaaaggccaaaggaagatcttgtagttccacttctttgtttcttatgagtctttcttctccctccttccctcccttcctcccttcccctctctctttctctctgtctctctctcattatcctcttactcttcagagtcttcctgtcctgagaggcctttattccccagcagttcattatccaaggaccatgcatgttcctgagaggaacatgggtaggaccccctcagtgggtattggttgtttcaactaccccctagtggagaaactaccatcataggaaaaaaaaaaaaaaaaaaaaaaaactacagagcttctatgtcagtcccaagattttatcaaattgtaattatttgtacactcccagtctgttcctcactccggtgcctaaggtgtagccattgttctatgtccatatgtacccaccagtcgtccgggagatcctaccactatcaagccaactgttgagtttgatagttaatttgccttctgcagagatgaaatacttgctttaatggctttggccatctagcctctggccagagttctagacataggatttgtgaacaccatggacttgaactcaggatttagatgtaagtggaaagtgacactaagataaagatggaatagggttgccaaatttatttattatgtatttatttattgatggagtcttgctctgttgcccaggctggagtgcagtggcgcaatcttagctcactgcaacctctgcctcccaggttcaagcaattctcctgcctcaacctcccaagtagctgtgattatgggcacctggccccatgcccggctaattttttttaaatttttagtagagacagtgtttcaccatgttggccgggctggtctcaaagtcctgacctcaagtgatccacctgcctcggcctcttaaagtgctcggattacaggcgtgaaccaccattcctggcctagggatgccaaatttagcaggtgaaaaacctagggttgccagatttagcaggtgaaaaacgaaatacagaatgctcagttaaaattcaaattcagataaacagatttaggacacacttacactaagaaaaaaatagccattgtttataagcaattcatatttaactggaaattctgaattttatctggcaattttaatctggttccagattttgcaggatcttatcagtcatgtgaaggattttagtccttagtatgtataatagcaatgagaaacggcagagggattttaaacagggaatttgtatcttgtcaaataatgattcgaacaggccaccaaaatagtcttctgatcaaacaaattcaggcttgttacttacagcactaaggaaggccactaccattgcaatattgtcttaataacctttcagaaggggaaaatcagatgtggagggattcatatttataaggtttttggagtctggtttgtggcaggtctttcattgttggggcctgaatgattgagattggacaaacttcatgatataattttatgtcaaaattatatcaaagtttgtgatatatttttttcaatagtttttatgtaaaactttgaagagtatcagtcatttgataaacccatttgagagatgttctgagaagtggctgtttactcagatgaggactgcttgataagcattgttcagaaaaattgatttccaggaagtttctgaaacaaagctattcacaacttcctcttactggaagaaatttcctggaatagtagttgaagttaatgcaaagtattaaatagaaacgtcatattaatgtgggtggtaaactgtatgcctgcctttggttccggttctctttagcctctgctggttattcttcagtcttagatgagcttcacaaactgtatgttcatggcacacttagtttcagtctaagtaatttgccagggtatctgtagtccaagagatgtacctaacgtctccatttattaagtaattaagttgaaccaacttagtaagtttgcacattcacacaacttagtagccatatcattcttattgaaagtatttttatcttgtcattaaatgaccctataatctttttaatgctgaatatgtttcagaaacattaatattaaaaataatgattttaataaaaaagatacctgctcatcctaaaaaattttaagcattaaaatgtgttcagaaagcgtagtgaaaattcaccccaaatcctactcaccaggaatgcttattttttaacttggtggcctttattctaagtatatttctatgagtatacacataaactattttagaaaatttagatcataattgatgaagaaagaattatccatgatacttggatatagtaaggtagacattttttcaacagagactactgcattggggttttatagtaggaagagagattgagctcaactccaaatacaaggaaatttatatccaaggagcaggatgggtgttatggcttgaatatcccctcccaaactgaagcgtatctgccactataatgttatcaagaggtggagcctttaagaggtgattaagtcatgagggctgtattttcatgagaatgggttagttactgtgagactgggctcctgataaaacaataagtctggcctaattttcactctgtcttgaccaccaacttgcccagctgtcatgggatgatgaacataaagaccctcaccagatgacaatgtcatgctcttggatttcttagcctccaaaatcatgagccaataaactggttcataaattacccagtctgtggtattgttatagcagcagaaaattgactaagacagtgggaagcagtggatggagaaatgctaagaggaaacatcaggagtaaggagagattgtgagtaaactgacttgataggatacttgctcaaagccggatacagtgatcagatacctagagtaggagattttcactaaactgactcagcaggattcttactgaaaccagactatgtgggccaaagacaggacccaaggttgggacctaatcagaaagagaattcagaggaatctgactcaagtttgctcaaggagagaatctttttcataatataaatgttttatattctcagcagtgtcagagaactggacaaagatatacattattgcctctctcagagaataatattctgtaaggactaataaaagaaacatagaactaaggtagaatcataaaaattggaaaggaggaggcaatatccatatgttagagaggctatacttgttagaaaaatcaagagcttcacctaaaaaattcctgagaaggagaatttagtgagatagttgattgaaatttctttcctatatacaacaataaattgtataataaaatggaagaaaaattccctttgaagaaattaaccaaacataaaatacctaggtctaaactgagcaggaaatgtgtaacatctatatggagaaaagcttggaatgctaaaagggaactagagagaaggcttgaatatatacaaacacagagccactttttgaattgggatatccagtgtggtaaatatgtcagtttcttactgtataaatataatgcagtcacgatgaaaaatatctggaaattaatttgtttggaactaaacaatctgcttctgatgtttatatgtatgtatcaccttgagccgagagtcaggaaatatttgaaatagaagaaccatacctagaagtaagatatataagaaagttgcaattgacaaaaacaatttggaatttgtacatgcttagacagtgaaaacagtatagtgaattcaaaagtagacctgggctgggcgcagtggctcacacctgtaatcccagcactttgggaggccgaggtgggtggatcacctgaggtcaggagtttgagaccagcctgatcaacatggtgaagctctgtctctattaaaaatacaaaaattaactggatgtggtggtgcgcacctgtaatctcagctactagggaggctgaggcacaagaattgcttgaacccaggaggcggagcttgcagtgatccaaggtcacgccactgcacttcagcccaggtggtagagagagattacgtctcaaaaaaaccacaaaagtagattcaaatatatgtggcaatttagcgtatgataaaggtagaatttcagatcatttggaatgaagtgtttaattcagtttatagtgttgataactggccatacatttggggaggtatacatttcaccttataaaaccctttgcacaatttgaattttgaactcttcaacaaagagctagtttaaaaaataaattaaagggttgatatgattaggaaatttttaaatgtatatttgtctgtctctgtcaattcaccatgttcacagactaggcaaaggaataaaaatgctgccataggaaaacaaaacctacctaatatagtgtgtaatggggtattttgacatggatatatcagagatcaataaaattctcccaaatgtaagtattaatgttaaaatctccaaacttttctaattgagataatacaaaataacatatacactgccagtcaattggcataacattcctcttaaaatataggtctattctatgagcagctgatatggtttgtatctgtgtccctgcccaaatctcatgttgaatcgtaatctccaatgttggaggtggggcctagtaggagatgattagatcatgggggtgaatttctcgtgaatggtttagcctcatccacttggtgctgttccagtgataatgagtcagttcttgtgacatctggctgttaaaagtgtgtagcacctccccactctctctcttcctcccattctggccacatgaagtgtcaactcccccttcatcttctaccatgatgtaagcttcctgaggcctccccagaaaccgagcagatgttagcaccatgcttcctgtatagcctgcggaaccgtgagccaattaaacctcttttttttaattaaattatgcaatctcaggtatttctttataataatgcaagaataatacagcaactgaccagattatctagctgtgactgtatattcttaaaatttcatatagggttaatcaagcccccatttagggagtatttttgttacttttatttttaattgtggtaaaatatacatgacaaaatttaccatcttaactatttttaagtttattgttcattaatgttcattgtattcacattattttgcaacaaatatgcagagctcttttaattttgggaaactgaaactctgtacaacattaacaactttccatcctcctctctccctagttcttggaaaccaacattctatttcctgtctctatgtgtttgactactctaagtgcctcatataaatgaaatcaaactgtatttgtctttgcgtgactggcttatttcacttggtgtaatatcctctagattcatccatgttgtagaatgttttagaatttccttcattttaaaggccgaataatattccactgtgtgtgtctatgtatgtatgcatatatatatatatatatgtatatataaaaacaatatgtattgttcattcattcttctgtggatagacacttgggctgcttctaccttttgtccactatgaacaatactgctgtaaacatggatatacaaatatcccttcaagaagctgcttttacttctttaacccatttatgcctagtgttccattattggaatgctaagcatgtaggagttatttatatcttactactcaaggtcatcatcaaggtctgattgcaaaaattcaaaaaaattgcaactgccagcataaatgggtttaagtatatgtcgagaaagtagaattgctgggttatatagtaattctgtttctagttttttaggaaccaccatactatgttgcatagtggctttaccatttcacattgccaccagcagtgcacaagggttccagtttttccacatcctcaccaacactttgaattttccttatttatttatttttgatatgtagccattctaatgggtgtgaggtggtatctcattgtggttttgatttgcattttccatgtgacaatgttgaatatcttttcatgtgctcacgggctatttatttcttttaaggaatgtctattcaaattctttgctcattttagaatcagtttgtttattttttgttgagatttaggaggtctttatatattttcagtattaacccctcatctctaacacacacacgatttacagatattttctcccatttgatgcacagaagtctttaattttgttgtagcccaatttatctattttttccttttctttcttgtgcatttcgtggcatattcaaaaaatttttgctaaataaaatgtcatacagttttcccctatgttttcttctaaaagtttcaagcttttgctttcatttgggtctttgatccatttacagttaatttttgatatggtataaggtcaggatccaacttaattcttttgtatgtagatatccagtttctccagcatcatttgtttcaaagactgtcctttacacattagatggtcttggtatctttgttgaaaattattgcaccatatatgttagggattctttctgtgctctctgttctattccaccggactgcaggtctgtctttatgccagtaccacattgttttgagtacgattgctttgtcaaagacaagatgttccagaccattagggaatgtctttatttagactgttgcaatagggagaaccttcattattgaggaatatttcccaggagaaggagatttaaggctttttagaggcagattacaagagagtcatcatgaggcttacatgagtcatgaggtaggatggagatgtgtcctatatgcaaagacagggtagacttttgaagttacttgtttctgaggacacaaaaagatcggggaggtgtggtatttctaaaccattgatgcttccttggagcacagggttcaagtgaagttcatcatggtcactacagtttagtaaactttttttgtctggactttgaatagacaatgatttttttttcctttttcgaagatttaaataggaaaaaaaattcttgtttggtttaagtagttacatttcttttccagcaactctacaatttatttttcccaccacacatattataaatataaccaattatgtactcaaatttctctctgcctttcaaaataatactttgtgactcagaagacattttaaaaaatatacttaaaggaacataattattaggtatgcagtataaatttgctcctaaaactttttccatttttatagttgaaacaatcttacacataatgatgcttatatctactctctgtagggaagaatttgtaattctttcacacaattctgaatattttacaggttttgggggactttttttcttttttttttgagacagagtctcgctctgtcgctaggctggagtgcaatggtgcgacctcggctcactgcaacctccgcctcccaggttccagcaattctcctgcctcagcctcctgagtagctgagattacaggcacccatcaccacgcccagctaatttttgtatttttagtagagatagggtttcatcatgttggccaggctggtcttgaactcctgacctcaggtgattcacctgccttgacctcccaaagtgctgggattacaggtgtgagccactgtgcccggccatttttttggattttaaactaaccattccaggctgggctgagcgattcatacctgtaatcccagcactttaggaggctgaggtgggtggattgcttgagcccaggagttcaagaccagtttgggcaatgtagggagaccctgtctctacaaaatataaaaaaattagctgagtgtggtggcttgggcttatagtcccaactgcctgggaggctgaggtgggaggattgcttatgcacgggaggtcgaggctgcagtaagctgcgattgcaccactgcactccagcctgggtgatagagtgagactctgtctcaaaaaaaaaaaaaaaaaaaagaataagttaataaactaaacattcctgggaagactggccttaaattctcatcctaaatattagagttttaattttttcctacttttgaattattgaaacttcttttttactatcaagaagggctgactgtattttcctattgaaaacatatttgctaactctgcagtcatattcttttgttacagccctctcatttaaatttttcttgaattttgcctcttgttataaagggtggctttgtgttgatctttttcaggtttgtggttttctttcagagcaaagtaaggcagcttatttcttttgggcatttttgccccattttttaattgaagtacaattaatacacagtgaaatgtaaagatcttaactgtgcattttaagggaaacttcaagacatttgttcattgattcacaaaagtgcagaaatctcagcgatttttcaaaaaatgaactaacccatgtaaccggcactcagatcattcttggtaccccaaaagtccttttttgacacttcccatcacaatcccaccaaaggttaacctttatcaagacttttaacaggatagattagtttttttatatagaaataaaattacactctatataaatagtatatgctctcctgttttggcttctttcacttaacattaagtgaaattcattaagtgagattcatccatgccatggtggttatagtgttgttatagttcactcattctcaatgctgtacaatattctgagtcattaatgtaccatatttgttcattttgtgttgatggatattagggttgtatttttttttttctaatttggtcttgcagtctgtctctggaaagtagctataaactttattccccaacaggttccaagggatttggttgtggatgtttacaatgtgcctttcacaggatacttctttatcctggcagatggtatgatgcctaattgtctgaggtgtgaacaagtgtctttctcaccagaaattattttatactggcagatgcttgtggctattatcagacctgtgtcccgtttattcctgtcaagatagccactgtgtaggagaggcttaactgggagaaaagttaagtctgaatgtatcagtctggggagatataggtgtgtcagttgggtaatactatacagaggagacagcacaacaaaaacagatgaaataatgtagacagtttattattcacaggttgatgggaaaacaggggtaccgacaggggctgttggaaatactgtagaggaaatgtgctcaaccagcaggtggagagataatgagttgaggcctttattgggtccagtatgttaccaaagcaggttacctctgatgagttctcattagtgggtgtagagcaagcaggcatgagttatactggatgaacgtctcgatggggaggttgtcaccgtggcatatctgcacagtccatgcatggtgtaagggatcaatgggccaagtcaattaggttatatctatgtgttccatagggaggtggtcatcaggaggcaattgtctaagatacatatctggagggaacacattaaggaattgggaggagacagagaactggaaactgtcaaggataatatggagcctggctcggtgtgagaaagttaaacttatattcagaacggataccgagacagcataaaattgtaagaattcactatgagtgttgtttccacttggggttactgcaaatataactgctatgagcattcttgtacctgtctttaggtgaacatatgtattcaattcttttgcagatatatctaggattgagattgctggatcaaggtgtatatgtatatttgggtttctaaaaagctttctttgggtaatttttttttacctattataaaatcactgatttgaagtgtgcaattcagtaatttttaccaactttaatgagtgttatacccatatgataaatctgtcatagaagatttttatgcccccaataagatccctcagctacatttacagttatatcctgtcttatcccagctccaagccaaagtaatcttcctatctttctatctccacaaatttgccttttctggacatttcataaaaatggaattatgatccatacctatgtggtatcttgtgttcaccttctttcacttagcataattttcagaaatcatccatgatatacccatgcatcaggaattcattcctttttattgccaaataatattctacagcttgtctttcccttcatgagttgctgagcatttgggttatttgtagttttgtctcatttgaataataaatcatcatgaatacttttgttcaagtctttgtatgaacatatatttttacttctcttgggtatgtacctgggaataaaatttctggcttgtatattaaatttatgtttagctttgtgagaaactgaaaaactgttccaaaatgactgcactattttacattcccgccagtaatgcatgaggagagggttcctgtttctacacatcctcaccaacgttcattattttctgtcttatatttattatagctatttacgagggtctgaaatgataatgtgttgtggttataatttgcatttcctttatgactaatggtcttggacatttttaatgtactcattagccagatatatatatcttcttttatgaaatgtctgttcatatcttttgtccactttttgattggactgtttattttctgttttttcttttcttttttttttatttttgagatagagttttgctcttgctgcccaggctggagtgcagtggtgtgatcttggctcactgcagcctccacctcccgggttcaagtgattctcctgcctcagcctcccaagtagctgagatcacaggcatgcaccaccagccctggctaagttttgtatttttagtagagacagggtttcaccatgttggccaggctagtcttgaattcttgacctcaagtgatctgcccgcctcagcctcccaaagtgctgggattacaggcgttagccaccgggcccagccatatcttcttactgtagacttctaaagattctttctaaattctggtttgaagttctttatcagataagtgttttccaaatattgtctcacagtctgtaactgaccttttcattttctctttctttctttttttaaaaatcaatatatatgttttcatttttttaaattttttttaaaattattaatttttgtgtgtacatagtaggtatatatatttatgagttacatgagatcttttcatacaggcatgcaatgcataataatcacatcatgggaaatagggtatccatcacctcaagcatttatcctttgtgttataaacagtccagttatattttttagttattttaaaatgtataattagattattactaactataatcaccctgttgtgctagcaaatactaagtctgttcattctttctaaccatatttttgtacctattaaccatctccactcccctgcttcttcccagactcttgtaaccatccttcaattctttttattttattttattattattatactttaagttttagggtacatgtgcacaatgtgcagtttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcagttcccacctatgagtgagaatatgcggtgtttggtttttttgttcttgcgatagtttactgagaatgatgatttccaatttcatacatgtccctacaaaggacatgaactcacattttttatggctgcatagtattccacggtgtatatgtgccacatttccttaatccagtctatcattgttggacatttgggttggttccaagtctttgctattgtgaataatgccgcaataaacatacgtgtgcatgtgtctttatagcagcataatttacagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcgtgtccttcgcccactttttgatagggttgtttgtttttttcttgtaaatttgtttgagttcattgtagattctggatattagccctttgtcagatgagtaggttgtgaaaattttctcccattttgtaggttgcctgttcgctctgatggtagtttcttttgctgtgcagaagctctttagtttaattagatcccatttgtcaattttgtcttttgttgccattgcttttggtgttttagacatgaagtccttgcccatgcctatgtcctgaacggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaacggggaatcctttccccattgcttgtttttgtgaggtttgtcaaagatcagatagttgtagatatgtggcgttatttctgagggctctgttctgttccattggtctatatctctgttttggtaccagtaccatgctgttttggttactgtagccttgtagtatagtttgaagtcatgtagcgtgatgcctccagctttgttcttttggcttaggattgacttggcaatgcgggctcttttttggttccatatgaactttaaagtagttttttccaattctgtgaagaaagtcattggtagcttgatggggatggcattaaatctataaattaccttgggcagtatggccattttcacaatattgattcttcctacccatgagcatggaatgttcttccatttctttgtatcctattttatttcattgagcagtggtttgtagttctccttgaagagttccttcacgtcccttgtaagttggattcctaggtattttattctctttgaagcaattgtgaatgggaattcactcatgatttggctctctgtttgtctgttattggtgtataagaatgcttgtgatttttgcaagaaggaatggtaccagttcctccttgtacctctggtagaatttggctgtgaatccatctggtcctgcactctttttggttggtaaactattgattattgccacaatttcagagcctgttattggtctattcagagagtcaacttcttcctggtttagtcttgggtgggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagtggtctatcaattttgttgatcctttcaaaaaaccagctcctggattcgttaattttttgaagggttttctgtgtctctatttccttcagttctgctctgattttagttatttcttgccttctgctagcttttgaatgtgtttgctcttgcttttctagttcttttaattgtgatgttaaggtgtcaattttagatctttcctgctttctcttgtgggcatttagtgctataaatttacctctacacagtgctttgaatgtgtcccagagattctggtatgttgtgtctttgttctcgttggtttcaaagaacatctttatttctgccttcatttcattatgtacccagtagtcattcaggagtaggttgttcagtttccacgtagttgagtggttttgagtgagttttttaatcctgagttctagtttgattgcaccgtggtctgagagacagtttgttataatttctgatcttttacatttgctgaggagagctttatttccaactatgtgttcaattttggaataagggtggtgtggtgctgaaaaaaatgtatattctgttgatttggggtggagagttctgtagatgtctattaggtccgtttggtgcagagctgagttcaattcctgggtatccttgttaacgttctgtctcgttgatctgtctaatgttgacagtggggtggcatccttctattctttatgtccatgatttcagttgttttgagttttagatctcataaataacttgagaacatatgatgtttgtctttttgtgcctggcttattttccttaacgtaatgatctccagttccatccaggttgcagctaatgacagaatctcattctgaatcatactccattgtgtataagtactacattttctttatccattcatctgttgatggatacttaagttgcttccaggatcttggctattgtgaacagtgctgcaacaaacatggatgggcagatatctcttcagtatacagatttcctttcttttgggtgtatatatatatataacacacacacatatacacatatgtgtatatatacatatatacatgtgtatgcatacatatgtatacatgcatatatgtatgcatatatatgcatgcatgcgcgcatgtatacagatatgtatacatgtgtatatgtatacagatatacatatgtacatatatatacctgtacatacatatatacacatatacacacacacacacatatatatacacacatatatatccaacaatttgattgctggattatatggtaactcaattttgagattttttgtggaacctccaagttgttatctatggtggttgtactaatttacattcctaccaagagtgtacaaaggtttcctttttctccacatccttgccagcatttgttacttcctgtcttttacataaaagccattttaatgagataagatgatatctccttgtagttttgatttgcgtttatatgatgatcagtgacattaagcgccttttcatatacccatttgtcttcttttgagaaatgtctgttcattattagactttttttctacacagtagtttgagctccttatataccctgactattaatcccttgtcaaatgcatagtttgcagatattttctcccattctgtaggttgtctctttgctttgttgattgtttcctttgctgtgcagaagctttttaactttatgtgatcccatttgtccatttttgctttggttgcctgtgcttgtggaatgttactcaagaaatatttgcccagtccagtgtcctggagaatgtccccaatgttttcttttagtagttttatagtttgaggtcttagatttaagtctgtaatacattttaatttgatttaggcaagagatagggttctagtttcattcttctgcatatggatatccagttttcctagcaccatttgttggagagactgtcctttccccaatgtatgttcttgaaacctttatcaataatgagttcactgtagatgtatggatttgtttccaggttctcaattctgttccactgacctgtgtgtccgtttttacaccagcaccttgctattttggttactatagctgtgtagtataatttgaagtcaggtatatgattcttccagttttgttcttttagattaggtcttttttctgttcattttctcatttagttcttctttatttttaatttttttgagatggagttttgcttttgttgcccaggctggagtgcagtggtgcaattttggctcactgcaacctctgcctcccaggttcaagcgattcttctgcctcagcctcccgagttgctgggattacaggcgcccgccaccacgcccagctaatttctgtatttttattagagatggggtttcaccatgttggccaagatggtcttgaactcctgacctcaggttatccacccgcctcagcctcccaaagtgctgggattacaggcgtgagccaccgtgcctggccaatggcttatttttaggtgtgaaagttttgaattttgacaagacataatttattatttctttctagtattcactacacccttggtttcatatctaatgaatctttgcctaacccaacatctgaaagatttttaccaatatgttttcttgtaaaaatttaaatcttctaaccccttcatgtaggtgtttgatgcattttgagttaatgtgtgtatatggcatgcattgtggatctaaatgcatctttttgcagttgttcatgtgattatataaaacacaattcctcgagtaggcttcccttctccagtgaattgctttggcacctttgctagaattcaatgaacttataaatgtagtttttgaattttatcatactgatttatatgtctttccttatgcctggtttacaccatcttcataactaactctatataggcatacttcactttagtacacttagctttattctggcatacctcatttcatggcattttgcagatattgtgtttttaaacaattatttatataaattgaagcactgtggcgatgtactgagcaagtttcttggtgccattttttcaacagcatgtgcccacttcttatctctatgtcacatttttgtaaatcttggaatatttcaaactttacaatttttattatatctgttatggtgatctgtgatcattgatctttgatgttactattgtaattgctttagggtgccacaaaccacgctatataagatggtaaacttaatctgtaaatgttgtgctgtgctctgccaatcagtagttccttatctctgtgcctctccttgggcctccctgttccctgagatacagcaatattgcagttatggcaacgaataactctaccatcatctcttagggtccaagtgagtcacacatctctcactttaaatgaaatgctaaaaatgattaagcttaatgaggaaggcatgtcgaaagctgagataggccaaaaactaagtctcttgtgcaaaatagtcaagttgtgaatgcaaatgagaaatccttgtaggaactgttttttgctaaaaagttaaaagtgctactccagtgaagacacaaatgataagaaagaacaacagccttatagttgacatggggaaagtttgagtggtctggatagaaggtcaaaccagccacaacattcccttaaaccaaagtttaataaagagcagtactctaactcttcaattctttgaagcttcagaatggtgaggaagcctcagaagaaaaatttgaagctagcataggttgttggttcatgaagtttaaggaaagaagctgtctctataacataaaagggcaaagtgaagcagcaagtgctaatgtagatgcatgttgtctagaaggtgtagttagaaggtgtagctaagatcattgacaaaggcggctacagtaaaatacaacttttctatgtagatgaaacagctttctagtgaaagtcctatgtaggacttccatagctagagaggaggagaagtcaatgcctggcttcaaagggcagactgactcttttgttagtggctaatgcaacttgtgatgtaaagttaaagccagtgctcattgaccattctgcaaatcctagaccccttaggaattatgctaaagccactctgcctgtgctctataaatggaacagcaatgtctggatgaaaacacatctgtttacagcacgatttactgaatattttaagcccactcttgaaacctctgctactcagaaaaaaagattcctatcaaaacattactgctcatatgcaatgcacctagtcacccaagagctctgatggagatatataaggagattaacgttgttttcctgcctcctaaaacaacatccattctgtgtagctcatggatcaaagagtaattttgcctttaagtcttattaagaaatacattttgtaaggccatagctgccataaacagtgattcctctaatggatatgggcagagtatattgaaaacctggaaagggttcaccattgtagatgccattaagaacatttgtgattcatgggaacatgagcagttcaatgaattctattacactatgagtgcttttggctagattatctagctttttgaccttggacacattatttaatgtagagcctgatctccatctataaaatgggaatcacagtagtacccacctcatatgaccgttgtgaggattagatgacattttatatggaaaatgtctgcagtaaaccgtccataaatggaaggagttttttaaaaaatgttgttggtataatcaccattatgatctttatgattctatgttttaatttcattttataatttatcctgtgattttttttacctcagcatcaccctttataggatataaccacatttcttctcaatacctataccaacagcactaatcattaaagaaatgcaagccaaaaccacaatgagatacacgtcacacttatttgaatggctgttattaaatagacaaaagataacaagtgtttttgagagtgtggagaaacaggaaaccttctatacagttggtaggaaggtagattagtacagccactgtggaaaatagtatgaacatttctaaagaaattaaaaatagaatgaccatatgactcagcaatccctcttctggttatatacccaaaggaaatgaaatcagcacctcataatcatgtctgcattccgtttttgttgcattgttattcacattagtcaatatatggaaataaccagtgtctgttgacaaatgaatggataaattgtggtatatacacacacacacacacacacacacacacacagaatggattttcattcagccttaaaaaagaaagagatgtgccatttgcgacaacatggatgaacatcataatgatattagcccaaaagagaaagaaaaatactgcatggtctcatttatatgtggaatttaaacaacaaaaaaaaattcagtggtttttgtgtaaattagtacaatagaagatccaaggtagagtactttaaattagcaagatatttctaactgtgcattttaagaaccatttttatttttcttcagtttggaactacaacctttagatatcaaaatgccctttgtaacttaatttttattcttttttatgagagaggtgcatgtttttcaagtacatttatctgttaacaaaaatagttggagttcgcgaaagcctattatttaggcaaagtcttcctttgcaaagattcagactaaagtactagcaggttttaaataatacatgatttattatattttcttgtttttgaactgagacataaaatatcctttaacttaaaaatatgttttattatttaataataaaagaagttgtttcttcaagctaaatgcctggtaaatacattttattatgtgatcagcttgtccgtattctaaaataatagtttatgacttacatgagcctattttttcacttgattaagtaacataattagctgatttacaatataaaacatattcctaaaacccttttcagctttgaaatttcaaatgccactgtttccatataatgacatgtgaatttacattttagaaagcataatttaaaattatatacctctatatttttaaggttcttggcaatttaagtagaataatttccatagagagacaattcttccctcctactctgtatgtactctaatgttgtctacttctttcttctgttcctgcagtgttacttacgttttttatactatccagaggcttaggctgtttgcctttgatgacatggatatatattgctcagtcatacgctttcaaaaaataatctcttcatttagtttttttattattttattactattaatttataataaaatttggtttatatgaaggatcttaaataacatatataaggtataatcaataatataatgagtctataagaactcagcataaaaaacagaacattttcaatagcttgaaagcctcctgcataccccttcacataaccctcccagatcatattgctttcctgttctgatacagataaccagtatctggaatttagtatttaacattcctttacttgtttttctttttataggtttactatatgttttagtttgtgctaagtgaaatggccactactcaaccatttttggtctataattataggaattttatatggttcagctgagtacacacatacacatgcacactcccaaacacactggcctgttgttgaacattatataagtgatgttacagtgtagtattcccactactttctttttttactcaacattatcacctagagattcattcatgttgctgtgcaaagctctatttaataaatttgtgctgccatatagtattccgttatatgaatattccccaattactttataaattttcttgtttatggacgtttattgctgctttcaggtttttggtgttttgacttttataagtaatgctgccatacttcttttttcacatatcccaacaagtgtctctaggtaggtatataaagtagtgaaattgcagagacctagggcatatacatattcaatttttataaacaatactaattttccaaagtaattgaccaaaagtatacttttaccatcagtgtaaagattgttcctttgtactaaatctttatcatttttttattttctgttttttaatatttgctcctctggtggatattatgtggtatttaattgacctttgactttgcatggtatctaattgaggttctaattaaggttctaattattaatgaagtaatgaagtggaatatttttaaatacatttattatccattcatttttcctccattttgaatgacctgctcatgtcgtattctggttttggtattagggtaatatcggcttcatagaatgaattgggaagtgttctttcctttcaattgttggaagtttgtgaaggattcatattaattcttgaagtttttggtagacttcaccaaattaataatttttaattagtaatttaatctctttactcattgcaggcctattcagattttctatatctttttgagtctattttcttagctggcatctttttaggaatttgtccatattatctaggttatctaattgagtgtcatacagttggtatatctttttgatcttctgtaaggttggtagtaatgttctctttttcgttcctgattttactaatttgagtcttctcttttttttctcccggtcactgtagccaaagatttgtcaattttgttgaactgtcatatgtttttcatatttcgttaattatgtttattttttgattctctatttcattaattttattatttcctttattcttcttgctgttaggtttactttgctattttcccagggccttaaggtaagaagttaggtgattgatttgagatatttcttcttttgtaatataggcatttacagctttaaatttccctgaaacacactgcttttacctgtatcacagaagtattggtatgttttcatctctattcatctgaaaatattttctaattttcattgtaatattatttgatgtgttggttttttaggagtatattgtttaatgttcacatttgtgaattttcaaaatttctttgttattgatttctaatttattccatgtgctcagagaacatactttgtattattcctgtcctttaaaattattaatgcttgttttatgacctggcttatggtatattctggaatatgttcaatgtgtatttgaggagaatgtgtgttctgctttttttgaatggcatgttctatagataatctgttatgtatacttagtttataggcctattaatgtcttctatttcctattcatcttctgcctagttgttctattcatcatttaaagtggggtattgaagtgtgcaactattattgtggaattatttatttttcccttcaattctgtcagttttgctttaatgtactttggtactctgttgttagttgtatgtgtgtttatactttatatgtcttctggatggattgaccttattattattattaaatattcctctttgtttctactaatattttttggtttgaagtccatttttttctatattggcattgccactccagctttcttatgcttgctatttgtataatatatgtctcccttttacatttaacataattatatgtttaaatctaacatgtgtttgctatagaaagcatacaactggatcttgtttttttttttaattttccagtctgaaaatatgtgccttttgattaatttgtataatcaattaatagttaatgtcattattggcatgggtgcacttatgtctgtctctttgttttctatatgcataatcttttctgttcctctgttcctctcactggtttcgtttgtattaaatggaaattttttgttgtaacattttaatcctttaatggtattttcttattttactcgttttcttaattgttgctctaggacttaacaatttatgtgagaacttaccagaatttctttcagatgttaaattttcctgagctgtagctatttcttctcccttttttggtgctgttattacacatatgacgtctaaatacgttatgtaactccaacaatacattattacaattattacttttgatagtttttttgtcttttactgaacctgagagaggaatggagagcaagtatataattttaaaaacttgttgattaaacttctcatttactatttctaatgttcttcatttcttggtatcatacccagctgttatccctgagtaattgttgaccgattgctacattgactttgacagtttcctgggacataatctgctccacagtgatacatttatttttggacccctttgcaggaatagtctttgaggccagtgtttcatgcttgctccagccataggtgggcttttctcagctatgtgtttgtttctcacttgtaaactggctggcctatgatttaaagagctcattaaactactaacctcctcataattgcttaccacaaaaatctacactgttttcagggactcccttaggctcaaacttccttacactctgttttaaataaaaatcagttcccttctagagagccttggacctgttttttaatagcctgcctctccccgtgggcagaacatatgcactaaagctttgggaggtaggggtggggacagtgtcatccttctctcagaatggcatccatgctctaggaagaggacattgggtaaaaacagtaacccgtggtcttcttggcttccccctccctgcatggaacctctgccttgtgaattagctggagcagggctgattggggcctagtattctcagattacttttcctagggtagagcttccgtcctgtgactggtcacttgattgaggaaaggagctccagacctctataacatgattgcctccatagagcttttgtaacctagagctgagggtaggatgaaaaattccaatcacctgctagagggaaaagtgcatgcccttggtttttggctgccccagccataagcaaaactttatcctgctaagccatccaggggaagggggagggagcaggttgtggctcagatgccacagactcttgctcttcttactgagatttcatagattttactaaaaatgtttctccatttgccgtataccatcaggacagattctagagactctaaatggttatttttcaaacaaataattttccccagttgtggttgttttgctgggagctcctcatgttgccattgcacatgtatctcttctaacgtggagaaacatttgacatacaaaaagtatactgtaataataacagtctaaccaaactttccagacaacagcaggattttcctccaacatctgtgtttgatacacagttgcttatattttgtttgtactcttgtatatgtcactgccctgcagccacagtacctacctgtgtttgaaaacaggtccagcctatacctgcctttggcctttgcactagctagtttctctttctacactgcttttgcgcaaggctctttctccattttcttcagatctcaacataaacttcaccttattgcagaaactttcccatatcactggatagaaaatagcacctctttggcaggcacctgtagtcccagtcccagctacttgggaggctgaggcaggagaatggcgtgaacccgggaggtggagcttgcagtgagcccagattgtgccgctgcactccagcctgggcaacagagcgagactccgtctcaaagaaaaaaaagaaaaaaaagaaaagaaaatagcacctctttatctctcttgatccctcatatttcattttaccaatacttaatgtattttgtcatatattttaattatttgtttatcctttctttgccatcgttagtacttaagctccataggggtatgaattttgtctgttttgtgttttgtggtatgcctagtatgtagatcagtgccatgcacaaagtagactttttattttattttattttgttatttatttaaatttccagttttattttagatacagggggtgcgtgggcaggtttgttacatgcatatgttacacccaggtagtgagcatagtatctgtagctagtttttcaacccacgccctcctctttcttcccccgtctaatagtcttcagtgtctattgggcccatgtttatgtccaggtgtgctcaatgttttgcttccacttataaatgagaacatgtggtgtttggttttctgttcccgcattagttcgcttaaaattatggcctccagctgcatccatgttgctgcaaaggacatgattttgttctttttatggctgcatagtattccatggtgtatatgtactacagtttctttatccaacatactattggatggtatacttttaataaatatttttagagtgaataaatgagttacagtatggcaattttatctatccccagaggagcactgtccaatacaactttctattatgatggaaatgttctctgtctgagttatccaatgtggtagatgctagttacatgtggtcactgaggatttgaaagatagctagtgcaactgaggaaatatattttaaattttatttaatataaattcagattaaattaggccaagtgtgcatatggttactttacagcacaactccaaaaagtcgtccgccttaccatggcatcttttcaaggcataatttttaccttttattcctattcatggagttacttctagcattgctggtattgtcatcatttttactacatactatgtgcactgtaagcatcttgggtctttatagaaactccctttggttatacttgctgtcaataaacaagagttcaattatcgggatttgtctacaaatgaaattacatccttaattttgcttgattttggaaataagcatctagttgtctcttcatttcttctttcatatgtgatacattttgtaaattttttcaagtcatattgtttttgcaataaaatggcatgaagtactgatgcataacaacatgaatgaaccttgaaaacattatactaaatggaagaaggcagtgataggagatcaaatgttgtttgagtgcatttatatgaaatttccataataggccaatctacagagaaagaaagtcgattagtggttgcccaggctggtggggaataggggaaatggggactcactgctgaagggtttgggctttctttctgcatgatgaaaatgttctataattaattatggttatagttgtacaatttgtgaatatactaaaagcctctgaatttcatatttcagtatgtttgtgtgtgtatgcatgtcttatatttttatatttattttatcttttttctttttttatcttttttttttcaaattacccagaatctgagatgtgtttttttttttttacctcttccttcagagattctgattcatcagaactaagatgataatctgcattttaaacaagcaatccaagtgattctgatttaggttgccaaaagatttttttctttaagaaacaatgctttaggcaaggatgttattaatctttctttaagaaatttctgataaagtagggaaatgcatatctttcccctaattatatatgaatatcctggcctccctgataccatggttatattttgaactgaaatttgtagttattgatgatgctgacacattttctctgtatttggcatgccattgctattttagacatataaggacactcaattgctgtatggtactcagatggctttatcttatcagttgaaatttcttcttattctttgtatttttctttaaaaaatagatttggtacttgccataccataacctctgttattacaactgttttaccattactttgaaacctattgtagagaaacaagaactctttctctacattatcccagtcttcacattttgtaagctgcttatcaggttgggttttctagtaagatatcagaagcacagcctacacagggcagagtatgtccaacatgtggtggtgggcaatctgtgtcttaatcatctggaatgtttgttaaatatcctgggatctgagaatcaaaatttctgaagaggtagtgtattagtctgtttttacactgctgtaaagatactacccgagactgggtaatttgtaaagaaaaaggtttaattgactcacagatccacatggctagggtggcctcaggaaattcacagtcatggcggaaggcaaaggggaagcaaggaccttcttcacatggtggcaggagagcagcatgggggaaactgccccctgatccaatcacctcccaccaggtctgtctctagacatgtggggagtatggggattacaattcaagatgagatttgggtggggacacaaaggctaatcatatcaggtagcttgagtatacaggttactatcatgtccactgaagtctgagagcaactgacgtaaatttttcattttcctttttttgtgtgccaaaactgtagatgagagaaccactgatttatgtagtgatctgtgcctttatgttctctaatacacaacttcagaacagttttaaaattcattctgattcttccttaacttggtcattatatttgcttttcttgggatgggtagaattttgcagtttcacttgaaactgatttttgcctctctacttgatcttgcttgtctaataaaaactgtgctttgcaccctctagcatgctttttgtcacctggctctactcccgatttctacactacttaacttggtcagcatagacttcacctttaatagacttaaaaaaaatctctgctactccgtttatgtgtgtgtgtgtgtgtgtgtgtgtgtgtgtgtgtggtgtgtactattgttctgctaatgttcttttatgctttggtccttcttataaatccataaaaccatagggataacagtattacaattttaaatacctgtaacctctgacctttcacagaaaatatgaaatacatagacgtattgacctgaccatttctaaattgctatggcttctaaccttttccagcaatctgaaaagttgtgggaatttatattctatttgtaaagaaaggactaagaactgtgacttcaaaataagaatcatagtagaccagttataaaatgcactatctaaaaaggtatgcttcacatttatgatcccggtatttgcattctgtgtcaaacattaaatatgagagaattattccaagagagatgaggaagaatcgatataattttagctggcagaatttattaacatatttgcttatcagtcctcacaaattatgagctgtccttaggtgatatatttatttggattctgctgtgttgttttggtggcaacaccatgcctgaataggtgaaaggggctctggaatctagatacttgccttaaaaccttgtccctgccatctgctagttatgctgctagtctagttggctctcctgtctgagcctctctttctccacaggtgaaaggggaaaataatagtgcccatgtcatagagttatagtgaggaacatctgaaataattcacagaaagcacttagtgcaatgtttggcatatggtaagcactctgtaaatattagctgctattattttcatgattgttaataaaattgctgccaatgttgttctttgtctacagcagtgtttcttaacctttttagacataaggtccttctcttataacgaacatttggtaactcctcctttaatattatggaatgaaaatcaaagatctataacctgtatacatataattttgaaaaatgttaatattattctttaatggtaatagaaacaaaatagtagtccagggctacagtgtatgaccactatatcataaatccccaagacctgtctcaggttcataaatttactagaaggaatcacggggtctcagcatatacttgtattagtggctgagggttattataatggcataagtgagaacatatagccaaatcataagggaaaaagacacaggtggcatgtgcaggaatccttgtgcaagcttccttacgctctctcccttcaacaaggggtcacacaaagcacattcttaccccagtaacaaaaagaaagcaacacatgcaatgtttctgtctagggaaggccattagacactcaatgttcagggttttccttgggggctggtcacactctctgcctcatacttaccacaattacagataaaagaaggtattcagtcatattatttgaagtgcttgagagggtatctggtggtctaactgcttcttctacagaatttcagtcatttctcctattttcagctctaccaaaactcaccacttacataagtaatcctgattggtatggctttctgaggtttggtgccacaagacagcttatttactattggtgtcaaaatatttaagttggtttgagatttttctggtacaacaagctattaataatttgcccatttgctttctttctttcttttttcttttttttttttttttgacatggagtctcgctctgtcacccaggctggagtgcagtggcgtgatctcggctcactgcaacctccgcctcccgggttcaagtgattttcctgcctcagcctctcaaatagctgggactacaggtacccgccaccacacccagctggtttttgtatttttagtagagatggggtttcaccatgttggccagtctggtcttgaattcctgacctcacgtgatccacctgccttggcctcccaaagtgctgggattacagatgtgagcctccacagccggcctgtgtatttactttctaatttacaacattctgttaacagctattgtctgccctatagcctcccctactctctatacatgtacattcttcaataagtcaacatgagcatgtttacttgctgaccgtaaggagctagcagattagaagtggatggagatattaagagggaatcaatagggtaaggtcaggccaagtggggtggctaacacctgtaatcccagcactttgggaggccaagacaggtggatcacttgagtccaggagttccataccagcctggacaacatagtgagaccttgtgtctacaaataatacaaaaattagctgggcatggtggcatgtgcctgtggtccagctacttgggagtctgaggtgggaggatcacctgagcctggggaggtcgaggctgcagtgggctgtgattttgccactgcactccagtctcggggctacactctgtctcaaaaaaaaaaaagaataaaaaaataggataaggttctgaggacaatgaagaaagggtctgagatgtggagcacttattgagagatgagcctttgataggaggatggcctcctctttcattgtaacaggaggttaagaggagaggttttagtaaacacaagaaactttgtcaatttgggaaagaaaagagaaggacgtgtttgtatggtggtttctgccttctctatgaagtgtatggtaaggctacctgctgagaggggtgatatggtttggatgtttgttgccacctagatctcatgttgaattgtaatctacaatgttggaggtggggcctcatgggaggtgattggatcatggagatggtttctcatgagtgggttagcatcatcccctcagtgccattcttgtgatagtgagtgagtaagtcctcgcaagatctggttgtttttaaagtgtgtagcaccccctgaccccacccctgtttcttctgctctggccatgtagacacgcctgcttccccttcaccttccaccatgattataagtttcctgaggcctccccagaagcagatgctgccatgctttctgtacagcctgtggaaccctgagccaattaaacctcttttctttataaattacctagtctgaggtagttctttatagcagttcgagagcagactaatacaaggaagtaaagatgtgagggatttcaggtcttgggaaattggaggaagtttgaaataaccgtttcaagggagggaaggagtacattgacctgagaacacagacttgctagaaggtgttaaatgcccaggggagattgttgattgtgagtatatggtgacaccagtcttacctgttgtgtgacttttttagcagcatctagctgcccctgtgcaggacttgtcaatgctgggttcacctcatccaggggtggactaaaaactgttgataaaatcataacaggttgaatgttactgcctatgaagtttaaggtctttccttgctcagcatcattttattttcatgatggtttgttggaggatgggtctcgatatgtctttcagcctcaattgactcatacctactaagactggaaaggcatgctctccagccagctgacctcttgaatatacgatgacaaactattatctgctgcctgtttttgtaaaataaaagttttactgaaacatagccacacccattcttttacttgttgtctatggctgcttttctcctacaatggtagaggtaaataattgtgataaaaactatatggcgggcaaaatctaaagtgtatatgtggccctttacagaaaaagtttgccaacctctggcctctaggcagctgtctgaatcctgaagccactgttacactgtgtgctgtttactgacattttttcccttaggtggtgtcatagtcctgcatttttggcttcttaatctagttccttacttaaatatgattcaagtactttcttttcttccactaaataaattttacatacacacagagagatagagagacatgtatatttcaataagttctgccaatgtgaattaataaataagaagtgttataataataatggacatagaattccaatttcagactcattttttaatcacaaaattctattactgacaaatatgtaggtactcttccgtacaaatttttctgagttacttaatttctcctggcctcacctctttgggaggtaatttagatgaaatggcttaaaaaagttatagtttcacaactattcctcaaagtcctagaatctttttactttgctgactctacttgcttaattatatttgctaatccatttcattagtcaacacttggcaagcccaagtgtactcatctgtctattaccttttcatctactttagtcttaagtaaacaaatgccagttcatgttctcagatactcagatgtaggtttaattgttaatatcttattcattattgtacaagcttttgctgttgaattttaatattaaaataatgataggttagatttgtgctcacaacttattattatgttccattttttcccactcaaccgtacattatgtaccctttcttcaagattactgtacagaatgattcttacatatttcagtgtgacattctttttttattgaggtggaattcatatattaactattttcaagtaaaagttcagtggcatatcatacccttacagtgttgtgcagctgccacctctatctaatgctaaaacttttccctcaccctaaaaggaaactccatttctcttaagcatttgctcctcattcctgtttttctcctactctggtaaccacccgtcttatttctttttttgtaaatttccctgttctggatatctcacccatatctagatgattctgtgtggtgtgtaatatgtgatattttatgttaggcctctttcactgagcataatgtttatgagttttgtccatattgtagcatgttcagtttttcatgctttgtcatagttaataatattcccttgtttatatataccatgttttgtttatccattaatccattgatgaacatttgagctgtttccgccttttagttcttgtgaatagtgctggtatgaacatcaatgtccatgtacttgtttgagtgtctgttttaaattttttttttttggtatataactaggagtagaattacaggatcatatgacaatttcatatttaagttttcgaggaaccatgaaactgtttttcatagcagctgaaccattctacattcccaacagcaatgtatgaggatcccagtttttccatatcctcaccagcacttctaattttctagtgttttgattatagccatccttgtgtgtgtaaagcagtatctatttgtggttttgatttgcatttccctacagattaatgtcaagcatctcttcatgtgcttttggccatttgtatatcttctttgctgatatgttcttgttcatcttatttttccttcacaactggagaagacagggtatatataaatgatactaattatgagaaaaatcatagtcatggaaaatcttgagacttcaggtcagtagcttcatatctaccatggaggttaatttaatgcttgttagctaaaactttggtaaaacttctcataaattggtttgcttcatattcattagagccttccactcaaagatgtgataattgttattttgactatttgcaagggatttggaaaggtcagtgtatgtggtgatttttcatttggttggttgaattatgaaagctgcaggagcaaggagtcatttattggaatgagtcttgcagagtccttaaaatacatatctcagatatggctttgttattcttcataatgacatttctgaatttgggaattctgacaaagtatctgcaggaccacattatggctttcatgggcaataggtacttttgttttgtgggccatgaaaaattttgctacataaaagatattaaaatatctttcagaaatactaaaaatttccatgaaaatattataattctattttctgtctacattgctatagagatgaatattttacaggctgtcttgtattcatattttcttctgattttaaaagaaattaaaacattacagaacctctaacagtatcctgggcccaaggcattatgcttgctttgtgcagtgggatgtgggccctggatatctgaagatatctatcatgattttgtttagccctttgtgatttttattatcattgatgtgtgagttcttaacagttactgtgattacttcctaataataatgtgctctttacggctactttgaaatgtccatttcatataactcagatcataataaacttgccctttttcctcattttcattatgggctcagccgtctcagcttgttcaattttatttgcattttcctcctcatattctgctagttaccatttgagctctcagctgctggaaagcccttcccagagcaggtctttggggataacaggtttcactaaattggtttcagaaggtgaagtttagtgttcatttggtctccactggcagccctgaggagatatgataacacaggctggaaaagaaaaattccaatttcataaagagcattctgtacagtgttggcataaacaaccctgatactagcaaggagaacagactagctttgggatagtatacaagtttattgctaactcttcttttttatggtgttatcatattatcgtatcctttaacatcctttgtggtttttttcttgttccatgttcacttttccaaatctcattgcctgtcatcatcttccttccatcactggcattttttattaatgatctgctttctcctttcccataagccagtcttagtgtcttctagcaatgtcatttaaaatcccacttcctcattcaagccacagtccatagcactaagcctttcttcttcctttctcataactggaaataacagatctctcaggaaaccttcatttcccttactgagagatggtgctcaagtcaaaagcataggagctcacatagaaagcaaattctttagagatccttgattacaggaaaacaggccacaggtcatgttaaaccattaatttttggagctagccatgaagcttaatcaaattgatgttaaaacgattcttttaaggcattgactatccacgcattgattcttaggctctatttcatcatcataacttcctttacatttttatgataacaggaatagcaacattattatcatcattcatagtaacaaatgtttatatagtgtttagtgagtaccaaagtctaagctttttgcatttatgaacttatttaattctcataactcttataaactgggtgctattttttacctcatgtcattgaaatcaaataatttgccctaagtcactcagcaagtaagtggggatttatcatctcctgttcatcttgtaagctgttttctatttcaggaagcttaagaaatctcagttttattctgtgaaggctaattcatattattagcacatcaggaaaacctgttacaaacaaatattcagcagagacatagaaatcaagaactgtgttcctcatatcaagtgtatgatcaaggcaaactgggaactgcttttatatgactctctcccaatcacactgaattctatgattccttatcccatttccttcactaaggttatccttggggttgattcctgccaacttggggatctccttgaatgacatcctttctaattcctactgttagagtagatctagttagggaggacatttatgaagaaagacctctcccacaacaccttgaaaccgttgtagcttacttatcctgagtggacaggcatgggcttggagggtgaaggggtcttgcagttctaacatgttactcatgttctttcagtcatcttcttaaatatactttgtagaactatgaggccttatggagatcttaggagaagtactaatgaacatagaatttctgtttttaatcatacagtattccaattttcagttgccatatgtacatatatgtacacagacttgtgtgtggatgcatgcctgcttgtgaacatgtttgcctttgtgtacacacacagacacacgcctttgtgtacacacacagacacacacaaacacacacacctgcaaagatagtttgaggtaaccataatctttctgtggtaagcatctgaggtctttgtaaagaggagtgtactttccatttatggcatggcaaatacattaatcccaagaactctcaatatcaaggcccttttatggaaagtttcaagaagctttcctaggcccctctgctgacctaattatcggggtaatctgttttatcaccgtcaggtggagccaggatacttttaaatttgggataagggtcagatgtattaatccatatcccagagtatacaaattaactcttggccagctttatataaaataaagtacaaagtcaggttctcagataaggttggtatgttgtttggtctttctttttattctattcctgataaagattcacttgttgtaatccagttatctcactaattaactaatatttatattattaacacaacaaaaggaaaactggtggatatcacaggcctccacaggacaggcaagtgaatgaatcacttaagctggttaaggactgtagtgatctgtagagcatatactctgcctaaagagggcagccatgtcttaaaaatttccacacactagccttactagaatgtggactttatgctgccagagcttctgatttttcaagaaacgtttggaatccagatatttgtatgaaaactaatttttcaatgctagcagttaattctaatttttaaaatacgatgccatataatgaataaactattataggagttgacaatttttttctgtaaagggtcagttagtaaatagtttggactttgaggtctgtatggtctctgtttcaagttctcagttctgcagttgtaatatggaagcagctgtagacaataagctaatgaaaatggtgtgttccagtaatatttacaaaaacaggtaaaggcctattttggcccagtggtggtaagtttgccaacctctgaactaaaataagatgtatcaaacatgtgtaagtatcgaaacataatttgactaaacaaagtgagctgtagaaggattcaaacattttattaccatttggattaaatgtaaaaacctgctaaaaaatgcatttatgggtatgtgcatgtatttgaatgataaagattgaatttatgatagtggttgtctctggagagggaaggatgtgggtccagagaggaattgattacagtatttaatttctttataaaaaggatctgatggaaatacagcatgatattaaaatatgattagtacatgggtgtttgcttccccccacctttttgtctttatatttgaaatactttacgaataaaaaacattagtatgcaaggcaatcaaaacatgtctgcagacttaatttgactcagatgccatcattttgaacaacctctgctgttcatgcgtgcaagcattctaaggatatcagctttgtagaaaatgatgagtctttatgtcaacaagttggaatctactacccatatatttggaggttttcaatgcaataacagtttgtgataggtgatatgaatgataaccaagatgtaagctggttttcatcaacctatatcatttcttttatttctgtttacaaaatcaggcataacttcttgacaatgtacatatattataattactttttaatgaccttgttatctagcattcctcatagtatctttctgttccctctgaggtttctcagagttttatacagtgtcagcttgttcttattagatctaattatttcataatccaatttaccatttctactcatcatcgaagactttcctcagtactgtcctagaaaacctgcaaagcattgtacatttctaataatatgatcttccacaattattgtttttcctgtgccaagatcaaggatggcatacttttctgttgatctcaaactcatttagttacgagtcatgaaatgatccatatattgagctttattgaagggcagaggttttgttttgtttacttctgtatccttagcaccttgaaacagggcttggcacagaatagctactcaataaatttgtgttgagttaataaataaatgaatgccattattcttttcagaggatataattttacatggtttctggtggaatgtggtgttattccaaaggcagctttagacattgcagtggcagaaggaaactttcagaattctgagtttatgatttattaacttggagtttcaccctgtgttccctaagtttttacttcttacattaatataatttgatttctaagttcctgatgttttctttttactttttttcataaacgttaatgtctaaattccaactatggttccttttctcaactgaaacttatttgtgtgactatgcaaaccttctttatacttaatgcttattatctgtgctattgttttttcagtgttgttcttagtccttcactttctatcactgctaccctttatggtacaacatggcctagtcagttgagttaccaaaagattaaaaaggaaatcgtggtcgataatcccagcactcggggaggctaacgtgagaggattgcttgagcccaggagtttgagaccagactgggcaacatggcaaaacccggtctctaccaaaaaaataaaaaaattaaaaaaaataaccaggtgtggtggcattctcctgtacttgggaggctcccagctatttgggaggctgaggtgggaggattgcttaagcacaggaggtcaaggcttcagtgagctgtgatcatgccactgctctccaaactggttgacagaatgagaccccatctcaaaaaaagaaaagaaaagaaaattgtagctcttcctgaacaagtcctgaaatgtctttcccatatgcattgaggatcttcaagataacctcccagtttggtaatttgttaaaaggactcataggactcagcatatattgttactcagggctgtgatttattacagtcaaaggatacaacacaaaattagcaacgggaaaaggcacatagagcgatgttcagaggaaaccagacacaagcttccaggagttctctagtggagtcactcaggatgtacaaaattcctccagtattgcttgtgacagcacatatgaagtgttgtctaccgggggatattattaaattattaattggcacaggtttattgggggctagttatgaaggcaacctctgtccagcacatatgaaaatgctagacccccagaaggaatgcaggtattcagcataaaccacattgtacaggcattctaggcatagtgagtcatgttgtcagttctagtagtcactgtctcctcacttagccccattaacagctgtggatgggcctttgtcatcaccaaggtacccgtttcccaaagatgaagaaatttgatttcattttgttgtctcttggtgtcaaaaacataaaaacatttttcctctcctggacatcttcaactctaatgcctttaccaccaagcatagtttcaaacttctagggagcttctctctgtaactaattggaaaatttcttttctgacctcctaaccctgtatggaggttgttggttttatatttagtaaattattaaacagcaacatgttttttaaaacatttgtactgaggcctgacattgggtagtttctccctgcagtcaggttacttgtcagagatggggcatgactccaaagagaattaatgtatgtttttgttatctgaagtgcccttgggggttccagaatcctcctgaagagcccatgtttctttagcaaaagaggtttttcaagtctgaatccaggatacaggaactcaaatgaaaagcttgttctataggagtcttaaaatagaagataagaggctacaaataatgaaatcaaatttgtagaaactgagaaatttcaatcagatgtaacaaaaagatccttgctggagaatatataccagtagtagtacctaactctcatccaagttttttaagctatgtaatttccatttgaccacttattctttatagattgaatttgatcgtagattataatttaaataaaataaagcatagccacaattcgagtgctgactgcaacctatcctagcaaacctttcacacacataccatgtctgagatattctcaatattgttgcaaataatccctaatcacctgtgtcaacatcccagaggttaagtcaaacaaaagcagagaatagggaaatgtataacataatagattttatttgaggagtcctatttagagtgattgccagatccatatttttcacataatttcattccttaataactggtacttcgtcacaaattatcaagcagacgttgataagttatctgaagatttgatttcataagcttccacaataatgatgctgtttactaacagaatatccatcctatcccaacataaagcccgctgggaaaaaagtcattctttttaactagtaattacatgcttgtccctatctcactatacagtaatattttatttttagtctgtctccactacactgtatgttctttaagactttgaattattctttgtcttttacatttatataacacctatgtgagcatgctcgtaattttccagggtcatacagactgaaatattgctgcttttgtcctttgttaattccatctaaaacatggactaggcactcttaggtttcagtcatctgagtagatgtttaatcaacattcgagaaactatgtgggagaattaacggcaggtgatgatggtgggacttgaagcctgtttgccaggggccccggttgtgaacatcattttcagtactgtccagacacaggggcaactccctgtcatttgtgactctttccgtcttggctcttgcctctcttctttctttctttctttctttctttctttctttctttctttctttctttctttctttaattaacatcaccatcttttctgctattaaactgtcaccatcttgatcttctctccctcttttggcctttactttcccggccagagtgtacttctggtttcttttggagcatccaatctccataaatctcagcctttgacctctctgtctctctgtttctctctctttcactttctctctcttttgaaatagaatttacattttattaaaaccaaacaatccttgcaactctaaaaattgtatttttatggcaccttatgacttcattgttatttatcaaacttcaggtaatagctgattcaaaaagacttgaactataacttaaatattttgtgatttatgaaacttcttaaaacaacttaaagtttatatcttgtggccaaggtactatagacctagttgggaagggcctgcctaagtgaacataaacatcacatttcattgattctaagatacacttttccacattttaacatctcttaaattgggattcatcttatacttcatagtatctcacagtataattggtgaatctttttccttagtattataaaaatgataatgatgggacttataattaaaggcaacttagatttttactttttacttaagtagctgaggcttaagaaagtttacaaagtctgactggtaaccttcacacacagaagttttgtttgcatgtagtccttctcttctttcctgcccttgagatgggatttgttcccttgacctttaccccctttgtgggcaggaactggagtggctcatttcacccagcctgcagtctgtggatggccaagtgttaacagcccagtaaagggtcagagtgacaggctcctgcacctgccctttttgacactcaagttcttgtttggtgtccaggaagaatcaggtcacacaaaccatttgaagggtagtgtatgcagaggatttattgggcgataaaagtggctttcagcaggatggggaattggaaaggggatggtgtgggaagaaggtgatctttccctgaagcctcattgtctgaagttagctgcatctatcagtagtcttcgatgctcagccacatgtatccctgaggctcagcagcttgcatccccaaccacttgcatcagctgcttgtgttgctcttttttttttccctgccagctgatctagtttttatgggcactggatagggggcggggtaggacaaaaaggcaattatttgggtggaaaaatggggtcagctgttttcacttagggccaaggttccaggcttgagggtgaggtttagccgggagcccagcccttcaggggtcagctgttttcacttatggccaaggttccaggcttgagggtggggtttagccaggagcccagccattctgtatcaccctcaccaggttgcttcatgctgacctgcaagtggttctgcttatgctggcctctcatgagtctttcagttaaatctttattggatatgtactgtgtgctaagaattgtggtaactactggagagaaagatgagcaaaatcgtacatggtctttgcttttctgattatagactcttctaaaatagtgttaaccattagcattataaaatggcccaatcataggccagatcattctgttgttcctgtggtgtctagatttcttaatgtttccatgttacataaggaaggagccattctgggtgatcatttaggactctgtatccagtgaccctgtatgggtagagtaacagtttgggttgactacttgaaggtggtttacctccttcatgccttcatcatttacttctcagaggttttcttcatactgcctgtatccaatacgttgcatctgtttttgtcaaacttttcaatgaattatgtatagcaagtctaaatggagttgccttagggtttagtttccctctttactcagtgattatttgatacagctccagggaagattccactgggaatgtgtgtcagctggcacttgctcaagcctacagtgaagctgttatttcatttcttatgtttagttattcttaagaggttggtgtctgggttagagttttcttagtcccctacctgttttcttagcattcgctgctggaatctataaccaactccccaatggactgcaggtagccaacatgcactctcttggtagggccttgcccgcattgaactttgcatttgtttagtaaatttaattaattttgtatagattataaatgtacttagcacaaaatttaaaaagtacaaaaggtaaacaataaaaagaaagtctactttttacacctggctcccagccaccccattgccatcccaggaagcaaccatagttaccagtttctctagctccagtattttttaaaaataactttttattatgtaaaatcaaaaatgtatatggaagaggataatataaagaacctcctggtatccatcatgttgctccaacaattatcaaaaaataaccaatcttgtttaactctactcccacccactttcttggattattttgaagtggatttcatactaaaatcatatgatgtttcagacatcataactaaaagatagtgcctcttttaaaaaacatatagccataataccattttcacactaaaaagcaaaaataattccttaatatcattgcatttaaaatttttcaatgatgtattttcttttcttttacagtttggttgtttgaatcaggatccaaacaaggtccacacattgcattttgttaagtctcgagcctcttttaatctatagctcccctcacttttttttcatttatttgtggaaataactgagttgtttattctgtagaattattccgcgttcttctgattctgttaccaaatatagtctggtgactgttttttctatacattggtattttgatctagacgcttaatcagttgtaggtttaattttttggcaaaaatactttagaggtggtattcagttttaattttacagattaagccaggtaagttcctggttatttttcatttgtttgttttgttttgtttacaacatggtttttaagtacacgggctctatagtcagactatctgggtttgtattccagctccacaacttagtagctgtatgaccttgggcaagtcctatcaaactcactgcatttctccttatttgtagattgtggatcatagtagcatgtaattcatagtactgttgtgaggaataaccaaatccaatgtgtgtagagcattttgaacagtgtctgtctttgagtaggtattcagtgtacattaactattgtggtactatatttttatttctccattgtcttgtacggtatagccagggctgctgtattgttctacgccagggttcactgtttatcttgtaggcttttgaatgatactttttatggtgctgtacaatgagtagtccgtgtggccatatgtagcagcccatatagtcatacaatacatgaacttgtgttgttcagctcttttatgtttttcatagcactactattttataaacaggatttagtgtctatctggatttcttattcgcaaactcatatatcacattgcctttttgtttctgtacccctcttccttgaaatatacatgtgtttgtgcccatagatacacaccacatgcattttcaaagtcaaagctaaatagtattcctcttacaacctctcttccaactgagtgatgtgaagattatgtagtttatgctggtttccacttaacacatctatggagagttgaggctatcagccagctaccaacaaaaaggaagtgaatcgattagcagcatgcctggggactgtgtagacatgcccacaaacctcatgttgttatatgatctgtccttgggatctggccaaggttcttggtattttaatcaatatgagatagatatttccagaattaggaccccatggggtgacccatgataatctggacatcatttttgtcaagtttaatagtttctctgtgaaaaaaaataatattgtgtgtgtgtctcctccttagatctgacatagaaggcattcatggaaaagtatacctttctatgctgcacttgagaggtggtaggcctgtgcacaggggagaagagattaggtcattaataaaatggtactcatatcctttctaatttaataagtcaatataacttctacagatgtgacactagggaattaaataatacagaatcccgatttttaaagttttctaatgcacaactatttcactcatatgtacacatatacatacatacatgcccaactagccaaacaatatataattatagtaatcctttacaagatgtccgttctagtcttaatcaaaccagtagcaggtttagctcatggagtagtttagatggaatgtgcttaggaaggtctgacttcaaagagcctttagtcagagcccaagcaactttctcagctctctctgatgatttcatttttctcttggctaatatattttatccatcaatgtcaggttgggccagaaatacttgatttcgagatagaagtcattgttttttcaggttttcagaaaaataattacatttattattgtgtattatatatggggatagagacaggtacacatttgttaatctgtatcttccaaggtccccatattgttgactagagttggcagatgggtcacaagcccaacacgtctttacccaggctttttcaggtaaagaaatgcaagttcagattgctctttatatatgtgtttccaaagcagacatataaaatgctcctcataaatcaaccccttgtatttcctttcctatgatttaactcatgtttttgttgatacaggcacatttaatattataaccattcattgtataaaagattgctgttatgttttgctgatacagtgtaaattggcagagttggtcctggcaaatgcagaagtcactgtaacatcttggcccatcctgcctcatattgtatcagtcttcccatatgcacttcctcatattcataatacatatagtattcaagaactttatgtacagcaaaaatatttttacacatatttacttgtccatctaatttcttattcaaaatactataaccaacaaattcgtcactgtggtttaatcacaacacagaaacataccactgatactatatgccatggtttataataagcactttgtaaatttttgcttatttaaacctcacatcatgtttatgagttaggtgttattattattccattttacagatgaagaaagtaatgcacaaaatttaagtaaatttcagaaagtagaccctgaatttgaatttagatattttgacactaggccaagcgcggtggctcacgcctgtaatcccagcactttgggaggctgaggcgggcggatcacgaggtcaggagatcgagaccatcctggctaacacagtgaaaccccgtctctactaaaaatacaaaaaattagccaggcgtggtggtgggcacctgtagtcccagctactcgggaggctgaggcaggagaatggcatgaacttgggaggcggagcttgcagtgagccgagatcacgccactgcactccagcctgggtgacagtgcgagactccatctcaaaaacaaaaaaaaaaaaaaaaaaaaaaaagaaaagatattttgatactagtatctgtgctcttaaacactgccatttttactactaaaattgtgacttgttacacttgcctttgtttctttgttatacacacacacacacatatatttaataactttatatttaataatatttaatttgattaaaatttgaattaccatatgtagccagtagtggccctattggacagcacagattccagcacaacacgtaacttagggatgacactcaatacatatttgcttaaggaaggaatgactctcagatttatttttccagctcagatctttcccttgaccttcagacttatgtatgtaatttcttatttggcaccttcactgaatttctattagacattttcaaaccatctattagacagttccaaagacatttccaaatagttcatgtccaaaatgaactattgatctttctctccaagcatactccatccataagcttctccatttcagtttcttctactctctcagactaaaaacttttgtcatgtatgatttttgacagctaatctaccaacaaattctgtagggtcttatttcaaattatatacataatctgaccacttctagtcatctccaccagttttactaaaatttaagccacagccatttttgttccatgttattgaaatagaccttttatatgtctcttttctctgctgtcccagttacgctcttactgttgtctacacagcagctagactgttcttctgtattcaggccaagtcagagcagaccattcctctgtttaaaactcaccagtggtttctcatttcattcaaagtaaaagcaaaggtccttccaataacccaaaaggcctatataatagctcccgctcccctgtccaataccctattctctctcttggtctcatcatttttaatactctcccttctttattccactttactttcactggcttccttattgtttatttttttaagaaggcaaggtaaacaaatagcttaagtatttttatttgtttgcaactaagcttgttaacactatataatgaaaatgtgcaaagaataatgttgcagttttcggttagatttaagtcaaagatattcattaataaggaatcttcgaacgtgaatattccagaaatttctctaagccatctgatcagaacaactgtctctgagtattaccttactttgtaaggtattggcatgcatttgaattaaactcagattttttcaaaataagtcctgattaaaaaaactattctatattcaaactaaaagaatataaatagaacttttcctttccagaaacaataaaggaaacaaggcattttgtaaaatatggtcctgagcaagttgcagtaaaaaaataaatgtatacttctacctgctcaaaacagaggctactttcttttcctcagtcttggaaacaaggtgaagaacagcctaaatgtgacttcgggcaggcggttgccaaaacagctcaagcagttgaccatggacacctcaaatgaatttgggagaacctcaccaaaggatccaaattctatttttaataactgatacaaaggtgaagtggctcttcccaagtagcagtgctgccagggcctggccctggcccaggcccaggcccagctctgagcttacctgctatgctcccaagcaaaccatgatccttctgctccagggcagaccttttccctttagaggttcagtgtccagggagctctatgattgtgtgaatgaggtgagcgccgactccatgtgagtattttaaggcttggagtcaaagtatttttctaacacgcttaggcagagtccatgtgtcaatggcccatctccagtttgttctaatttctcaccacacatttgtagatatttctcaccacacatttgtagatctaggaccacagacctttgctgtattatcataatcacagctaatgtccatcctaacttatgattcatattctatgcctggaaacagtccctgtatttaacaataaaacctacacataaaaacaatccactgttgcaacttatatggtcacaaaacgtaaatgatcttctgtagaacaagcaattttttttttgttttttgtttttatttatttatttattctttgagacagagtctcactctgtcacccaggctggagtacaatggcgcgatcttggctcactgcaacctctgcctccctggttcaagtgattctcctgcctcagcctcctgagtagctggaactacaggtgcctgccaccatgcccagccaatttttgtatttttagtagagacgggatttcaccatattggctaggctggtctcaaacttctgacctcaggtgatccaagcacgtccgcctctcaaagtgctgggattacaagcgtgagccacagcgcccggccaagcaaatgtttttaaccataattgtcatgaatcaagctcagccagaatccccaagatcaaaaaaaaattgcactatacaaataataacttgaaatatacatacacacgctctcatacacacttcttacagaactgtgcttggggaagctccatttgttgagtgccactgaaggcatattttgctaaactgcttctccaagtattttgttttggaaaatctatcacagtagggcacagctgtttactggatgagcagaaaaagggagatatgcttgtggcaaccaaaaagttttaaggtctttcaagttgtataaaatggacctacagaaacgtttaagtgttctcaggatgcaaaattgaagctgaaatgtgttgtcaaaccagttgcaaaaagtgtacagcaggcatctcttgaggttaaacctggtacccagatacataacaaagcttcaggacacatggcttgttggccttgtcccataccgttgcataatctgatcatgtgtgaatttcacaaaagattcattcatattgttctgctagtttggtattgaggatttgctcatactcctcctgaatcttgtcttcatagtctaagacacactcacgtattattccgatttgtcagagggtaaatgtgggctggtccttcttcatccatgaggaacctggagagctaggtgctatgagtgctgaggagtgaggttgactttctgaagcacaagcttcactctgattaagaacaatttctaaatgtctccacctctgataacgactgtattctagttttatgttctgaaaaattttctccggaattgtaaggcgccgcttgctgccgagtggggcggactgctgcagagttggcggtagggtctgcgtctgaagcggcggcggcttggcgtccgggggcctgaggcccggagtggggctgggcagaggggtgcagcacggctgcttcggggaagcagggactcagcagctttgtaccgaagtccatgggccgcttcagcgtcgcctggttcgccaggtcgctgacgggccagggaccgggagcggactcgggtaagtgcggcccaagctccggctcctcagtggggctcgccagccaagccctattgtttctttttctttttttctttttttttttttttttgacacttagtatctcaacattttattattatttttttttaattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttgttgttcttgcgatagtttactgacaatgatggtttccaatttcatccatgtccctgcaaaggacatgaactcatcattttttatggctgcatagtattccatggtgtatatgtgccacattttcttaatccagtctatcattgttggacatttgggttggttccaagtctttgctgttgtgaataatgccgcaataaacatacgtgtgcatgtgtctttatagcagcatgatttatagtcatttgggtatatacccagtaatgggatggctgggtcaaatggtatttctagttctagatcacgtatttcaaaataataagagctatctatgacaaacccacagccaatatcagactgaatgggcaaaaactgaattttcctctaatcgcctcattaaatgtatcccacagattttgatatgtagtgttttcatgatcatgttttaaagacattctgtgattttaatttgtatttctttctttaaagaattatttaagagaaagcttataattttccatgcggaatggacttaaaaagtgatttctagctttatcgtagtattattattagacaatgtttataacatgtcaactttatggaacttactgatgttttctttgtaacctaatatatgatcactttttgtgagtatttcatgtgcaactgagaagtatagtctctattaccgggacataaaatatgatatatatctgtaagattgttatttaagtcttctacatctttacttactgtttatccacttgatttgttgtttaatgaaaatgatgtgttaaagtttctttttagtgtgcttttatatacatcgcctgtatttttgctttataaaggtggtgtctgtattactttatgcacagatattcataattgccatatctttatttggagaatggcttttagcatttaaagtgttctttgtggctgggcacagtggcttatgcctgtaatcccggcactttgggaggccgaggtgggcggatcacttgaggccaggagttcaagaatagcctggcctacatggtgaaaccccgtctccactaaaaatacaaaaattagtggggtgtggtgggcacctgtagtcccagctactcgggaggctgaggcacgagaatcgcttgaacctgggaggcggaggttgcagtgagccgagattgcaccactgcactccagcctaggccacagagcaaaacgccctctcaataaataaataaataaataaataaataaataaataaataaataaaagtgttctttgtttaatttaatgctttttggcttgaaatctattttgtctgatattgattccatttgcctggtagacttttgaccattcctaaattttcctcttttgcttcacattcctttaaactcccagacttcacagggtatctctcccttattttttgccatcttctctcttacaaatgatacctttcaaagtctgccttttgacaactgcatagaaagctcttccccaaggctcgaatctaccagtttgtcattatttttacgctttgtgtggactttgtctttctggttgtgatttagattactcttaggctactagccccttcttttctcattaactctcctgtttcagcattgtccttgctccctggaaagacttgaagagggaatatgagtgatatcttgctgagatttctttttttttctacttacaatttaatagttaagtcttttattatgtgggtgttttctttctttttgttatgtgaagggcatggctttatgtacttttatgttgttctggtggctctatattgttttgtggaggatatgtttggaaattttgatttacatagtcaccattgtcttaacataatattttccatatggttaaaaatactttgtaaatattttaatggctatatactatgatacaaaaatataccaaatttttccaataatttccctctttagtatgttagttttttccttttatgtgatgacgtatttgtgcataagttaattccactacatactttgggtagatttgccaaaatataatttttgcctcaaggttataaatattattaataatcttgacatagtttgaatacagggagaatcaattggcatatggatttatattaagctgctaactagggtagcctccatccttttttcaggtagcaccttcctcttttacatatatatcatgagcctggcctgaaatagctagtaggtaccagtgtggctgtttctggtgtttacagccagcatctctgttgagtgatagaactttgtgccaatattagttattaagtatttggagatcttccacctccacagattataacatttgttattctgtggttggattttctttacttaggacacacacttgtgttatattcagcaataacaaaagaaccaatggcctttctttcagctgtcctttagtctggcatccctggattttataattgaagaagaggggtgatatttaagagcccaaaatacaactggcaagaccttaacttggagaaactaatcaatcctcacattagtcattactgcttttgtggcttatgtcagagcatgatgggcttatttctgctcacgctttctgttagtcacttgtttttcctctcacttgatctgttttatcaacttcagttaatcaaagctgggcttcctattcatgcaactagatttttctcagtaatattatattatctaccatttcctgaattaattgagacactctgacatgatctgtgtactttaggtaagccattgtaactttctatagttgttttgtttggtttgcctctgaatgtaaaaatagcattgtgtgagaacacatttgagagtggtggttagggtctttaccaatatattttctatgattatttttactttcaatcttattattcatcacattacatggtagatggcttagcaatatttagacagtaattccacaaaccactttcatcctagaatcacctttgagacattattatttttttaaatgcaaactgccaggcctcatcatggacccaatgaattaatctcttgcattgggatccagagatctgcattttaaacatctgcccaagtgactctcatgcagtttggtacctgactgtagacttatttttgagatgcaaagtttaatgcataccctaccaaatcatgaccccagtgcacctcttaagtggtcatctctgtgctagtttttagagcttgtcacccttgctgtatatacatggcatgctccagggtgcatttaaagcgttattttctacatatgtttagaagtcattccttaacccaataacctattaaaatccacttatgttttatttgtattatttagtggttttattttacattttatctcctccatgcacttgaaattgaatatgttgtttggttgtgaaatagagatctaacttatttttttcccaaatagttaattgtccatgttccattttttgaacaattctgctttttttccaccaatttaaaatgccgcttttattgtacattaagttcttacatttatacgatggtcttatcgtgagctttcattttttccactgacctaactattcttatactactatgaccatgccacataatcattttccttttgagtagcacaaaccttccataattattctgtttaaaaaatgtttcactcattttgctagtttattattccatgtaaactttagaattattttatcacattccagaaaattagcttgttggcattttgattacaattatactaaatctattaattaattggaatgaagttgacaacatgcaatatttagtctttctatccaggatcacaaaattttgtttttcatttacggaagtctttttgtgtgtgtaatacttttatttatattaattctgagacttaaataaatcactctcctctctctctctcccacacacatacagtgcaactgtttttttctattacaattttgaagtgtctgttactaatatataggatgcttatgatttttatatcttcattcactgaccaggaattttaacaggcttccttgttaatgttaaaaacattatcaataggtctaagcatggtggctcatgcttgtattcccagcactttgtgaagccaatgcgagaggatcgcctgagcccaggagttctagaccagcctgggcaacataatgagaccccatctctacaaaaattaaaaatacaaaaattgctgggcatggtggtgcgggcctatagtcctatctactcgggaggcagaggagggaagagcccttgagcccaggagtttgaggctgaagtgagccatgaccacaccattacactgcagcctgagtgacagagtgagaccctttctggaaaaaaaaaaaaagtatcagtaatttctcttgcatttttcagttagacagttatatgataggtaaataatgattattctatctcctttccaataggtttaacttttctgtttttgtttctttttaaaattacattgagaacccagttcctcaccacctttgctgttcattaaactcggtgaagagttttttaaaaagtatcaggactcacctgaatcagagattctggtttacctgatgtagggggaatgtgggtattgtcatttttaaaagcttctcagatgtttctagaagctgtgtttgagaatcattgttctagacactctgaccaaatgataagtagtactagtgatagcagacatccttttctggcttctgatcataagcttctagtattgcaccattaatggtgatatgagctgatcatttgagattgactcagtggtgtgttggaggcagctggtacctgctcaaaaggtgtaactgtacacatattttcccaacttcacattcattgacattatgttgatcacttcaaatcagccatggttgattcacatggaaattgacaaatgctaaaatcagcgctccccaccttctctgtcaacctgttcattatttgccagcacatcacagtagatctttattagcttaaagaagtattcttttttaaaaaaaagaaaaaaataagaagtattcttttattattaggctatgaataatttttgtccttcattatcatttgcatttcattgcaaccaccttttaatcacattgtcaccttatatcagccacgttctaaaaccttgtgtttctcactgtaaatgcttttttccagagggattcctgtattctgattcttcagagagttttccttctattaaactacattgacttttcctaaacctaataactctttttatggaggaaactttttttcttcttcatcttccctcctcctacccttcctgtcctctgatactcaccagtctactctctatcttcatgagatctacagacctaagaacctttttagtttgttcttttggttggtttatagacaagcaagagtcaaatttgagtttgtaagatatcagtgtgagttcttgcataaaaattccagatacaaatgagtaaaaaagtttaaaattcttctaataatcactgctgtggtgagccacggattcagaaggtagggtgtttgggtggaaaagagtggttcacagtgaccaacctagaggaaaagatggactgcatgttcttcaggcaatcctctatgaatactgtcttgtcacaaagatgtatgtaagaattacagactatggccgggcacagtggctcatgcctgtaatcccagcactttgggaggccaaggctggtggatcccttgaggtcaggagttcaagaccattctggccaatatggtgaaaccctgcctctactaaaaatacaaaaattagccaggtgtggtggcacgcacctgtaatcccagctactcaggaggctgaggcacgagaatcgcttgaacctggtaggcagaggttgcagtgagccgagattgcgccactgcactccagcctgggcaacagagtgagactctgtctcaaaaaaaaaaaattgaattgcagactataaatctggaattgccattctctgagaagtaattataatgtacaaatcaccatctagtcagataaatgtagaccaatatgctatacaatcaagctgaaattggagttgacagtgtcttgtgaatattagggatcctaaacagacacatggctaaattggtgtttattttcactgagaatggaacaggccttgggcagggccatgctttttctatacccagatttttgagggtttttatcctgaagggatattgaattttgtcaaatgctttttcagtaacaattgaaattatagtatggtttttgtccttcgttttattggtatgatgtactgtattgatttatttgtgtatgttgaaccatccttgcatccctgagataaatcccacttggtcatgatgaaggatttttaaaatttgttgaatttggcttgctagtattttgttgagggtatatatgtgtgtgtgtgtgtgtgtatgtatatatatatatatatatatatatattgatcagcggttatggccaatagctttttgtttgtttgttagtttgtttttttgatgtgttttggtctggttttggtatcagggtaatattggccctcgtagagtgagtttggaagtactccctcccccctctattttttcagaatagtttgaataggtttagtattagctcttctttaaatgtttggtagaattcagcagtaaagctattgggtcccagacttttctttgctgttagactttttattatgcctttgatcttgttccttgttattggtcggttcaggttttggatttattcctggttcaatcttggtaggttgtgtgtgtctaggaatttatcaatttcttctagttttccaatttattggcatatagttcctcatagtagccactaattaccctttgaatttctgcagtatcagttgtaatgtctcctttctcatctctgattttatttattgggatattctctctttttatcttaatctggctaaaggtttgtcaattttatgtatcttttcagaaaaccaactttttgttttattgatctttttgtattattatcatgtcaaattcattttatttctgctctgatcttaattatttcttctactaattttggatttggtttgctcttgcttttctagttctttaagatacatcattaggttatttatttgaagtttttctttttgatgtaggcattatagctataaccttccatcttagtactgcttttactgtatcccatacgttttagtatattacatttccattatcatttgctttaagaaaatgttcagttttcttcttaattttaccattggcccactgatcattcaggaggatattaatttccatgtgtttgtatagttttcaaaattcctcttcttattgatttctagcttttttttccattgtggtcagagaagatacttgatattatttcagtttttttgaatgttttaagacttgctttatgggtgggtgcagttgctcacgcctgtaatcctagcactttgggaggccgaagtgggcagatcgcttgagtccaggagttcaagaccagcctgggtaacatagtgaaaccctgtctctactaaaagtacaaaaagttatccaggtgtggtggcacacgcttgtagttccagctactagtgggggctgagatgggagggctgcttgaacctatgaggctgagactgcagtgagccactgcattccagcctgggtggtggagtgagaccttgtctcaaaaaaaaaagacttgttttgtgacctaacatatggtctgtccttgagaatgatccatgtgctgaggtgaagaatgtgtattctgtagccattggatgaaatgttctgtaaatatctactagatccatttggtccatagtgcagattaagtcgaatgcttctttgttgattttctgtctgggagatctgtttaatgctgaaagtaggggtgttgaagtgtttagctattatcctattgaaatctacctctccttttagctctaataatatttatatgtttgggtgctccagcattgggtgtattatatttaaaattgttatttcctcttgctaaattgacccctttatcgttatggggtcataatgatcttctgaagatttaaagtagtgaagggaaaaaaaaaacttttattctagaatagtatgtctagtggaaatgtccttcaaacatgaaagagaaataaagactttcctgacaaacaaaagctgagggatttcatcaatacgagatctgtcctacaagacagatgatcttctttgtctcttacagtttttgtcttgaagtctattttttctaatataggtatagctactctgttcttttttggtttccattggcatggagtatcttttttccacccttttattttcagtctatgtgtgtctttacaggataaatgtgttttttgtaggcaagagtcatttgatctatttttttttatccattcagctactgtatgtcttttgattagagagttttgtctatttatattcaatgttattattgataagtaatgatttactccgtcccattttattatttgttttctgattgttttgtggtcttgtcttccttcttttcttcctgtctttttagtgaagtagattttctctagtggtatgattttaatttcttcctttttattttttgtgtatccattgtatcttttttgatttgaggttattaagaggtttgcaaattctctcttataacccattattgtaaactgatgacaacttataactgatagcataaacaaacaaacaaggaaaaaaggaaactaataaaaactttacaccataattttttctgcccacttttcagttttttgttgtttccatttatgtcttgttgtactctctatgtctttaaagttgttggagttattatttttgattgattcattgtttagtctttctacttaagagtggtttacacattacagttacggtgttataatattctgtgtttttctgtgtacttactattaccagtgagttttatatcttcagatgatttcttagtgctcattactgttcttctctttctgaatgaagtactctctttagcgtctcttgtaagatagatctgctattgatgaaatctctcagcttttgtttgtcttggaaagtctttatttttccttcatgtttgaaggacattttcaccagatatactattctagggtaagagtttttcttcttcagcactttatgtcatgccactctctcttggcctgtaaggtttccactgaaaagtctgctgtcagacatattcgagctcctttttatgttacttgtctcttttccccttgctgcttttaggatcctttttttatccttgatcttgaggaatctgattattaaatgcctttagatattcttgtttgggttaaatgtctctggtgttctataaccgtcttgtacttcaaagttgatatcgctgatactatcccactgaataagcttgctacccctgtctctttctctacctcctctttaaggccagtaactcttatatatgcccttttgagactattttatagatcctgtagtcatgcttcgttgtttttcattcttttctcttttgtctcctctaaatgtgtattttcgaatagcctgtcttcaagctcatcaattcttctgcttgatcaattatgttattataagactctgatgcattcttctgcatgtcacttacattttttaactccagaatttctgcttgatttttaaaattatttcaatgtctttgttaaatgtatgtgatagaattctgaattccttttctatattatattgaatttatttgagttttctcaaaatagctattttgatttctctgtcttatatgtcacatacctctgtttctccaagattagtctctgatgccttatttagttcattttggaaggtcatattttcttgaatggtcctgatgcttgtgaatgttcatctgtttctgggcatctaagagttaagtagtgtagtctttttagtctgggcttgtttgtacttgtccttcttgggaaggctttccagatatttgaaaggacttgagtgttttcatccaatccatatctgcattagagagcatcccatacccagtaattctgtggttcttgcagatttgtagcggtaccaccttgatggtgttgaataagatctggaagacttctctggattactaggcagagactcttgttttctttccttactttctccttttacttttaaagtccacttttacttttccctctacttttctgaagcagaaggagtctctccccacagctaccacagctgggaacgtgttgagtcatacctgaagcccacaaagtttcgtctaaggcccaatgagtactatctgggttttgcttctggttatttagggtccaaaggttctttagtcagcatgtgatgggtcctgccaggactgggttcttccattcaaggcagtgggttcccttttggccccaggtgtgtgtagaaatgtctgggagctagagtctggaaaaggggccttaggactctgatgagtgctctaggctactgtggctgagctaatatacaagatgcaagacaaagtcctctttactcttgccccctcttttcctcaagcagaaggaaggggtatcttttggagccttgagctgtgctgtgtggggtggtgcaaggactcccatagccaccatggctggtgtctcagtaggttgcatgcctcccaaattcactggctctgagcccagttcaacactaggactaatataagagttgcagtccttgtggcttagagtgcccttcaagtttatttagggatccagagcactttagcctgcagtgtcaaggcttagaactaggatgtgtgattcccctctagctagggctggtttaaatgctccctgtgtgggttgtccttagctgagttcagcctgattttgctttcttccatgtgacagggtagcacggagttcaatgcagtgtctcacaattgctgcactctctctttctgaagtgcacacattccagtgtctctttttttggagaaatgtttgctcatattttcttacccattttttacttgggttatttgttttcttgttatttagttgtttgagttacttctatattttggatatcagccccttatcagatttatggtttgccaatgtttttacccaatccgtgggttgtcccctcactgtgttaattgtttccatttctttgcagaagctttttagtttggtgcaattccatttgtctacgttagcatttgttgcttgtgtctttagagtctgatccaagaaatcattgcccagacaaatgtcatggagcttttcacctatgttttcttctagtagttttatggtttctggtcttacatttaagtctttattcattttgtgttgatttttgtatacagtgtaagatagagtccaatttccttccgtatgaggatatccagtttttccagcaccatttactgaatagagtatcctttccctgttgagtgttcttgacacctttgtcaaaaaatcaattaactctaagtacttgggtttacgtctggactttctgttctgtactattggttgattggtctgtttttatgccagtaccatgctgtttatatgtgattataataacttcataatatattttgaagtcagagaatgtgataccttcatgttttttccttttgctaaagattgctttgactattcagggtcttttgtcatttcatatgaattttatgattatcttctatttctgtgaaaaatgacattggaattttgataggaattgcattgaacccagagaaagctttgggaagtatggacattttaacaagattagttctcctaatccatgaacatggactattttttcatttatttgtgtcttcagtttgttttatcagtgttttatagtttttagtatagcagttattcacttccttgactaaatttattcctaagttttttctttatttaatactattgtaaatgggattgtttttgaaatttttttcaaatagttcattgttagtctgtagaaatgcgactgatagaggctaaacattactctgatgttcttgtttttgcctcctctgttatttttggtttggcctaaagacttaaatatcatctgagaagcacagttcttttagtcatatttccgtggttacatatgagcccagttgatacggtggtaaggtgtcatgggtggggaggtcttctataagattatgtctctgtcttttagtgagctgtgcccctggcctgtgacttacttaagttcttctcaggaattttttttccccctcttgggagagatgggaaggcaaattgggtctggaattcggtatttcccttcacctcgttcgcttaggttctgataaaactccaggaggttttgatctggtaaaaatagtttctcttgagggaagaccttgttaagaagaagagaagggtctgtgaatatttttaaatgactacttatctttcccccctgctggaagcatgaggggatttttcaccatcaaaacttgataggactcttgtaggtaaaactcacaaaagtttgggagccccttttggactgggccctattggagtttttacctctcaaatccgagcatattaagcctccagcaatttgtaaattacagattaggttatcctatcccagtgctggttcgcaaggagttttctactcctggccttctgttactgtaagatttggttctctctatctatctcctcacttctggggacagccatttaccctatgaccccagttatctgatgaatctaagaagagttgattttgtttgttcagttttttcttgttgtgtgaattggatagattactttcttatttcttatatggcagaccagaatgcagtcatgtttttgaaatatcaaagatttgcttcttctaaagttttgatctcttaaaaactacttagggtaatatactttgtttttcttttaaaagagggaaaatgtaagatttttttgatgattaacttttgttttttgtttacttttctcaaatagatcctaaatgcccaggagatgttgattttcataatagtgactgggacattaagacaatcaccagctccttgaaattctacctcaggtatgcctgatttgaattgggagtttgcttttcatagctggtgaaatttctctgggtgttgagcggagttaacgtggtctcagttccaggagtttggatagaattgcttaagaaaaaacatgtgaagaggatttctggccaagaatgtgcaaagactgttttttaaatctgagagtttaagcaagagaagcataaaaataatagaattgttactgaaaaaaggctaaaaagattatgttcaaaaaacatgcacttgaaataattgaatacgttttgctcttcacagatagagtgatgttgtgatggattcactagtagaatcaggagctgggactattcagggtggctaacatgttttagaggataataaccattttgaaatgtcaaattgcatttgggcaaaaatggtatatgtgtgtgatgtgctacatatcatgtcttaatccaggtaatggaaataaaaaccaagaaaatacaactgtaataatattggagctaaatgaactgtcagcagtatggaaaaaagttagctcaccaacaaaatttgggaatgtgcaatattaatgaatatattgttcagtttattggcataaatttatattatgcaaaaggtgcttaagacatatatattttttaaacacattgatttcttaccactctttatgtctcatagtatgtatcatactttatgtgcaaaagcctcttcttttcaatgattgtgttcttgagccattaagattgatacataagttctgggaaatctcattaatctaaaatagattgggtttcagatattactgttaaatattttgctactgtagcatcatcttagagctttccataaacttgaatgttctttccaggaatatttctcctgcatctgctgataaagaaaagaactgttattggagggtttattctgtactaggctacggctagttgtttacactgatagtgtcattgtttttttctcccattaaccgagtgtactaggtggtacttgactcgttttgcagatgaggaaaccaaggtgcaccactttctccattaagtaatagccatggtcccagcttgtattttttaaatctcagtgtctctgacttataaggcccctggtactggggcatcttcttctcctgccccctactcccaggagctttggccttctttggatggcttggtaatttagtaaagacagagagcaatctgttacaaatactttaagaagacttgttgtgatgagaatagtgggaataagtgattctgtatctctagcttccttcaaaggagtctcaacattttcttagatttgtaaggccttccccacattgcattattcccagctcatcctataataggcagggtggcccttttcaaagatgagagggtcaagcctgaaagtgcgagtgggcggcacccccagtaagtgatatttgttctcgagactctcatccatggttctgtaatatataccagccagtaaataccctatagaattctcaaagatagctgtgttccaggacaggtctccacactctgttctaggtaactaaatcaccccttatctctaacctttccagagaagtcctctaaaaatcatcccttctctctcccctatttttatcctctctcattcaactggctctttttccgagtatgtaattatgctccagccacatacatctttaaatcagtaaatgattcagtaaaaatatcttgactgcttattctatgcccagtgtgatgttaagcactaggcaaacagttgtgtatagatatggtctctgaccttaaagaacttatagcctagtaaaggggacagtcagaagacaaataatcatacaaatgtaataaactctaataagtactctgaaggaaaggtataacgtgctatgaaggcatttaataggaagacgtcacccattttggtttaaactgaggtttgaactgtaagttggaatcaactaagtaggagttgggttccagacagagggaaatgaatacgcaaagacttgaggcaggagggaagaaggccccttcaacaaactacatgaatcagtatagggggagtattgagtgtagagagggagggagaggtatgtaagggccatatcattcatggctttaaaggatcttttaaaaattagggtctaaatttatcttaaaagtaatgggactatattgaaagattttaaacatgaggtgcatattgagatttgtattttgaaataaaaaaggatggagattagattacagtgatataaaatgggcagagatgtggaaatcagttagccggctatggctgtcgtccaggcaagagatgatgctcatgcttggactagggagtagcagtagatattcctagaagtaagcatattcaagagatttgggaagtacaattcatgaattggatatgaggattagggatagggagacaaaaaggtgacttccatgtttctggcccatacaaccaaatgatggtcatgcatttactgatttgagaaacacaagaagactaagtttgagggaggcaataagttggaatttggatatgtcgaatttgggtagctttgaagaaatcagggcacaatattaagcaggcaattgaatacataggtctgaaactcagtgatgagttcagggcttgaactaaaaaattggtgatcattgaccatatagatgatagttacagccaggaacttaaacaagattgcctaatgagatactttactcggtgaggactaaactctgatttttcatcttgcccaaattcctttctaaggggtctggggagtcatgccctccaagccataaattctcatcagatgggttttatttaaccttgtatatcatgacttactttccaatctgactctggcataacaagggagaaaatgaaaatgttttatcccaaaatatattttcttgccataccttgaaattgccctgcaaagtctcttgtgggaaaaatccacattctatagagaatccccttcccccattgttttccttcatttctttccagatccaggagataatcaactaagagccaggtgcccttttaggtctaataagaaacattttacaacgtactctctctaaagtctggtatctgagagattcctccacacaataaaacttggtctccacaatcctttatcttaacctgaacattcctttccattgatcccggtcgtcagataaactcaaccaattgtcaaccagaaaatgtttaaatttacctatagcctggaagcccccactttgagttgtcctgcctttctgaaccaaaccaatgtatttcttaaatgtatttgattgatgtctcatgcctccctaaaaatatgtaaaaccaagctgtaccctgaccaccttgggcacaagttctcaggacctcctgagggctgtgtcacaggccatggtcactcatagttggctcagaataaatctcttaaaatattgtacacagtttcactctttttgtcaacatcagccaagcttctgtgtcaagtaatatacactcctggtctgtacttcttaactccccagttccttcttaactcattgtaatctaactcttaccccctctgctccaatgaagctgcttttgccagggtcaccagggataccctcaatgctgcacacaaagcacagttgtcagtctttaccttacttgacctttttgtaacatttgaagttgttaacaagccttctttgatactttcttctgttttggattctgctgaatcacttgctttttgtttttctctaacctctttggtcattttagtcaatctcctttatgggctttctatttggtattttcctgggctctctgctcattttactatagtagaacaactgaaaactgaaatatctacagggaccaggaaataaaactgaatgaagtagactattttcatattaaacactttgcacattgaacctttatttgtatgacaagccctttgtttacatacaaacagcagtgttgtttacttctacaaagaaccaatagagccagatctttgcatttttcaacagggacaggggatatgggtttgtatatgaaatatctcattttaaaatattttgatcattgattcaattccatttcacttttatacactgtgctggacaaagaagaaatatcggaagacctcatgtagctgtttgactgccagtttgccagctcccctggagaagtggcatctgttcttgtggtttcgtcatctgttctctaggttcctgattttcacatctgcttctctgatctagcagagccctgcatccagcttcttagtagatatcaccttcctgaggcctccctgacttagcatctctacttccctcttaatcaactcttattctattcactcacccaaaccaaactgctcccttgccatcatacccaatcaaagaaggagttctttctttaatatttttcaaaacagtctcctcacctattctttctatgctttgtcacccaggctggagtgcagtgttgtgatcatgactcattgcaggcttgccctcccgccacacccttctctctctcaggctgaagcagtcctcccatctcagccccttgagtagtctggactacaggcacgcaccaccatgcccagctactgtttttaagttatttttaagaggtaggggtctcattcagttgtccagactggtctcgaactcttgggcttaagtgatcctcctgccttggcctcccaaagtgctgggattacagatgtcagccaccatgactagcccctctgtttgtcttttattatcttttgcttggattactacagtaacaacagtggcaggcagtatagtatagtaattaagagcatggactcaggagacagacttcctgcttctgccacttattagctgtgtaattttggatgagtttttaacttctctaggcctcagtttcctcatcgatgaactggaaatggtacctacctcacagagttgttatgaggtttaaatgggttaatacatgtaaatcacttagagcagtacagagtttgctattcttataattattagttgattacttacttcctctgagccacctaccatatacctttattttgtcatcgtacttgtcccactgcattgcaaattttgtgtatggtgctcttttctactaaactattagctcgttggaggtttggactatttctattcatctctggatccccagtacctggcacaatgccaggtacaagtaaatgctcagccaatgtttttttttttctttttttttttattattattatactttaagttttagggtacatgtgcacaatgtgcaggttagttacatatgtatacttgtgccatgctggtgtgctgcacccattaactcgtcatttaacattaggtatatctcctaatgctatccctcccccctccccccaccccgcaacagtccccagagtgtgatgttccccttcctgtgtccatgtgttctcattgttcaattcccatctatgagtgagaacatgcggtgtttggttttttgtccttgcgatagtttactgagaatgttttttgactaaatgagtaaacccatttgagcctgagtttcctcctcccgtaaatggggatttgaataactgctccacctcacaggattattgggaggacaattgcaaaagcacttcggaaattctaaggatctatcaaatcgtaagggattcatggtagcattcagcatgggtcccctctggaattttgcaggactggtttgtgcctctttttacttctgggagctagttggagaccttgctagagggctcagcccatgcttttgcaggtcttttgttgaattactagcaacttggattccctgacgaagcttcaggtgaagagaaaaatgtatataatcccactaagctgtagggctcaggaacttcagccttgctgtccccagaactaagaatccaatacccagctgctttcttcccaaagcaactgacaattttcattcatttcaggaatctttctgaacctgtcatgacctatagacttcacaaagagctggtctctgctgccagtaagtatttatgttactaattaactgtgttgtcctagtttcttaatgtttactgcaataagcctagaaaattgtttgaggggaagtgattgagggcacagaaacctaaaacacatacacaaattatgcacaactgccaaatgaaagtattcttgcttgctgtctaactcaagagttctattatttttcataattagtgttacttaagtgggcttgagaaaattggttaacttgagggttgtgtgaatataaaggctttatttatatatgtattcattgcctcttccatcagaacaagaacattggctcacattaccaggggacagaaaaatggttacacgacagttgccgtttcaacttccttcagcattttgcctgttcaaatgcttttcgactgtgttgtgaaccattgtccttaatctgttagtgccagcatcacattttctagatgagaaaactgagggagagggcgtcagtacataggaaataaggcatagagaatcactcccaaaagttggcgattaaagaagcattgaaagttttggctgaggccactgtatgagtgcccctctccacctcaatgtgacccttattctgcatcatatcctgtgtggtgtagaggaaaaagattcaggggacttaacatcataatgcgtctttgttgaaacaagggagctttgttctttacttctgggctctctcagtgattttaacaggaatccagaggcagcagcacacttctcagtaccacaaggaaggtggatgggaataggtttccagctggaagtttatctgtgagacttcaggaacaacctgctgtgctcagagttctgactccctctgagacagtcttctcttctcatccttctcttttctatcttctattttctacatctttttagacctgtttctttgtgtgtgttttttttctctttttctgccttttttctttctttatgtctttgtctttgtttctgggtctctaatttttattgtatttcagtgcctatttatctctctgtctcttttcatctcattgattatctctctctctgtgtgtgtctctgggtgtctttctccgaatctctctgtgtgtgtgtgtgtgtgtgtgtgtgtgtgcatgtgtgcatgtgtgtgtgtttgtgcatatatatgtgagaattttgctcaatccagttgcccagaaagccaaaccatttatctcttactgttctatcccagagtctgacaacctggattaccgcctaggagctattcactccctggtatataagctaccagaaaagaaccgagagatgctggaacttctgataagacacttggtcaagtaagtaactgctggattttcagaaaaagttcctattagaggactggcccatgtggttggactacacagaaactgcctctcagctctttcagccccagcccttaagtgcttccttggaagctgaatgctctgtgaggaaggctattttgccttgacccatgtacatatcctcttagagtcatcatgcatgtggattgtctcagttgaaaggtagcagcaaggtagagtggggtggacacaggctttgctgtcagatgagcctggttttgaattgaagctctccaacttatttgctgtataatctcaggcaaacctctctgagtctgtttggtcatctgcacaatccctacaatgaaggccagttgtgtggattaggatgaacacaggtaaaatgcatgtcacatgagaggctctcaagaaatggcactttttgttaagattctggtcaacttcttgccatggtgtggctggcagtaacagacagcgggatcctggagaatagtcctggtgacaggcactgagataggcaggtgaaaggggcacttgtgtcccacagtggtgcttcctggccagaagatttaatattgtgaatcaagatgaatttacttggcttaaaaaaggcggaaagcattctgtccaggagccagcagacctgggctctagtttcatttctgctttctgctattagttcattttgtgaccagggacaggtcactcttgaggcctctcttggtatatatattaaaaaattgtaatgtattttaagtgtatatatttagcaagtgcagttgtctgcatactcaaaagatgcagtaatgatacattttaacctcatttggagaggctctgaaacacctaaaattgaggcctttaatgaaggtgagtttccaggttaatggctcttttggcctccccctgtaataaatcctgagtgctttgcctatctggacctcgagttttcctattatatgtgagatctccaagatctgattcagctctgactttcaaagactgttttctacacttctatagcaaatgaatattgtggacactgatgtaggtaataagcagaattaacaagagagaatggcttttatatttattgccagtgtttgcaatttgagctaatagagaacattaagaggcatgtggtctccaaaaagtagtttgtgatcatctcagtaaatgtacaaaaatcagcaaagaagctatttgcatgttaatttaaagttgccctggaggagtctttgagtccaagttccagatctgtcacaaatatgctgtgtgacctagagaaagttcctcccactctctgggccacaggtttgtgcatctataacacgaagagactgaagcagctaatctcaaagggttttctcagctctgactttctgagagtctcaacatgtgacgagacccaaggactcaattgaggatgcccgtgcttagtgagcatcagggtgcctgcctctatctgcccaaaggctggctgcttggcttactttaagaatcttagtcctcaaaatcttgaaatcaaaagaagacatgaacaaatagatcacagaaatagaatggcaaatactcttaagtatgtggtaatatgctcaagctcactcatagtaacaaaaatacaaattaaacctatactgagctaccatttattgtcaaatcctaatgcttattaattagactatggggaaactgtcctctaatacatttattgtattaatgcagtacagttccagaagaggggatttggcagtacctaacaaatctacacattcagttatcctttgacccagcaaaacagcgtaaaacagggtatatgatatgttagcttttttttttaaggcgtatactctaaagatacacctccaccaatacaaacaacacatgcacaagatttctcattgcagcacaattttcaaaagcaaaagattggaaacaacacaaatatctgaaaataggggactagtcgagtaaataagggtgtattcaacagtgtagtattatgcagtaatttaagaaaagaatgaggaagatctctatgaactttgttttgtggtgattttctgggatatattacaattttccagcacgtaaaacaaacatcataaaaaatctctggctgtaaaacaaggtttataatatgctagcttttcttttgtaagaaaaaagaggaaaataagaatatgtaagaatacacacacatttaaaaaaatttgtcaaatgaagcatacactaagataaatttaaaaaaaactaatgactccaaaagttaaatgtagagttgccatagatccagcaactccactcctaggtatatacctaagataaatgaaaacatgtctccacacaaaatcttgtacacaaatgtccatagcagcattatttcatagttgttgaaaagtggaaacaacccaaatgtctgttaactaatgaataggtaaacaaaatgtgatatacaggcaatggaatattattcagccataaaaaaggatgaagtactgatacatgccacaacatggataaacactaaaagcattatgctaagtgaaaaaaaacaagacacaaaagtacatattttatatgatttcattgatatgaaatgttcagagtagacaaatctatagagaaagaaagtagatgagtggttggcaaggtctgggaagtgggggtatgagaagtaatggggagtaattgataatgagtatgaggtttctttttggaatgatgaaaatttctggaattatataaggggtgacagttgcacggctccgtgaatatactaaaaaccacttaattataacctttaaaaaggtgaattttctgatatgtaaaatatatttcaataaatgtattataaaaataaactaatgaaagtggttattatactggataggtgtggtaagtagggtggaggtgataggggtaagagctagattcctctaagtatacctccttatatacttatgactattaagccatattaatgttttacatatccaaaaaagaaaattaaatcaaaaattataaaccgtaaaactgaacaccaataaaagcaaatgactttaatgaacctaagtgtttatcaacttgatagcataattacagagagaaagcaattatttcaactaacgtgtcaacacagtcctctgactcatccttaatgagatgtactctagaaacaagaagagcaaaattttaagcaacactcagtaggtttattaatagtagtaatataatttaacttgaaacaaacacacagatcttataaagataaagcaaaaaagtaaatatgttaatgttatcacaagctaagtttatagtgtacaaaagagatactgataaaaaagacataaggaaaaaaaattttaacattaaaattaaattaagaatgttaatatgaattcatgatttaaagagaaagcaacaagaagaaaaaactttatccactgaaacagtgtcgaagggattctacccaaaaagaagtgaatacacttagtgcccagttttttgtttttaaatagcatttccttttcaaaggaatcaggggtgcttagagaaatggctgattgcatgtctggagcaaggaaaatacaaagttagtcttggataaatagtaccaccaagcaagaaagaacagagtcacactaatagtgtcatgtccaaaggacgtagaaaccttgaaagggctgacactgatgatgtttgagccaacctgaacatcaataacaataaataatgtatttgattattacatgttgaaaaacaaaactcctggaggtgggtagaggaaggaaatctctttattgcagaaggaataccagctaataaacataggaggaatgacagaattagaaaaatcattagtttgcaatctaagtgatctgttttagacatgaatcaaaactattgggcaagagtattgaggaataggatgttcacattattccagtgtattactgacaagttacttactaatcacaaataaaaaacaatgtatctttacaatgaacctatctggcagacaccaccttaagtaattgatcaaagttagcatcagtaataacggaacaggccaagtgcagtggctcaggcctgtaatcctagcactttgggaggccgaggcgggtggatcacctgaggtaacgagttcgagaccagcctggccaacatggtgaaactccgtctccacaaaaacacaaaaattagctgagcatgatggtggatgcctgtaatcccaactactctggaggctgaggtgggagaattgcttgaacctgggaggcagaggttgcagtgagccgagattgtgccattgtaaataatggaacaaaccaccttatgtacctcctaattagacataataaaaattataaaacattaactgtgaaatatttttgccaaaaatacgtagcctgaatcaaattaattctttccaatttgcaggaaataaagagtatagaaaaacacacagtatttgacagtctataaagcttttgaaaaggcttggacttttcaaaaagtcaatgttgtgggaaaaagtggtagaggtactgttctacataaagagactaaagaaacaaacaaatacagtataagagctttgtttggatccaaatttgaaaaacgcagctataaaagactttttctcccataacatttgagaaaatttgaatatggactagatattagatgatatagaatctacgttttctaagatgcaaacatgttattgtggttttgtaggaaaatgtgcttattctttgatgatgaatgctgaagtatttagggttgaagcaatgtactttcagaggattaagaaaaaatatagacagaataaaagcaaatatggcaatatgttaatttttgagtctaggtatagacagtatgagtcttcctagtaccactctttcaactgttttgtatgtttgaaaatgtttataatgaaaattgtagggaaatgtaaataaaaaataggcttagtttcaatagagaaatttacacaggagaagaaaattcaagtgtttttaaaatgcacataattatcttgcctgtcaactgctgctttcatcatctatatgatgagtacatctatgcctttgtactgtgtttccactgacagcctgttttctaggctaataacaggcagaaccaaactgaccttagccaatttgaggttctcagttatccagttctttttggttagtatctgtagcttctattagtcagaagtaggagaactctaaggccacctccctggcaatcttactaccagtggaatattacaatggaagcaagctccaggcctaattctgccattcttatagctatttatcagcaggcagacgaaaaaagacttgaacaacctgttctgcaaactcaaatgaagtcccagctctctgtcctttcagatgccctgcctgacaacatcttggatgaaaggttcactggaggcagataagattggagtcagacaataaaatcctaccatctagtacccctatgtaaccttaggcctgggctaccattctgaagggtatgggttattagcttactaggttctttttacttttgtaataatacttctcttatttgagaagcaatactgtgcattgtataaattagaaaatttttaaaaagcaaaaaaaaaaaaaaaaaggaaaagctttctattcccaacattcaataatcattactgttaatatagttcaggttttttcggatctctctctctctctctctcttctctctctctctccctctttttctctctctcgttgtgtgtgtgtgtgcatgcatttttgtatacacatacctgtttgcatttttttttaccaaaatgagattatgctgttctttagtctactttttccattttaacaattttgacttttccagaccatattaactttttcccatttgacccaaaagtggccttttataggtgtttgtccaatctggtattcaatataggaacacattttatttatgtccttattgtgtttttaatctagcacagtgcttgtttctattattattattattatactttaagttctgggatacatgtgcagaacgtgcaggtttgttacataggtatacccgtgccatggtggtttgctgcacccatcaacccatcatctacattaggtatttctcctaatgctgtccatcccctagccccccaccccccgacaggccccagtgtgtgatgttcccctccctgtgtccatgtgttctcactgttcaactcccacttatgagtgaaaacatgtggtgtttggttttctgttcctatgttagttttctgagaatgatggtttccagcttcatccatgtccctgcaaaggacatgatctcatccttttttatggctgcgtagtattccatggtgtatatgtgccacattttctttatccagtttatcactgatgggcatttgtgttggttccaaatctttgctattgtgaatagtgctgcaataaacatacgtgtacatgtgtctttatagtagaatgatgtataatcctttgggtatatactcagtaatgagattaccaggtcaaatggtatttcaggttctagatccttgaggaatcaccacactgtcttccacaatggttgaattaatttatgctcccaccgacagagtaaaagcattcatatttctccacatcctctccagcatctgttgtttcctgactttttaatgactgccattctaactggcgtgagatggtatctcattgcagttttgatttgcatttctctaatgactaatgatgatgagctttctttcatatgtttcttggcctcataaatgtgttcttttgaaaagtgtctgttcatttccctcgcccactttttgatggggttgtttgtttttttcttgtaaatttaagttccttgtagattctggatattagccctttatcatatggatagattgcaaaaattttctcccattctgtaggttgcctgtccactctgatgatagtttcttttgctgtgcagaatctctttagtttaattagatcccctttgtcaattttgacttttgttgccattgcttttgctgttttagtcatgaagtcattgcgcatgcctatgtcctgaatggtattgcctatgtttttatctagggtttttatggttttacgtcttacatttaagtctttaatccaccttgtgttaactataaggtctaaggaaggggtccagtttcagttttctgcatatggcaaaccagttttcccaacaccatttattacatagggaatcctttccctattgcttgtttttggcaggtttgtcaaagatcagatggttgtagatgtgtggtgttatttctgaggcctctgttctattccattggtctatatatctgttttggtaccaggacaatgctgttttggttattgtagccttgtggtatagtttgatgtcaggtagcatgatgcctccagctttgttatttttgcttaggattgtcttggctatatgggctcttttttggttccatatgaaatttaaagtagttgtttctaattatgtgaagaaagtcaatggtagcttgatggggatagcattgaatctacaaattactttgggcagtaaggccattttcatgatattgattcttccaatccatgagcatggaatgtttttccatttgtttgtgtcttctcttatttccttgagtggcagtttgtagttctccttgaagaggcccttcacgtcccttgcatgttgtattcctaggtattttattctctttgtagcagtcgtgaatgagagttcactcatgatttggctttctgttattggtgtataggaatgcttgtgatttttgcacattgattttgttttctgagactttgctgaatttgcttatcagcttaaggagattttgggctgagaccatggggttttctaaatatacaatcatgtcatatgcaaacagagacaatttgacttcctctcttcctgtttgaataccctttatttctttctcttgcctgattgccctggccagaacttccaatactatgttgaataggagtggtgagagagggcatccttgtcttgtgcctattttcaaagggaatgcttccagcttttgcccattcaatataatattggctgtgggtttgtcataaatagctcttactattttgagatacgttccatcaacacctagtttattgagaggttttagcatggaggggtgttgaattttatcaaaagccttttctgcatctattgagataatcctgtggtttttgtcattggttctgtttctgtttctctttcccgatttccctggacagaacttccaatactatgttgaataggagtggtgagagagggcatgcttgtcttgtggcggtttttaaagggaatgcttccagcttttgcccattcactatcatattgcctgttgatttgtcataaatatctcttattattttgagatatgttccatcaatacttagtttattgagagtttttagcatgaagtgattttcaaatttatcaaaggccctttctgcatctattgagataattatgtggtttttgtcattggttctgtttatgtgatggattacatttattgatttgcatatgttgaaccacccttgcatcccagggatgaagccaacttgatcgtggtggataagctttttgatgcactgcaggattcggtttgccagtattttattgaggatttccgcatcaatgttcatcagggatattggcctgaaagtttttgttgttgttgtgtcttctgccaggttttggtatcaggatgattctggcctcacaaaatgagttagggaggattccctctttttctattgtttggaatagttttggaaggaatggtagcagctcctctttgtacctctggtagaacttggctgtgaatccgtctggtcctggggtttttttggtgggtaggctatcaatttctgcctcaatttcagaacttgttattggtctattcagggatacaacttcttcctggtttagtcttgggagggtgtaggtgtctaggaatttatccatttcttctagattttctagtttatttgtgtagaggtatttatagtattctctgatggtagtttatatttctgtggtatcagtggtgatatcccctttatcattttttattgtgtctatttgatttttctctcttttcttctttattagtctggctagcagtctatctgtttagttaatcttttcaaaaaccagctcctggattcattgattttttttaatgcattttttgtgtctctatctttttcagttctgctctgatcttagttatttcttgtgttctgctagcttttcagtttgtttgctcttgcttctgtagttcttttaattgtgatgttagtgtttcgattttgtatctttcccgctttctcctgtggacatttaatgctataaatttccctgcgaatactgctttagctgtgtcccagagattctggaattttgtgtctttgttctcattggtttcaaaggacttatttatttctgccttaattttgttatttacccagtagtcacccaggagcaggctgttcactttccatgtagttgtgtggttttgagtgagtttgttaatcctgagttctaatttgattgcactgtggtctgagagactgtttgttatgatttctgttattttgcatttgctgaggagtgttttggcagtacatatactaaaattggaacgatacagagaagattagcatggcccctgcccagtgcctttttttatgatactgttttaccaacaagagaagaccaattgtcctgtagaatgttacttcctagttttgtctgctttcttctttgtcatatatttcagctaattactctacttcttgtatgttttgtaaagtagaggttatatctaaaggctagatggattccagttaactatttgttggctggaacaaatcacatgtgatgttgtatacaccatatgctgcatcacatctgaagatgcataagattggttgattcaccttactgatgttaagattaaccattgctatatttttctaccctgtcaatgcagggctgagagtgtctgtacaatattttcagctagtccatatgtctttaatacatctaggcaatgataattcatttttaccttatgttatgctcattaacaaagcctttggtgttggttggagataatgttagctgaaacttacaggagcccctctgacttttacctgagtctttaaatactcattaatcacccctagagtatgcgtgtattcacaattagaatactacaattataactaatacgttatacatgttagagtatacatgaaaactaacaagcacataaaccaaatttcatcagttctaataacactttttctcaaattgtaatctgaattctgtacacatctgaaaatcaatggtttcttaaaattacacttatcaggcagcagttttgatgtaattatcatggcctccatatgcatgaacttgtaatagctgctcatattatagtcacttaagttaaattatgttcattgttgagtttattttctatttaaaatgtcttcaaaaatattacatgatgatatgacaatgaaattacttttctttcttagtggtacataaataatgtgctcgtaactgatgactgatgaaattcatgacatcgtatggactttgttgaagtatttaaagtaaatgacagataatataacaccagtggaggaagccaaagctgtcagccctttaaaaaaaggcaccatttcgctgggcacggtggctcacgcctgtaatcccagcactttggaaggccgaggcgggcggatcacgaggtcaggagattgagaccatcctggctaacatggtgaaaccccatctctactaaaagtacaaaaaattagccgggcatggtggcgggcacctgtagtcccagctactcgggaggctgaggcaggagaatggcatgaacccgggaggcggaggttgcagtgagccgagatcgcgccactgcactccagcctgggtgaccgagtgagactccatctcaaaaataaataaataaataaataaaaataaaaaataaaaaaaaggcaccatccttggggatagggacctgtttgcttgtgacactgattcactctcgccttcactattgtcttttccttttgaagaattttttattatgtaagatttcaagtatatatgaaaatagaagaaacagtatagggaagtattatgtgtccatcacccctccttcaactgtaatcaacacatggccaatcttgtttcatctatttccccacccatttcccctcctcccatgttattttgaatcaaatctaagacatcatattatttcatccacaaatatttcagtttgtcttgaaaagattagaactgtttataaacataacatcacatctaaaaagaaatgagtaataatgtaataatattatccattattctgtgttcagatttctgcttcctttttagttttgtgtttctggggtgtgtgtgtgtgtatgtgtgtgtgcgtgtgtgtgcgtgtatgtatgtatgtatagggtgggaaaggcaagcatacttaatagatggttctatgttcttctaacaggggacacacagtgtgtggttgtctttgcccccaattattttcgagagcactactttctgagattcacttaattgtcagagctggaagtccccttagatcacctaataacttcattttacagatgagggaacagatacctaaggatggaaaaagataggcccagagacacaatactttagtaaaagaaccaaaaaatattgaaggtagcttccttgtttaggagtcagagggcacacagttcttagaattgttggatgctaaagctgggcgagacctaaaagttcatacagatagcctctcattctgccagaggtctcagtctggcaatctgttgacaaggtccagaccagaaatatattttatttgtcctgcagtgttttgggaaaaaagtgatttggcttcaacatttaaaaaatccagatagttcacatcaaaatatacatttcaggaaaaaaagaggatgttagcacactggatctgcatgcccacgtggcagcaatcagttggggttgagtaatggtttcttgctttggaatgggcacaagcttctaatttgccatagccctcaccactcccaagtgttttaacaaatattatattagagttacattagatgtgacctaggaatttccctttcttaaaactagaagttattctgttgatggtgtgtctctaagtgagtggcgggaaaatggtggtctaaagaatgtctgcttgtttaaatgtggcagccacttctcaccaggcccatttctctcatgtaagttacctgccttgcccctctagacatttaaatttatgacctctaatctaaaccatgcaatcagaatcattttattctgtactggaggcttctcacaaccaacctcagtggactagagagttcaagattcctttgctgtcaaataacatcacatactcttgtttttggtttcattcatcttgttaacccacaatttggaatgttacttatcccccatactgattttcaaaatatataataaaaagagagacactaaatgcaaagcaatttccccaaagaataggtgaacttccaaatctcataagaaggccaagaaggaagagtatcctaaatgggatgccaagtaactccctcagagaatcagaaggtggctttagcttagaagagctcacatatgagttttgatttctccagaaaagttagacaagcaggcagtgggatgcaatgggataactataagacttggggagcaacaaatatgggcttgaatctctgccttgccatatgaccttgccaagtgctttgctcttggtaaacctaggcttcaaagctaaaatactctgctttttggagttgtgatgattctgtgagctgctgggacactgaacaaagatcagttcctttcaaagttcacaaaaggagatacacaagtgcccttgtggtttagccttttagggtcacttggtgttagcatggagatacttttccattttaatatctgaaaaaaacttccgtcactaaagaataaagattaattgcaggggtattgaaactgttaaaaggaacacatcaccagcccagcaatatcaaaagctatgaatggttgctgttcatttccatctgaatggtactcagctttgtctagggcttaacagacttcacattaagatttgtctaaggattctgtcctcctcaattacccactcagtgttaagaacctgccattctcttctgggccttagccttggtaggtgtggagagtgagtgtttcgggtagtcagttgggctgttcctacagccaaactgaccaaaagagattcttgccttttacttggctgcctccaggactgtttgaaacagcactagggagctcaattcctttacaaataattcattagtacctgctgtgtggcaggcacacacacttggaagttgtttatcatttagtaggagaggcagataagtaaacggaaaattgcaacttactctgcttgccagtggttttagttaagatgagcacagtgggctctggtctccctgaaggagatgtaacgttatgtgcatctccaaggatagatagacattttgtagatgtagggagaggggggatattccaggtagagagaacgacatgagcagagaggtatgggggtctgaaacaatgtggtataaccagacaaccccaatctaagcagtttagtataacaagagtgtcagaggtcagcagtacctgaaggctcctggagaggtaataataacaacagatacttcccagggtgccaggtaccatgctgaagcaatttatctttatttattcaacaactctctgaagtgggtgctattttcccaggtgggaaaactgaagttcagagaggttagagtgagtgaactcactgttgcgcagctggtaagtggccgtgttgggattcaaacccagcttcagagcctaagcagtgagtagggattggaaataggggtcaagttactcaagttatggaaggcctcatttgtcactttgaagagaattggccctatcccaaagtaggaagccactaaagggaatttaagcaatgaaagtgactagggatcagaaaatctgggattgcacgttctactctacagctaattgactgtgacttcgagcaaattcctttccttctttgggcctatgttttttcatctgtaaaataaggaagatgatcaagggcaagtcttaatgatccctttcagctctttcaggtttttgcttctctaacgggggtcaggaaggggctgatttaagagactagtaggcattctctcaatgtgctttgtggttctttgtacatgctttatacttatatgggctgttcctcttgctttgaatgtcctcttgcttccctcctgcctctccaaatagtatcccactagctttagtccctccccacatccctgtctgtctcttaattccttcaatgctgttagctaggttagctatgtctaaccactttgattcctaattttatactatcttgtattctttgctgattgtttcctttgtaatcttgccttccaatacatactttaggtgctcctttccttctacattttagtttctcttaccctctacagcacctaaaacagtcttggttgtaaggggatactggagcaaattttgttaatcttgccccttttcttctggcagtgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaaggtatgcattttctattctcactacctgtcttccaaacatgtgacactttcccccaactgccttttagtgctgtgtcttcctccttggctcacgttgacagtgaaaggaaatcccattatgacacaatgacatttaatggcaactctgaccctgggaaattcattcattcagcaaacattgcttaagcttataactatattattttcagacaccatgctaaatactgggggtaatgaagaagaaaaagtcactgtctgtgcctttaaggtgttaacaatgtgtagtatggagacagatgggtaaataggaaaatgatagtataaaagtagtctatatacaatgaaactgtaggggagaagatatttatgttctcacccattgctagtttcatggctgagatccctataacaaaagaccgattaacaagagaaaagcatacaaatttatttaataagttttacatgacacaagaacctttagaaatgaagacccaaagaagcaggtaaactcttgcattttttatactaagtttgatgaaatggatcgttgtgaagattagtgattagaagacagaaggatatgatctaatggtaataaacttagggggatcttagcaaggcttgtttgttcagattcttcttggtgtttctgtgtcttcgaggatagggatgttcttttccttcagttatagggagggtacctctggaatgacctacttcagaggaaggtcagagaattcttttatggcctgctccaggggagaaggtagagaaaccttcttgcttctgctgtttccacaaacgccaaagtgccatattttgggatagcaggtcctgaactccatcaaaactaaaaagaaatcaatgcttacacttattcgaaccccatctcattccaaaagtatatatggtagcatattttatattgcacataaaatataaggcatcatacattataatcaggtcaagtacaaaaggtaaaacaaaggtagagtcagaaaatgatgcccagaatgaggttaagacaaatatttattgacaaattcttgtacacttgcaacagatggccctgcacactggggtataagcttcatagcagctagtgccatcctagggaaaagcataattcaataaagaagcacagggaggcaaaagcagcaggacttggtgactggaagtcaccaaggatgggggagagggagatttctgaatcctgattttctgacttggctgactgggtggatggggctgtccttatacatataagaaattcagaatgggaaagtttgagggagatagaggaaagttcagtttggaacaggtcgcatttgagatttgtgaaagacatccagggagcaatgcctggcgagcagttgactatgtgaatctaaagcagggatcagaaagcttttccttaaaggaccgtataataaatacttaagcctttgcaggccatggatttctgtcacaactacttagctttgccattgtagtgagaaaacagccatagacaatatggaaacagatggttgtagatgtgttctagtaaaattctatttacaaaatgggaaacaggcctgtgggctgtaatttgctgacccctgttctagagcccagatgtgataaattgataaatcaattgattcatccaacaaatatgtgtcgagtacccactttatgccaggtactgtttcaggaactctagatatcatcttcatagagtttatatttagaaaaagtaaacaaatagtattcaaagtaagtaaagtatataatattttagattgtaatgaacattaaggagaaaagcagagaagggaaataggaagggttggaaagtggttttgcaattttaaatacagataggaaaggagaaaataaggaaatgaggagggcctcacagagaagatgacctttcagcagagatcgatagggagtagaggaatgattcattcacctatccagagagaaaggattctaggctgaggaaatggtaagtgcaaaatcccagaggcagaagtgtgcctgtcatattcacggtacaacaaggaggccagactagctagagtggattaagcaaaagatgaaatagaaaaagatgggctcgaagagataatggagagggacagactagatcctgtagtggagtcttataatccactggaagaattttagatttgctctgcctgggtaagatagaaggggggttttgagcatgggagtgacaggatttgatttaggcttaacaggcttattctggctgcaatgtggagaatatgaaggaagtcaaagaaaatctagataaattgagatacatactgtgttcatggagtggaagactcaacatgataaagatgtcaattctttaaaaattataagtttaaggtaatcaatatcaaaatcccagcaagagcttttgtagataaagacaagataatactaacatatatgtagaaatggaaaggaactgtaagggctaatacaattttgaaaaataataaactggaggtaggtattaataatattaatgcttactgtattgcttcagtagtcaagacagtgtacaattggcagaggtaacccgataagtcctcttgtctacttcttacataaacaaatagaacagaatagagaatccacaaatagccctacagagtatggcctgattatttttcatgaaggtacaaaagcatttcaagggagagagggtagtcatttcaatgaattgtattggagcaattgcagctctataggtaatgaaagtgaacctcaacctaaacctctcattttatataaaaatgagctcacaaaggatcatacatttacatataaatcataaaactaaaacttgtagaagataatatagaaaactgttagagcctaggacttattgaggagacatgataccaaaagcataatccattaaagaaaaaaaatcaataaattgacttcatcaaaattaaaaatttttgctctgtgaatgaccctattaataagatggaaaaaaaagctaccgagatttggagaaaatatttgcaaaccacgtatctgacaaaggattaatatctagactatacaaagaactctcaaagctcaacagcacaaaaattcaatctaattagaaagtgggcaaaagacatgaacatgacgtatgcgtggcaattaagtatatgaaaagatgttcaagatcactagccattagggaaatacaaattaagaccatgatgagagatctctacacacctattagaataggtaacgttaaaaaaatatatagtggcaataccaactgctgacaagggtacacaaaaactggatctctcacacatttctggtaggaatataaaatggggcggctgctctggaaaacagttttggagttccttaaaaactaaacatgcacttctatcggatccatcatttacactcctgggcatttatcccaaagaaatgaaaacatgtccacacaaaacctttatagggatgttaattaatatttgaaaaaaagttatttaaagcattttacacatattagcacatttacacctcatttcacataagaagaaaccaaggtacagagaagttaagtgacttgtccagggtcatggagtaagtaaatgttggagctcaaatttgaaatcaggcagttcaaatgtatactttaccacctctagatctttgttatgtgttttgcaaatgggtacctgaagtaagtgaaggtgagggtcattatagatgagagagctaaggaactttgaggcaagagttgctgaagggtcatccacatagtaaagatttttgatagaaaataattttctaatcctagcatttggtggtcagatcatgggtcttgtatgcttggctaaggagtttggtctttatcctgaaggcagtagggagccttggaagcatattctgaacattcattatatgatgattcattgcatcttaaatgtcctaattcatttataagtggataaaggagtgacacagcatctcatcattagtataacaaaataatttttcttttgtttttattctatgcatttttaggggcaaatgccaacttaaattttattagaaaatgtgttggttggcaaatgacctcaatcccaatctagttcataaaagtgtgattttgctatgtccaaagcatattatgtggcatgatttgaaaagcaattaaatgctagttatctcttattcccaggatataataggaggccatttctattaactagtggtcagctgttaagtgagattttcacaccgttgtaacctgttaatatgtgttaagtagtcgaagttctgacctttgtgtgataccagagatgtacgctgaccatgttttccaaacaaagacatggtaaccaaggatcttttctgatttatgaatttatttcaaatgaaacatcttacatggagatatgaaatgaaatcccagtttattaaatacttatcaagttaccttttttgaaaaatagcagaatgatatatgggtgagaatgttccagaaattctagaccttatgtaggtgtaacctcacatggtggttgtgggattaaaagagataatatgtgtgagagctgttgctgcttcacacatagggattatatgttcctggcaagttgttcagttaatggggtatgatttttcagttgaaatatattataatttcagtaatgtgttttttccatttacacttgctctttaatagaaaagggcttaaacacattggttttaagttttctttgttactcctttctttcagtctctcttttaagagcatccagggtctgtaaatacagtgtaagtgaatcagaagagttgatgcttaaaggagtctattactaagtcttgcttaaaatttttttttaacaacttgaatgatcttttctaatttttttcttttttaagttggaaagtaggtaaataataggggaagatctacctctacactgattccctagaacaacattgccaattattctgaagttctctctcttcccatctcacttagcagtatgtatcagggtgcctgaacctcatgttgttggcttgaggcatagaggtaatttggactgacagaggaaggttgacttctgttttccgaacattttgttttggggagctgccaggaattagtggggaagagagaggtcatctctgaaggcggttcttagcaatttagttttgaggacagagctatttcacctaaggggacaaaatatagggtagatccatttgaattttagaactggaaaggggccctaaagaccttcaggtccaagcttttcattttatatgaagcctcttttcgcatgccatggtagtggtaacaggtttgcatttctgcagctccattcctgcttgtctactgtttggaacatcagctctcccccacagttcttcccaactagtttataaaagaactcggataccagccacaaacttttaccagttgtctaacttgtgctttgcaaactcattttctcacctacacaacctggcatcagctgttttcctcctttattgctcccaagaccactctcaaagagctagaaagcagtggttctgcccctgtagacttagatttgtattcagtgaacatggaatcagtgtgggacagcgtatttccagctcgtttagtcctttttctaactctgtgaatgatggatcgtatttccatttctgagataggaaatggaggcattgagtgtagtaagtggcaaagctgagacttaagtttaggtctatcaggttaaggctgcccctcagggaaagggggacctgttttattgagatgtgagctgtgcttttctttgcatcattgatgatgacttagctattctagctactcttgagttccctccttatttccagtctttcctttttagtgggtgggcatctgctttttaatcatacaggaaggatcttgcctaactgtgttaagtatagttttctgggagaatagttgattatttttgagataattagaaaatctattatcggtgtatgtcaaaatggattttagtcttactgcttaagatatatggttcagggaaatggaagactgaatggtatagtcttttctgcagacatggatggttgaaggcagttcttcctataaactggccggagaaagctgggttattctcagtgtggagtttgtgggaactccagtgttgcctatgttcccaaatggccaaatgggacctcatccaggaaaaaagcccatgtcgtagcaatgtaatggatttgagaaggcaaacaagagaccctgttaagaaatggctctgatttatatacttttcagacacccagtctagcaacctagaggaaacagacccttccagtcctggtctgtctctcctttctctaaaaggtggtgtttgtgaatttcagtctgccaccagagggtagcaagagaacagatgaatgtgtccctccaactgatttctggaataagatagatagatagatattttaaaatataagtaaatgtaaatatatagttatactttatagattttactgtatagatttatattttatacatttgtattttagaatgtatctctatatctacctacctacacacacacacacacacacacacacacacacagacacacacacttggtggggggtgggcgtcagtatgtgtaaagagagagaatctaattaagccaagactctacttcacatttaatttctgaaatgataaggttaagctaaaggttattgaaaataacatttttattatctgtacatgtaaggatattttcattagtctctacatgtgaatctaatatgtatttagcttggaatttggcaaacattctcaattgaatctggagaaaaaatatctttaagtttgaatattaagatcaaaacgtaacctggagaaaaaatatctttgagcagagaattattaagattgggagatttcagatgtatttattagttacaatgaatctttgaaaacgtagcttcaagttttccaccttggctaagtggaggtctttcacacattcttcaaatgcccagttacttatagctttgaagtgaagtcaggccctgtttgaggtgaataagcatgtccaaacccaatgagatagggtgataaatgtaggatgcagttgtgatctgaggtttgctccaatgttcagagagcagaaaagattccccttttgattctgggaattatgccgatgattcagaatgaggtgaaaatatccactccttccctttttctctctctagctggggctgtaataataattatcacagtaaaaatgatagcattttttgacagcttgctatgtgtcagacatggtgctatacatttgacacaaagcatctcctcgatttctcacaactttatgtagtatttacttacaggtaaactgcggtctacagaggttaagtttctatggactatcaaaatcaaatatctgtttttattttctttttggaggcttcgagtgtgtgtgggtggggaagaatatagaatcagagatttttgagaatcgaaaatatctccaaggtcatattgtccattcccctcaatggccagcgattttcttgtatcatatattttttcctttgctgttctcctttgagtggcctgaggtctcaggttggaacaccagagtctagataatacagtaagactggggccagtgtgccagagggccagataggtgtactttggcagctagacttaaagcagactgagcttcagcagtctggtgataggccaataggaatttcagaaaacaggaatcaattgaggagcaatgagagatcgggtggactttttctttgctctgagatttggagagtgaaaactgggtcattgctactttcttagattaagactccttaccaagaactctgaaaatgtccaggctacctctgtgagctcttcagatatccctagagtgagaataatggaaagaatggaaaaatagctttaaactagacagcccaggggttacatcccaactttatcctttactagctgggtggtcatctaaacaagccagtttacccccctgagccttgtttccctcattaaaaaaaaatgataccaataattagacatacttcatagagtttttgggaggagtcattgagataaatgtttcaagtactttgtacatagtacattggccactaaattttagtacttgcccctgccctataccaccacccctttgctgtattgacaggagatgagctctgtctttgtggtggcattccctcctaatacttttattaataccttggtatctactaagtctttgtagtcaaaagaggcttttcttagtagctgttacaccattgtttatggttgttaaatgatagagaaactctttaatttcccaacctaaacgcatcttaagttgatctaaaaagaaactgcacttggaatctgccatctcattcttagtagaaaactcacaatccatgctgagtagatagagatgtccttaacaggatctgactttatcttctctcccccttgatattttcttcccaagacaactgggaaggggaatgaacagacaattagaacacggattacagaccggttagatataatcagtggaagtctacagctgtttcaggcaggaggtactggtttttaggggaaatgacacccgattgggcattagaactcttggattctagtctcagttctaccacctactagctttggggccttgggcaagtcacttccccctctttggacatcgattttcccataagtatattggatgagtaggactagacaggattctggaatgttacatctaaaaaggccttaaagactatgtgttgctgagaccaaagacagccttagtgacagcccttttataaaaagctggctcttggtaacaacagacgtgatactttcaaagttctctacatactctaagcaaactcggtgacacacttgatgtttaatgtggtctgtgccaaatgctaagagctcattacttttgaccctttgccacctttgtttctagtgtagttaagagtatggtttttgctaatataaccagaacccagaaagctcaacatagccttagccagagtgtaaatggagactcagttggaaagctgggattcatcagggccaagtcttgtagctttgatttatagaaaggcaaaatgtttttttgtacaatctgatatttgcagccctgaagcgacatctggaaagaatctggatagttgctcatttctgccaagatttccaagagttagaatgggtctggatctcttggcctttggcaattggaaatgaccatcttatattaaatttcttctctctttcacacctaaagacatgacagagaagaatccgtaagggggttaatatgtgaccaaactcaggcaagcagttcattaaccctcttcccaatggaggtgatcgctctcctggcagtgtctcaaagcccagcaaattatccagatttagttcccagaagccttcaggagagggattccaggagttgggctccttcctgaatacaacccaaaacaacagccaaggcccatcagaatgaaataatattcctcggatattgagttctcttagaccaggcctttagaatggcactcagtgccaaccatatgcccagaaaacaaataagcactggtttgcccccagactctactttggccaccttctgggatttttttctgaagtcactatcagagaccatgaagccctaattgttcttaaccagtccacagaaagccaaatcagtctgtcctttttctggagttttggagggtgggaaaataagttctgcctgatactgtttctacccgaggagttatttttaaacttaaaatgtttccttctatggtttatagtggaaagagtgttagccttgaagtcagacacttctgagttcatatcatagccctgcttcttactatcaggtggccttggacaatgcacattctttattcccagccaagcctttggcctcacatcctctttctagtcttctccccagtgagttgatctagtctgtctatgagttaggaattcctacttaatttttcagctacagaagaaccactacagtgtccagaggagggaaaatgaaggcctataccctgtcaagttctagtgataattttctcaactttccattcattcagctttctaattattctttcctcccttaatcctgtggaaaggggtagatagagggatttattttgtggttaccctaatgcgctagttgttcaatcatgtccttcaagcccaggttgtctttgcagagaaaggaatttgtgttcagagaaaggaacttgtaaacactcaataaatgagttaatatacataaaacacttagacatgtgcctgacatgtagtaaacattgtagaagagttgaccattaaaactaactctgacccatggcttgaacttggaaaaagtttattccatcaaagccattttagtcagtcttctgggtcagcagctagtaccaccatttccaccttctattactgctgtcactaccttttcacaatgattgcatgagatgcataggaactggttttgcatcctgtgccacctagtatttgaccctttagaaagtctccatatgctatgagtttcccattcttttaggatttatttctgcttttttttttttggagacagagtctccacttctgccacccagtttggagtgcagtggcgtgatctaagctcactgcagtctccatctcccaggtttaagcgattctcctgcctcagcctcccaagtagccaggattatgggtgtgcaccaccactcccggctaatttttgtatttttggtagagacagggtttcaccatgttggccaagctcgtcttgaactcccgacctcatgtgatcctcctgcctcagcctcccaaagtgctggggttacaggcttgagccaccatgcctggttttatttctgctattgtaaaagggtaggttgttattccattctcagaacctgcttagaataagtcctttcatggatacacaagaagccactggggcattaggtagagcttgctaggtttcttttcttggacctattctaactcccttgtcagctctgaaagttttctcattaatattggactgccaacagtgagttaagagatcttgggcccatattctctttccttcctcctttcttaatagaaactgtggagttttccgcaagttgcccttcccaattccactagttatatctgtagtttataatcctgtttttaaggtaccaatgtcaccccttcattcaatgaatacttactaaatgcttactatggacaggtgaagttctaggctctggggatacaaacaaaacaaaggcccttttttgtgggtcttatgttctgctggagataaacaatacatcaggtggtggcaagtgctctgaagaaaaagtaaagcaaggtagtgggttgttcctttatggaagatggtcagacaaggctactgttaatgtgttatttaggcagagaactgaataaagtaagggtacaaagtatggtagatatctttgggaagagcaattccatgaatagggaaaacctagtagaaaggcccaaggcagcagtgtgcttggcatgttgaacagcaaagaaaccagagtgtctgggagcaaggatgacaatctgctccatttctcttcccaaaaggaatagcagtaacacacaggttaatgcccattgttaaaaaagagttttgaagtgaggcctttggagggccacagaccagaaaaagaggtaagtggattcttcttactacagcaattgccaatatttccacattaaagtttggcttgaatgtttgcatctgtaggccagctttgggaaggatgttgcaatccgtgatgactgcagggttattcaggccacattttaattttagagaagacacacaacaggaagtttcccctttgcttttctagacttttctcacttaaagagagtgtggttttaagcctaccaagcaccttctctgagctctgcctactgccacattggcaaaactgctctcaaccagctccttaccaatgagcctttcagtatattttcaggagacagggcatgtggacaacaccctgtccaggtggaattgtcagctctcattataaatcgtagaagtcagtgagcccatatctatcttaaggcctgggtagcttcttgaagaagaacaacctgtgaggaagggttttttttttcaatgagaagtgaataatttttataactggagcagggaaataagatcatttaatctgacagagagcttgaagagcaattaagttcatatcacctgatttgcatagcatgtaactgcttcactccctattgctccggtctgaaaatttctctgttcctccctccctttctctaccactctcctctccctctccctgtccccctctttcactctctctccctccgttccctccgttcctccctctccccccgttcctccctctcccctctctccctcccccctccccacctctttgtgtgtcttgtgttttctctttctctaaggaaacataggtttaagttctttttagggttcatgataattgcaataactaccacttactgagtgctcagtatgttccaggctaggttctttacatcaggtataccttgctttattgtgctttactttattgctctttgcaaatattttatttttaaaaacaatttgaatgttggtggcaatcctgtttcaagcaagtctatcagagccatttgtccaacagcatgggctcacttcttgtctctgtgttacattaggaaaattcttgcagtatttcaaacttttttttctttcttacatctgttgtggtgatatgcgttcagtgatctttgatgttactatgtaattgttttgcggctccatgaactacacccagacaagatagcaaacttaataagtaaatgttgtatgttctgactgctccgccgatcagccattcctcatccctctccctctcatgcttccctattccctgagacacaacaatattggaattaggccaattaaaaacccgacaaaggcctctaagtatgcaagtgaaagaaggagttgcatgtctctcatgttaactcaaaagctagaaatgattaagcttagttaggaaggcatgttgaaagctgagataggctgaaagctaggcctcttgtgccaaacagttagccaagttgtaaatacaaaggaaaaattcttgaagaaaattaaaagtgctactccagtgaacacacaaatgataagaaaccaaaatagccttattgctcatagggagaaacttttagtggtctggatagaaaatcaaaccagccacaacattcccttaagccaaagcctaatccacaggaaggttgtaactcttcaatctgtgaaggctgaggaagtaaggaagctgcaaaagaaaagtttgaaactagcagaggttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagaaactagcagaggttggttcatgatgtttaaggaaataaaccagttccatgacataaaagtgcaaggtgaagcgacaagtgctgatgtaaaagctgtaccaagttatccagaaaatgcagctaagatcattgatgaaggtggcaacactaaaaaacacattttcagtgtacatgaaatagccttctgttggaagaagatgccatgtaggactttcatagctgcaaagaagtcaatgcctgggttcaaagtttcacaggacaggctgactcttttcattaaggactaatgcagctggtgaagccaaggctcattgaccattctgtaaatcctagggcccttaagaattatgcaaaatctactctgcccatgctccatatgtggaacaacaaagcctaagtgacaacacatctgtctacagaatgttttactgaatattttaagcccactcttgagacctactgctcaaaagaaaagctctctttcaaaatatcactgcccattaacaatgtagtaatcacccagcagctctgatggagatgtgcaaggagattaatgaatgttgtttccatgcctactaatacaacatccattctgcagcccatggatcaaggaataaagtaactttccagtcttattatttaagaagtagatttcatcaggatttagatcccatagatagtgattcctctgatgaatctgggcaaagtaaatttaaaaccttctggaaagcattcaccaatctagatgtcattaagaatattaataatttatgagaggaggtcaaaatatcaacaaaataacagaggtttgaaaaagttaattacaaccttcatggctgactttgaggagcttaacccttcagtggaggaagtaactgtagatgtggtagaaatagcaagagaactagaattagaagtggagcctgaagacgtgactgaattgctgccatatgaggataaaagttcaatggatgagaagttactttttatggatgagcaaagaaaatggtttcttgaggtggaatctactcctggtgaagatgctgtgaacattgtggaaatgataaccaaggatttagaatattgcataaacttggtttactaaagcagtggccgggtttgagaggagtgactccaattttgaaagaagttctgagggtaaaatgctatcaaacagcatggcatgctacagagaaatttttttttgtgaaaggaagagtcaattgatgcagctaacttcattgttgtcttcttttaagaaattgccatagccactccagccttcagtaagcaccatcctgatcaatcagcagtcatcaacatagaagcaagaccctccaccagcaaaaaagggtatgatttgccaaaggctctggtgattgtcagcattttttagcaataaattatttttaatgaagggatgtataccttatttttaggaatcatgctattgcacacttactagactacagtatagtataagcaccatgaaaccagaaaaaattgtgtggctcagtttattgtgatacatattttattctggtggtctggaaccaaatccacactatctcctaggtatgtctgtatgttacctcattcaaccatcacaacaaccctatgaggtagatggtatcactattctcattttgcagctgacattttcaaaatgcaaactgagcttcaagtttgagattcatatagtttaagtttcttgcccctggttacatagcaaagctccaacacaactgactctgactctgtcctgactctttgacctctactttgtactctctcacctctattttgtactctctcttcccaattatagttggtgaaggaataaatgaaaaaaaaagttctattatttaatatgctctaaagggcctggtagccaaaattcatccattcattttaaaaactgtcattgagctgctttatcttgcctcgtgccctactcagccctagtctctagagaggaatcacgaaaaaaaatctctgctgtcagaaaagttatgggacttgggggtatctggaaccaactaacactcaggatgcagtgtaataaagactgtggtgaagatgtgcattggatgctgtgggagcccatggaaagggaacttacctctctattgggaatcagagaagtcttcatacagtgggtaatgcatgatgtgagtcctgaaaatcagaggagtagattaattgattaaccttctgtaagaaaagtcctcctataacagaggactgcaaattatttggcttaaatatgatggagaggagttcatttttctctcacataaaagtctagcagtgaatagtccaagatcaatgacatacttctgccatcctcaccacttggcttcagtttcttgatcctagatagctattccatttgtccccatttactagccagagagaaagggaaaaaaagacagaatgtaatacagacagcttcttcataaaagcatgacccagaggctttcatgcattatttctacttgtattctgttatctaaaacttaatcacatgtccttacctagctgcaagggagactaagaaaggtaggcatgggtgcccagctaccattcagtgacttccattagtaaaagtaagaaggggaaggtgggtaccagtaagcaattagcagtctcttccataaagggtaagagtgaaagtgttctgtgtatagatcactctggatacatacaggaatgagacaccagagaaattaagttccataaaataaccaaagaactaaataactaagagactaaagaactttaataattcagcatggctatagtggagggtgaatgtaggggaatagtggaagatggggaagatggggctggagatttcaggatgtggccagattattgagtactttgtgtgctaactaaggaatttggcctttgtcccgaagacagtgaagagtcattgaaacattttaagcagtggagtaacacaattagattagagttgagaaagatcactctacctgcacttgggtagacagattaaagacaggagtggctggagacagaaggaacaattaggagactattataatcatagagagacatgatgagactcaaccaagtcagtggtagtgagcagaggggacagattagagagacattaaggaagtataattgatagaacttggtgactaaatggatgtgggatgtgagagagggggaggattttaagataataatgtccagatttgtggcttggacattggcattgttttagataataaaaaattttaagggacgaaagtgtttaattctagaaatgttgaatttgagatacctctgggatatccagaaggcaacattgagcagttagttagatatattggtatagaaaccagtagagaaacttggtagtgcaagccatgtgagtggatgacacggttgagaaagcgaatgagtgcagacaagtgagatcattagaaggttgaggacataatcctggagaacattaaatttcagagagagccagtgaaagagacgacagtgttcagagaagcagaaaggtaaagagagaggaatttttagaaatggattggttaaatgtgttaaatgttggagcacagtcaaaataaaaattgaaaaagtacctgttggagtcagcaatcagcaggccagtggtgatcattgtaaaaacagttacagaggagtgatgtgggcagagacaaggttgaggatcaactggaggatgaagaaatggagacttaactgtctggaaagtgtagaagaaaatgaatgtgatggcagtggagagtagcttgggttcagacaggagagacttaagttcatttaaatgcttttgagaaacagtattgtaagaaaggagatgaatgatggaggaaggtccctgagaaacaggaagagatgagatgggatccagagcataggtagaggcattctccttagaaagtgaggagagataaagtaggtttataagtgtggatgtcaatgagtttgtcagtatggggacagaaagttgaagttgtttactttatttatttatttatttatttatttatttatttatttattttgagacagtcttgctctgttgtccaggatggagtgcagtggtgcaatctgggctcactgcaacctccaccttccagatttgagcaattctcctgcctcagcctcctgagtagctgagattacaggcatgctgcaacatgcctgactaatttttgtactattaatagagctagggtttcaccatgttggccaggcttgtcttgaactcctggcctcaagggatccgcctgcctcagcctcccaaagtgctgagattacagacatgagccaccgcgcccagctgaagaagtttacttctaatgacctcccttttctctgaagtatgaggtgacgccatctgtgagggagggtgtctatggtctggtatattatgaatggctcagcaaggatgtcttctaactgagcaaagggaaataatatatgatgcgtttatctccattaataacactcacttgggttcaatcggaagagattgttggatggacagatgcatggatggatgcctataaacataataaatatgtattctgttttcctccactcaatgttttcaaaacgtttttttagaagtttagttcagggttaaaattttcttgaatcccatctgcattaagtaagtatattctcatttgttattcctcttcattattctagaccaacatttttcagccttggtattattttgacattttgggccaataattcttgttgtggggactgccctgggcattgttggatgtttagcaggattccttgcctttccccactagatgccaaccccccttccacagttgtgacaataaatattttcacagatgtcatgaaatgtcccctggaaaatagaattggccccatttaagaggttgtattcaaaaccaaatggaagggccctggagagagagagagagaagggggatttaagctagacaaatactcatgtacatttatcagttgatcatgacaactatactcatagacatgatcttcttttggcaaattagacaactgaggctcagagaggttaaatgacttgcctaacatgacagaggccataagtgatagagctggggtttgaactcatgtgtgttagatccctacaatttaggttctttcttaagcaacaataaaaaatattttagagggtgtccttgttttcatttttattatgttttaaaaaatcaaactaaacttaaaattcagcacaaaaatttaaataatatagaagtgtatagactaaaacaggaatgtatctgttgacattcctctgtaatcctattcactttcctagaggttatgattgtgattgttaacaatttaatgtgtatgcttttagacccttttctttgcaattataaatgacaaaggacagtgcattcatacacacacaaaactatttttgaataatgacatcatactatatatactattccataagctactttaaaatatttaatctttccacctcagttcttacaaatctacatcaccaccttttaacagttgtgtaatattcctcagtgagtgaaccacaatttatgtaactttcccatgttaatagatatttatgtagttttattttttttatggtacatggaacttgcatagatatcagtgtgtgtatgtgtcaggatttctgcttaataggggttttaaaagtagggagatcagaggtcttgcctatttaaaatcatgattgctactaccagattgacccccaatatggataaaccaaatcatcctcccaataacagcttataaaggtgactgtttttacccacttctttgtcagtttaggacaatatcgatttttcttaatttatcagtctaataggcaaaatgtgatatcttgtttgaattgtagttttataattattagtgaagttgatttttatgttcacaagctatttcattttcttttcctttgtatgtccttttcagtggctggtcgcttcaaaatcctcccctctccaggccactcccacactaaactcttcacctaaggcaaccactaatcagttctgttagtataatttgtgtttcctaaagttttgtataaacggaataatgcagtatatacttttcttttggtctggcttctttggttcagcatagttattctgagattaatttaagttgttatagtgagtcaatagttcattcctttttagtactgagtagtattccatcatatataccaaaatttggttgtctattcactagttaatggacatttgggttgtttcagtttgggtctgctgcaaacatttgtgtacagtctgtacgactatatgttttcttttttcttgagtaaacatgaaggagtagaaatgactgagtcacatagtaattatacatttaatttttaaagaaaacgtaaaacatttttcttaagtaactgtatcattgtactttctggaagagactgtaaaactcatgttaattctgtatatgtttggtggaatcctccagctaaactctctgggtctagagatttcttctttggaagtttttaaactatgaattgaaattttttaatggttataggactattcagatgatctatttcattgggtggtttttttttttaattcactatgacattgtatgattttacattcccatcagcagtgaaagttccagttcctccatattcttttcaacatgtggtatggtcagtctaaaaaatttcaaccattctaataggtgttcagtggcatcgcatcatgtttttagcatgcatttccctattgacttaatgatgttgaactttttttatgtttgccatttgtatgttttctttggtaaagtgtctattcaaatattttgcttattctttaaaaactgatttacttgttttcttattattgagttattgagttttgggagttctttatataatatatatataatacaagttctttatcagacatatgatttacaaatattttaactcagtctgtggtttttcttttcattcttaacagtgtcttttagaaaatcatgagttttcaaatttgatgttcagtttattgattattttatgaatcattgtatctaagatatctttggctaacctaagattacaaagatttttctcctcgaaattttatagtttcagcttttaaatttgattatagcccattctgagttagttttcttctgtggtataagatacgaattgaagttttttttttttttttttttttgcctatgtatatcacattgttccagtaccattgctgtcctttctccactgaattgcctttgtaaaataaataaataaatttatctgtatagatgtgggtctatttctgggctttctattttgttccattgatctattcacctatcttgacatcagtgccacactgtcttaattgttgtagctttataataagacttgaaatcaggtagtgttagctttccaactttgtttttctttttcaagattgttttggctattctaggttctttgcatgtccttatacatttttgaatcagcttgtcaatgtctacatacaagcttactggtatttgggttgtgttcagtctgtagatcaattttgtgagaatttacatcttaacactattgagtctttatacctgcaaacaaaatatatctcagtttatctagattttcttaatatttctcagcaatattttgaagattttagtgtacaaaatctctctggcactttgccttgcaaattctcacttccttgtctttcccatactcccaattcagtcttctcaacgtagggatactactgggttccacttgggttccccttcctgcactgcagcctgcaaaactctaagctgggaaactcatagggctgacctcatttgtttttttcagtctctcagcattcactgtccttcactgctggatttccaatgcctttaaaactactgttgcatgtatttttcctagttttgttttgtttttacttgtttcaggctaaatgagtaaaactagtttctgtgccctatcttggccggaataagatagtagctgtttgtagtagtattttagtagtagtagttagtagctgttaatagtagtagtattttcaggtgacagtttggccttttacattagaattgcaaatgtatttgttttttgcctcagcaattccagtccctcttctaggtggtggagatagagcagtgaacatgacagacatgcttctatgttgtgtaaaatctagcttggagacagacagcaaacaaaatcaataagtaaaacgtgttatatgttagaaagtgataggaaatgctgaagagaaaaaaaattaaaatggaaggaagataggaatgcttgcgtagagggaggcatgtcattgttttaaatatattgacctggaagggcttactgagcagagtatgtttgattagaatcctagaagaatggatatctgaaggaagatcagtctgggtggaagaaacagtcagtgcaacgacctcatgtattcgaaaaatagcaaggaatatttgtaacaactactacagtgtttgagctcacaaaatggtggctctttagactattattactaatgatggtggaattaggaatatgacctagaaccgtatggcctcaacattaatctgcttgctgttaagttacattttgtcttccttacaatcatgaggcatatactcacggtttgtgattgttcatgcattgtttcttatcattgtccaccttttacacagcttgccttgtgttctcaatcatgttatttccatgcccatgtagtctgtgttgacccttgcctgatgggatattgggctctgacatttctctttacactaatcactggggttgattttgttagtctcactggctagacagtggtctcctttctccatcacatatgtgtatcatcccatagtgtatgcacttgggctaaaaggttggtctccatggagactggaaaatccttaagtacacatgagacattatataaaaattctaatcacagctccttctgcatgccttcggcacttcttatagcatccaaggcactgtgttgttgctttttaattttattttactttttattgaatagataatgtaccatggcatgaaattataaaagaacaaagtgacataggagggaaaacacagttgttctccctgtattccccagccaatcattagtcctaccttgagacaaacaatgtaatcagattctttggtatcccttcagaactatttaaggcatatgggcatgtaattgtgtttagtctccttccatgtcctacccccacccatagaaggcaccttgacagctcctttaatttctttcttaccacactctgtgaagtgggtgatgctgtccctatgttacggatgagaaagccaaggctcagagaagtgaggtgacttgcctaaggtctcccaggaaggacatggaaaatccaggactaatgccatcttttataggcattttttcttccaaactgagaagtgccaggttctgtgccttgagcatagtaggagatacctaaacatttacctgtagctagagtgattaagaaaatctctgattctttgagtcatgttagtattcacgttacaaactctagatataaggccaacaagcatcaactggtgggtagcattcagaagacaaaaacttgatctaattattctctagatatcttccttctttctccacagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaaggtcagtactgaggttcacctttagcttctgaatggtgattagacacaaagaggatatcgaagggcagaagcggtggcatgaccatttttctctctataaaagtagacctttcctggctcctgagcttaaaagcagccagggtttgtagtttgtgctcagagaggggattaagcctttgacagcagataggatggtgatgagcttgtaaaggaagttaccacgtggaggatccctataaggccagtgcaggatccaaggtgttcttagatttatgcccccaatatattgaaatgggtgagcaaggtgaatgttgtgaaattttaaattcaaatatagcaaacacggattggataactactatgtgccaggtactgtgctaggtgaaattaagatacattgcttgccctcacagaagaaatggagacatagataagtgaagaaataaatgccttcagtggaataattgctagtgtggagactacacccattctaaatgtgcctctgccctcctactccactaagaccatttttgtcaggtttgccaataatctccatgaggccaaaccaaatagctacaacattgttctcatcatactcagtttgtgagtagcatctgacacagttgactaactcctccttcttgaaacactttattcacctggctctcaggataccagattttcctttaatctcaccagataatccatctcagtcttctctcctggttttccttctcttcccaactttacatgttagaaggtcccagagcttttttcttagtcctgttctctgatcatgttcttttcctgtgtgatctcattaaatttcatggttttacatatcatttaaatgctaaagatgatttccaaatttatctaagattgatatcttgcctcttttgtcatatcaaatttcctgctcaacagttctccttggatgactcatgggcatctcagtttacactgtgcaaaacataacttgatgcctgactctttcttaacctgctcctactctggtctcctccatctaagtaattggcagcagcagtcatccagttgctaaggtcaagaactttggaatcatccttggttactactttccctttttccttcatattgaatccattggcaattcttgtcagctctacctgcacattatatgctaacttctactactgcccactgcttctatcactgtaagccactattatctcttacctggtatcattgcttgccttcttccttgcctgtaattcattctccccggcagccagtaacagcacatcctttaaaatatggaaatcaggattctgcaagcttcccaagcacacatcagcagccggctcccttactgtctgaatcatcgacctctctccatttccaaaatgtcgctttctaacaagctgacattggacaaaccagacgtcaaagggcagcgggtcattatgagagtggacttcaatgttcctgtgtagaataaccagataacaaacaaccagaggattaaggctactgtcttaagcatcaaattctgcttggacaatggagccaagtcagtagtccttatgagccacctaggccagcctgatggtgtccctatgcctgacaatactccttagagccatttgctgtagaattcaaatctctgctgggcaaggatgttctgttcttgaaagactgtgtaggcccagaagtggagaaagcctgtgccaacccagctgctgggtctgtcatcctgctggagaacctccactttcatgtggaagaagaagggaagggaaaactctgggaacaaggttaaagtgagcccgccaaaatagaagctttccgagcttcactttccaagctagggaatgtgcatgtcaatggtgcttttggcactgctcacagagcccacagctccatggtaggagtcagtctgccacagaaggctggtggttttttgatgaagaaggagctgaactactttgtgaaggtcttggagagcccatagcgacccttcctggccattctgggtggagctaaatttgcagacaagatccacctgatcaataatatgctggacaaagtcaatgagatgattattggtggtggaacggcttttaccttccttaaggtgctcaacaacatggagactggcacttctctgtttgatgaagagggagccaagattgtcaaagacctaatgtcccaagctgagaagaatggtgtgaagattaccttgcctattgactttgtcactgctgagaaatttgatgagaatgccaagactggccaagccactgtggcttctggcatacctgctggctgaatgggcttggactgtggtcctgaaagcagcaagaagtatgctgagactgtcacttgggctaagcagattgtgtggaatggtcctgtggggggtatttgaatgggaagcttttgcccagggaaccaaagccctcatggatgaggtggtgaaagccacttctaggggctgcattaccatcataggtggtggaaacactgccacttgctgtgccaaatggaacacagaggataaaatcagacatgtgagcactacgggtggtgccagtttagagctcctggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgttaaaaaaaaagtgagctgtgttagcttagttctcttttgatgtagcttatcctgattagctttgtcactgtttcactactcagcgtggaaacaagatgaaattccatttgtaggtagggagacgaaattgatgatccattaaatagacaataaaagtgtccattgaaaccatgaaaaaaatggaaatcagatcacatcattccctctgtgccaaattttcagtaacctcccttcatacctagaataaaatttgcattttattcttcattatatgactgttgcttatttctgtgaccttcatttctgaactttgctctctcactgtctcttttgctctctactgtaatctcattgttcttgcaggtccttacttgtgtcaaacttacctaagggcctttgcatttgctactctcttggccctaaacattcttcctccagaacttcacaaggctcactctttcattcaggtgtctactaaatgctttcttctcatagagaccttttcttaacattctacttaaatagttctttctcctcctccaatcactccctatccctttatatggcttaatgcaactcatatcccctgcttctgtttgttcacatgtttattatctctctctcccattagaatgtaaaatctatttgattaccaggccctagaacaactcctggtatacatatcatgtatttagtaaatattctaagaatgaatgagtggatgtataaggaatgatgaagagattatcacttaggttaagggatcaactctttgacagaggaggtgagctggcattcaggagaaagtggaggggaacattggatgcctgtctgttgttccatagtctcatttttacagaatgggtttgtttatttacagtctccccaaatataaactctatgccagtggccacttgttttttttactatatccaaagcatgggcacagtgccaggcatatagtaattccttaataaatgagtgcaaaaaatgaatgaactgtgtgtcagtagatagaaggtctaatttaatcttggctactagcctgctgaataacttgagctagtcacttcccctctctggacctcaatttgcccctctgtggtgatgagggctttgggacagaagatctccaatgaggttacccagtctagacattttttatttttaacttttttaaaaactgagctataattcacataccataaaatgcaccattttaaagcgtacagtttaatggtttttagtaaattttgtgcaactatcttattccagaacatattcatcatcccagaatcccaatacttttaaatttacttctcccccaacctctgacagttactgatctactttctgcctctacggatttgcctattctgaacatttcatagaaatataattatagaatatgtggacatttttgggtggcgtcttactcttagcataatattttcaaggttcatccacattgtagaatgtatcagtacttcattctttcttatggacaaataatattcctttgtatagatgtagcacattttatttatccattgatcagttgatggacacttggattgtattcattttttggttattataaataatgccgctgtgaacattcatgcacaggattttgtgtggatgtctgtttttaattatcttgggtatatacctaggactggaattgtaggttatatggtcggtctatattaaaacttttgaagaattgccaggctgttttccaaagcagctgtacctttttttttttttttttttttttgagatggagtctcacagtgtcgcctgggctggagtgcaatggcgcgatctcagctcactgcaacctccgcctgccaggttcatgtgattctcctgcctcagcctctcgagtagctgggattacaggtgcataccaccacaccaggctaattttttgtatttttagtagagatggggtttcactgtgttggccagactggtctcaaactcctgacctcatgattcgcccacctcggcctcccaaagtgctgggattacaggcatgagccactgcaccaggcctcagctgcaccattttactttcccaccagcaatgaatgaaggctccaatttcaccacatcctcaccaatactttgtatagtctgtcttatttattctagccatcctatgtgagtgtgaatccataatctcatttaatgttcagcactcccatgcgaggtaggtatgctgaattctgttttatagtgaaggcactggaagctcaaagatgatgagtagttttcccaactaacacagctactaaatgacagaacaatttgcactcatctatcttatcctaaagcttatttatttactataatatcacacttcctataacctgtctgaacactgttctgagaaggaaccaatcctgctcaccagtagcatctcattatctcactctgaaatttgatatcccttttgtatatagtatgtcagtgactcctttcaccctcgtcatggactccatcacacctccataactaagccctgattattccacttctttaacctctcttgaatctgcctctcttttctgacgcagctctagtttggatccttctcaacagcggtcccctagcttgtctttctgccaccagtctttctggtccaagctacttttcattggaacgagcctatttttcattacttttcgtaatgaacccaaagggatgtttaaaaatgcatatttgataatgccacttctccccacccccagccctctgccccccaaaatcattgtcttctgtgactcaaaggcagagtttgtattcctgagcatggcattcatggacttcatgatatagccccaacttattgcaacaacctcacctccagctacccacactttttcatctgtaattggtccctatgctcaagccaaaccaaacttttaattatattttcttaggcaaagcatggtctttcactcctccaagttgttttttgtttgaatgccctttctactttgctccaccttttggaattcttcaaggcccagcttaaaagttacctgttttataaagaccctctctaatccttgcagtcagtattagtactgtcttactcctagcacttatttgcatgaatctacatgtattataataattgatttatttctattactgtaccagtgtgtatcctctcaaagcttctccccacctcttacccacccatggaagagaggcctccactttaagggttggccccacgcctatttatgaggcctccctgtctcatcctgattcactcccagttcttcgtagtccctgagacttgtctgtgtgttttcctgtagaaatgggtggctggttagggaaaggggatggcaccgaacttttattacctgacagagcaatgaactctcttcagaaagagtaagtagactctggaagcagacttcaagatttgaaatttggcgtttccacttagtagttttgtgacatggagactgcgggtgtcttagattccttatctgtaaaatggggctagtaacaatgtactactttatagagctgttttgaggattacatgagataatccaggtaaagcacttagaacagggtctgccatggtataagtgctcaagtaatggtatgtgttgtctttatcagtattattctcattattactgtcattgtcactattatcattatttttattcaccataccccagaacctagaaatagtttccctgctgaaaggcctggctccgaagtcatcatggcttctatcattacatttcctattttcccgagccagcagaagatactttcctgagtggaaggtagcagcctctctgaggctgtgtatgtgggtcctctttatgaagattggctctcttgagatggtgatgttactctatggcctgtagggcacaggcaacctttatttccctaagggagagcagagatggagtcacttgtccagaagaaagtattcagataggaacatgcagctgagatgttgggctaaagcatgtgagggaaagaatttatgtcaccatgcactttattgtttggagagagtagatgtgcttgagttactcctgagtgctgtgtttaaagatggcctctgccacaaggcacgtcctggaagccagaggctctagttatttggcgctcttgtgctcatgttcatgccattatttgtgagcctttggtagttttttgtttgatggcctctgtctggttgcacttatgctagggttaataaataaagggctatgtgtctactttgggacaaaattagggagactataggggaactccccttggttccggcccctttggcagtggcatcagtggtggcaaattcccaaggagaataaaactgtctaggggacaaaaacctttgcagcaagacttcccccatggaaacttttgcctcactgcccacccaccacataatagtgtaaataataaccaccaattaatgagtgtctgttatgtgccaggcactgaaataagtatacctaccatctcctgtaatcctcaccataacctcatgagaccggtattctttattattcccgttttactgaggagaaaatttgaggtacagagagaatagggaacttgtacgaggtctcacagtcggtaagaagcagaactgagattcagacctggccacctggcttcagagcctgcatttcttttaacattttattgcgaagaattccaaacataaacagaaattggaaacaaacgtattgaactccccacatttcagcatttaaaaacatatatcaagtcttatttcatctatacccctacccgttcccccaacctactcatcatgtcatttcatttgtaaatgtttcagtgtatatctctaaaagaaaggaactcttttaaaagcaaaaccgcaatatcatcatcatacttaaaataaaacaaaacagtgattccttaagatcagctatccagtcagtatccacattctcctattatctcattttgttaaaaaaaatatcaagatctaaataagatccatgtattgcaattggttgatatatatctcaggtttcaatttgctggccggaacctctgttctttttttttattattattatactttaagttctagggtacatgtgcacaacgtgcaggtttgttacatatgtatacatgtgccatgttggtgtgctgcacccattaactcatcatttacattaggtatatctcctaatgctttccctcccccctccgcccacctcacaacaggccctggtgtgtgatgttccccttcgtgtgtccaagtgttctcattggaacctctgttcttaaccactgcactcgaagttttttatgactatggaaggtgacaatttctttacagcaggcattctcaatctggggtttattgacagcttcagaaggctctgtgaatcactaaaaaattagttttcaaaatttttgctatatttgtgtgggttaatttttctagagagatggtccctaggtctcattagggtctcaaaagctttaagtaagtctcagaaccactgaaagacatgtactaatgtcagaggaaattgtagaccacaaaagctggggaaagaacagttggaggtttccttccgggttggagaacgaagttaaagtatgttatgttgattaacttaaaatttgagagaccttaacaaaatacttttcagagaagtggttaagaattaactgatgatgtcttcatttgcaaagaatagaatatgccattgactggggactttaagtcttttttgagtgacatattcctttaataaaacctcttggtttactgtggcttattgaattgtggtggtgaaaatcatacgcggatcttgaattccctatttggattggatctgtggctttacatgaactgggaagggtagagaatgattttgtgggatatagttggtttgtgccacagtgacataactgctttgaaaatgtatacaaattttcaaaattaagtatgtatgcatgtatcaaaatgaaaaggttttaaaagttatcattaatcttccctcttggcaccaacttttcctagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggtaagtgcttgggaatcccatgggagccagagctgaccctaactacttttcaccttgagatccttctgagtttggagatatatttaagtggaaatatgttccagtttactaccactaatattggaacagtgggcaagatcacaataatcagtcacaataatcactagaatgtaagctccatgagggccgggattttttacctgttttgttgacctctatatcccaagtgctatgtgcctggcactgtactaattgctgatatactatttcttatcctcacaatcccactgtaaagaatgtattattcttaatattttctttttttttttttttgagacggagtctcactctgtcacccaggctggagtgcagtgacgtgatctcggctcactgcagcctccgcctcctaggttcaagtgatttccctgcctcagcctcctgagtagctgggactacagacacttgccaccatgcccggctaatttttgtatttttagtagagacagggttttgccatgttagccaggctggtctcaaactctcgacctcaggtgatccacctgccttggcctcccaaagtgctgggattacaggcgtgagccaccacacctggccaagaatgtattattcctgtttttttttttgtttgtttgttttttttaatttggaaatggaggctgctgtagataagtgacttgccaaagattcacagctaataactggcagagctgggatctaaatcttaccatgtctcacaggcaccaaagcctgcgttctttccactgaggcagaactatcactttaccttcctataagaagctatgaatctgtgaacccttgttttctcattctccctttccagtttgggagaaatagggacaaaggggcacaacttctgccaaactctggatttttgaaattattgcaaattcaaggtgtggctgacttcagcaaatttaattaactattgcatgttgagacttatgttgagagactggggctaatccagaggggagttttaggggacacaattctatgaagatagtaagatataatggacaaaataaggatttgagtatcagaaaggcttggatctaaatcctagctcttttactttgtagctttaaggaatttcacaatatagcaaaatgtaaaaccttaaaaaatggttaagaataatttatttgacaaatatttattgagtactgaccatgtacctggccccattctacatgccgaagacatagaaatgaataagacttatgaagtccctgtcctcttgaggtttagataagagggcttggcagactatggcctgtggacccgattgggcccactgcactgcctctttttatatagcctgtaagctaagaattcttttttacattttttaatgtttggaattaaaaaggaaataatattttttgacatgaaaatgttgtgaaattcaaactttgtccataaacataaatacaccccttcatttacatgttgtctatggctgctttcatgccacaacagcagaattgagtagtagcaacaaagacttcatggcctgcacagcctaaaatattaactgtctgacactttacagaaaaagtttgctggcctttaccttagattctagagtactgataagaaaacatgaggcccagaatgggaatcgggaggttgggagaaggtaggatagcaaggaaatggcaggaatggagttagtatacaaaatatttgccatgaatacttaaacacttggtggagcagtgtcacaggtttggttccaaactttctagagaaaacaaaaagagagaaaccaatggttatataactaagttcctaaggtaaaagcaagccaattgttcaggtaagccataacttttctggttttgaggccagggaaaaatttcttccatggattatttcatataacaacctcagtatgaaccaatggcattgtctcagagcacaatttagtaaaagctattcagtgtgcggatgggagggggtccagtacaatttctacaagtccagtacaatttccacaagtagttgactctgaatgctctggtttgatccactgatgctgatgtgatcactcatgcgatcacagttaatttatgtaagctgtttgtaccttggtttccagatctgtaaaatgggaaaacagttcacctgttagaattattattgctaggattaaaaggaatgacaaaatatctggcgtataatcagcattcaaaatatgatattgatttccctcccctgtccctcttctcactatgacttggctcttctgagacatagccaagaaaaggaaaactttaatgtagacctctgcttctgtttttaagtcatgtcgtgaccttcctatcaatctgggtagaaggttgggtaactcaacttatactcgtcacagtaaaatttgtcttgtctgttgccaagccttgagactggccagattctatcagctcagcgcacacagtaactcagccctccttccctccctcctgcaaagttcaatcccagtggcattcccctcttccccttcctccagtcctaccctgggctgctggcggcagctactctgatctaatggtctcagctaatgtaagtactgatctgacttgttcagtatcagcctaactatctaaatctgggcctcagctttgcctggcttcattttctgctttcaatcagttagcaacaggctggcacgatgcagctttttttcaaaaccccatgcttccagctttggctacagaaagcagaactgaggtggttttggccttggtggagaaccccccaaacctctggtatagttgcctctttgaacctaacctacactatctattcacttcttacttcctccttgctcccctcctgattctggctgcttctcctagtagattccctggcatctgaagagttatcggttaagcaaaagccacacacagctctgaccctgtgctataactggtagttgtttgctcctggtactggccagtagcctgaatggcagtattagagggagggaactgttacctcagccagcccagtctgtaccttgcagttgtcaccccatttcagctctgttgtttaggactttgcctgccatcctgaggatcagtacacaggctccattgcattagtgagccagctgtgccacagtcctgcccccatcttcaccccttgcattgacttaacatttgagtggccttaacattcttcacattttttctcagcaattaaaaataacaaaagcatggtgcatgttaaattgcttttttccatgacagtcaactttaaaataagaatcaatagtgtttgctgatggaattttatcaaggatccttttctgttccagacatgagcttgatactttcactcttctgttgcgtctaatcattgtgataggccttgtgaggtatgatttaccctcccctttttatagatggagaaacagaggctcacagacacaaaacaacttgctcagagttacctaggttgtaaggtgcagagatggggcttgacctcagcttcttgggttcaagattgggactctttttctttataccatatttcttcagcagcgttggccatcttctcctttctgtttttctaaggaccacttacttttgggggggtacaaaattatacaagcctatttttttctgccttcatttgagtttactgcctcttaggtgtcctggctttgcaaagggcaggcatgtagctaccgcaaagggatttaggactttcctttgggtaatgaagagggaggagggctatatcccatctactttacatgtatttgtttatttaatcaggtataatcatatgcaaagggagagacaaaaatgaaaagccattgtctctgccttccaaaggtttgtggtgacactggcatgcaagcagtcagtcccagccaatgtgattaatgttctagtaggggtgagaagaaattctagtaggagcatggagcaaggagaccttcattctacctgaggtattgagatgaaagtgaagagcacaccatggactgggactttatgacatatgggttgaggggcccttcttagctcctttcctctgtcttggctggaaaggaaagattgcatctggtggcatgcttttgggcttgtaaggccttgctcagtcacagagccattaattctccactgaggtgactaatgttatgagtggcatttgcatctactctaaaagtattaggaacagacttgctcttgcagtaatgggtgttgctggccattatccacattttcttgtttggacttatgctttaataatctactgtttggtttttattctctacttttcttggagcctaacgccaaattgttttataaggataaataatggctaaggaagcaggaaggctttaaggtgagcatggaggagtgtcatagaaaaaaagaggtaattctaggtgactgggggaatctacaagaggaatcaacctcctcctactctgtgccttcaggttgggtatagaggaatataaggaaaggtggaaaaaagttgctaaggttgaatactgatgaccatcaggtcccaagaactctgcaaatgttaagattctttggttatggtcatttgacagagattagagagagagggaacaggtggggcttgagaaggagatcaagtttgtagtaaaagccaggtttcggaccaaagttgaaaagaaattaaaaagaagtacagcttggtggaaagcctataggctcaagtgacttagtggttaaaagctcaggctcctgaatcttccagatgtgagtttgaatcctggctctgcctcttcctagctgtgggactttgggcaggttacaacctctctgaaccttagttttctcatttgtataatgaggatagtatttgcgcccataggattgctataacaacaaagtgagtcctctacatgcctagcacatcaagagtactcagtaaatgatagcagttgttttgccttcataggagactattactagctacttgatcttagttagttcagctttacttctttgagccagttttctcaactgtaagtggggacaataccaccattgaaggcaaggattttgcatggattaaattagattaggtatacaaagaatctggtaaaataatagaggcttaagaagtggtagtattactaggtaacaacctcttaggaaatggcagacatggaagatggggtgtctactcttctgtattcgaggccctttgagaagcctcaagcctaaaatgtagatggcataaaagagttcagagttatattttcaacccacaacctgtccctaccatgccaaacacctaggaagaggcgaactaacctcaaggtctaactcaagtctcattctgtccatgaagccttctgacaatcctaccccagttagctctcccttgattcacatattttggcacccaagattgaccctctaatgtggatgctggtttatagtattcacacttgtttcccatgaatatgacttatatcccccaactcagttttgagctcctagagggcaggggtcatttgtgtgtctttgtgtgtgtgtgtgtgtgtgtgtgtgtgttagagtgtagggttgggcacaaaagccctcacaaaacccccatattgaataccgttcaatttaggtttcagagagagaaaaagagagagacagagggattaattattttaaagcaggttaagtacatgtagagtacttcaaaaacagcctataaaagtcagctgggtctaacatttaagtcagtccagcaggccagcatggcacatgtaacgagcctatgtaacgagcctgcacattgtgcacacgtaccctagaacttgaagtatatttttaaaaaataaaaagtcagctgggagagatagaggcttatagacttagatcattggctcattcatctggaaaaacagtccaatccccatgttatactggtaaggaaatgatccgctgaaggtcacacagaaagttagttttagtattaatcatagaatccaggtttcttgactaccagttacatgactctcccctttctgcctcaccagtttgatactgtggcttaactgtgactgagacacattagaggcaagagagaacaacatcggtgtcttcagccaagaaaatcctttgctgctacctcaaagctttacttgtaatgaataatcatttggaggtagcaataaagggcccaagaggaaatgaggttaatgatgtttgttttccaaggccctaggttcatgttcattaggatgtggctataacttgggaatgaatagggttcatattttagggatgtcatctggttcactcatcaaggcatggtttcaggtagacatgttttccagctctaacagtccagcatatcatttctttacaattactgccttcccctccacaactccgcctcccagcagtaaccagtggaaatggggcagcactctcagctctgctactctgtggggtgcagtgaggaagcaacatcatatggcttaatggtcctcaatcttggctgcacatagcatcacttgggaagcttttaaaaatacccatgctcaggatccatcctaatcaataaaactaggacgtatgaggttggggtccaggtactttacaattttaaagctccttacatatttctaatgtttcactagggttgaagaacagtggtagttgggactacataggtttcagaaatcagatggactgatcaactatgaagttacttttcatctctgagtctctgtttcctcagctgtagaacggagataatactttctgtcttgcaagattgtggccagtgttgaatgagaaaatgtgcataaagcactgagtacagtatcacagtacctggaacagaacaactgttcaataaaggttagctaaaaaaattttgccagtactattgtattaccattactattattattataatttataatttttatattaccaatgataacaaaacagcagacaactggaaaggcagtgggtgtggaaacaggaggtatgggtttcagccctcactctaccatttaacctatggttgtggatgaatcagtttacttttctgaacctcagtttccttctctgtaaaatggggataataagacctatttattcatctctctcaagcttattgtaaacattaagcagttatcgtctgggagagtgctttgaatagtataaagtatattagaagaattggattattattatcattttggttaattttttctgctgcaatgctgtatacccagtctgatgttaaggggaatgacatgtccagaacgtaagatgcagactaaatggagagacaattcatatgtgtgcacatgaatagtgttttgtttcttccttaattagaacaccaatcacactgtattatcattatttctttacatatatatcttgctcaccagaatggctagatggatgaattttttaaaaaacgtacatattaatatataagaacttcacgaacatttacatggatgtgaattacatatacctactagggtgttcagagggttgagattttagctgggtcttgaggaatgattataatacacaggagacataagaatagggacacatatagggcaagaagcaggacagagtctgacgcttacttacctctgctgtatactaggcattgtctataggtcatctaattgagtccttaaaatcaccttgtgaggagggtttttctttctttttttttaaattatactttaagttctgaagtacatgtgtacaacgtgcaggtttgttacatatgtatatatgtgccatattggtgtgctgcacccattaactcatcatttacattaggtatgtctgctaatgctatccctccccgctcctcccaccccatgacaggtcctggtgtgtgatgttccccttcctgtgtccaagtgttctcattgtacaattcccacctatgagtgagaacgtgcggtgtttggttttctgtccttgagatagtttgctcagaatgatggtttccagcttcatccatgtccctacagaggacaagaactcatccttttttatggctgcatagtattccatggtgcatatgtgccacattttcttaatccagtctatcattgatggacatttgggttggttccaagtctttgctgttgtgaatagtgccacagtaaacatatgtgtgcatgtatctttatagtagcatgatttataatcctttgggtatatacccagtaatgggatggctgggtcaaatagtatttctagttctagatccttgaggaatcgccacactgtcttccacaatggttgaactagtttacactcccaccaacagtgtaaaagtgttcctatttctccacgtcctctctagcacctgttgtttcctgactttttaatgatcaccattctaactggtgtgagatggtatttcattgtggttttgatttgcatttctctgatgaccagtgatgatgaacattttttaatgtgtctgttggctgcatgaagaggaggggtttttatactcatttcgcagatgaggaaatttacagtcgtagaggtgaagtacctgtctagggtcctacaacctggaagcagcagaacaagatctgaaagccaggtctacaaaactccagactctgtctcacttagaagtaagagtcaagggtttgccttaatggggcagtaggcagaccaatttgattagagtagaactgatagttaaaatccagggttactgcttgggacagtaatatgggaccagctcaaggagggccttgattttctgtgaaggagtttaaacttttatcttctacattttagagctgttgggaaagtctttaaagagcagaaaaacagtgtaaaaatacttaaattaaattttatagttgtatatgtagattcaatttagtatgtttttacatttactgtaaatatttttgtagaaaaaaatggatgaatataaagatccactgacacccttgcatagttatgtacatgtctatttcagtatggtcttcatcaggccatgagcactttctgtggacttttttttcacttgatattattttgtatgcctgtttttgttttgacctggtctaaatttttggcagttcacacataatatgtattggttaaatgcttgtatgaattgaattgtttgtttagcctttatggttaagtctgattttttttctgataagatgcatgtttttgtgccaattgctttttcttaagtgttttttttgttttgttttgtttttttgtttttttgcctcttggattagtccatttgggcctgttcccaaaagcaaaattactggatcaacgagtatgaaccgtctcatatgtatgattttgtacttcatccacattgttccagaatccttgatgccctctagataaaataagcccagttcacattgccaccagcaatgtgtgagtttacctgtttcactatagtcctactagaaccatcttatttaaaaagtgtttatatttattttgtactaactgacaaggaaactaaagacacagaggcaggaaagtgagttagaaaacaactataatagtcaaggcctaagtgaaaaggacctggatatcagtgatgatgaatttaagcaattcaaattcatcatcatcagacatttagtaagcacctactatgtacctggccctgcactaaacatattagtacctgatttaatcctcccactatctctgtaagataatatattgtggatctttattatatagctggggaaactgagacttagggaatggatatgacacacccaagatatctgaaactccagagctggggttcaaatatagactttctgaagggacagttgccagaaaaattacaaaaaaaaaaaaaaaaaatagccagagttgttagtcaccaagaagaaatggaggccaaggaagttggcccaggtaactctcatattgggtgcctgctcatgagtagtgttctgtttggctaaccatccaagttcctggtatcattttctcttccaggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtgtaagtagggttgtacctcaaagttgactgaagtcctgtactaggccactaggaatgctttcaggatcaccatattaagggtatacagtgcacagccctggggcatccttcactttatagtctagggaaatatcataggccagccctgttgggagtattccactcaatgctcaaagctgagggatttctctaaagctgaaacctttgattcttagtacctgctaggagacccatttttcttagcttcctttatctctgtatggtgatattattaccttctgattttagcttccttggctcaggatattttttaaaaaaatttcttgttatttctactggttttaaaagtaatttaatgaacagattcattcactgtacttatgcttgaggcttttattttaagcaaagggtatgatttaaattttttttcaaaatgactttggttctccagagagtctcttacagggtgggagctgagctgatgtgcaacagaccttcctgaggctgggccgcaagccaaggaaccaaggaaggagcagctagggtgggaccacagcagtgctcagggaccagctttgcttggccacaacgcgcttgcctgtcctctctttatcgactgggaccattctcagtatactgcctcctggtcttcctttttcttgtctttcttgttttccataattgtaaaattggagaaaaagaagaacaaagcctccacagctttgactaattagcttactatatttacaaaaagccaacaattatactttgaaatcaagactggtttcatttatttcccccaagaagagcctgactcagcaacatactcagaccattctgaagcaatggggataaagagtgtcagctatggccttaggggtgcctatgggctctgggccatttcacatttgtatgtgtagggcctttgccagcaaaggcaggggctggcattggtgtcccatctggttcagagtctcctgtcctttctgttggccattggttctcacgtgtataccaaagcaacttatgggacttggttggcttctgtttgcagggtggcttccaggaccaggttttttgaaacagcttcccggaaaacaggaaggtaagatatggaggtgacaaaagaaaaaccaaatcgccttttaataactgcatccttagcatacaattgtgctcactctaacatctttctctttttgtttctctacagctctgtctctgtctgtcactttctcttccccaattctgtctctccatccctatctgtctgtcacctgttcacctgtgtgtctatttgtttctctcatattctttttctcacttggtgtctctgtcctttttttttttttttttgagatggtgtctcactctgttgcccaggctggagtgcagtggcacgatcttggctcactgcaacctccaactcccaggttcaagtgatcctcccacctcagcctccctagtagctgggactacaggtgcacgccatcatgcccagctaatttttgtattttcagtagagacagggttttgccatgttggccaggctggtctcgaactcctgacctcaggtgatccatccacctcagcctcccaaagtgctgggattacaggcgtgagccactgcacccagccagtgtctctgtcattctcaatctctttctgtctgtctgtgtttctttgcctgtgtccccatagttgtctttatctgtctgtttctctgttcatgtcactctatatgtctctgtttttctcttcctgtgtctctttgtatctgttgtctctttgcctcttcatttcttcatctctctctctgctcatctttcccttttctctctcacaagcacatatgtctgtgcacacttgtgtgtgcatgtgcatgtgaacacacaccaagcagtatctcaaagactttacacccaatattttttgttagtttttttttttagtttacttttttgttattttacttatttagattccattatatactcaaagggcagctgacagggatatgtagaatattacactctaagataaacagccttagggcccccatttcaaaggtaaacattggacttaggcagtggttctcaaactggctgcacatctaagtcacctggaaacatggagaaaaaagtcacatattcctggatttcattctagacccactaaaacagaatctctagtagtggggcctgggaatatgatttttttgttttattttgttttttccttccctccctttcttcttttccattagtttgttattaaaacttctcaagtgctggtacagactgtccaaggcctggaatttaggaccctttggactagaacatctggagagatatttggttagccttcagggactcttttgtgagtttgttccttcttggttatcagagagtttgaaattgttcctcctaacaggtgacaggagcagaactcttctaggtggtcagttaaaagcagaacaatatacctttcccagcagtggagttggggtagattttccatcctctagtcaaaactatgggaactgacacactaggacatgattctgcacagcagttcattctagctctgattgtcagtgagccacctggaacctcaggctgggccaaattctccttagacaataatttaccattcattctaccatagcagatgaaagtcagatcaaggccccagatttctcttactgatagcatgaagataaaagttttcacctcagaagttttttaagtaagcttaatcaaatatctctcttgagaaaagaaaaagaaaagaagaagggagacgaagagagtctcaaatattcttaataaggtggcctatgccttcctagaataagccacttgagaaataaataacaaggaaatagaacgatgtaaactggaatgaactggatatgtctacaggaaagctttttagaggaggtgatatatgagttggggcttgaaaaaagaatagaactagacagaaaaaatgctgtgggggcagttattgatctgcaagcttggacaggaaaccaaggcattgagaaggaaatatgtaagaagcatgaagaaagtccaatagaacttttaaggcaggtagacttacaagagggaagctatagccaaactggtgttgagagtgtgaaaagattggtagccactaccaatgggctgggctttgtcagccagtgctcgaggaagccttagatcaagcacaacctacaagggctatggccaaagcaggcacttcaggctagaatatcactctacccaccctatgtctgggcttccagaacctagatttaatcctgttctttattcctagattccattttggcaggaatgtaggtaagaccaaagtaggtacacttgctctccagtatgtcatgaactaccatcctgagtacccacaggctcctcccactcagcatccacatagggaaagcatcccttccatctaggcctccaccttgtaaccaccacttgcatcagtgcttccacaggttggcctctgatcaagatcctcagaccagtcacatagtcagtcccgtctatggtcattgttgctaagttcttctctcatctctaatgaaaatgatgatctttttaaactttgtcttgcccctttttggtccccatttgtatacctgactacggcctagcgtttgaatgacgtcacccccttattcatttcccttacacaatttaaacataaataactaagaagaaaatgagtagtggctcatcaagaacataaaggaggtgagaacatttcaaagaggcccgacagcttatggtttcagaagttattagtgttccactttggctagaatgtgggagtgaaaagagggaaacttagctgggggtgagaccagaaagatggattggagccagatcgtgaaggcattgtataacatactaaggtgcttggtctttatactgcagtccatatgcggatgagtcatagaaaggggggaagaatttcaagaatgacagtcacattctgagctgaccaagttgtaaaaagatcactttggtagtgggaaagatagatgggagagtaaagactggagaccagttaaggagactaattgtcctggcaagagttggggaagccctggcctatggcattcccagtgggaatggaacagaagggacagatttgagaaagactcaataagaccttgctacattttcaaacatggaacattgatgaaccgagaaagagaaaagtctaacttgggcacttaagtagatggtacaataattaatcatggagaagcaggttttatgggaaagatgctgagctcaattttggacacagtgattttgaagacacagttgttaaatttatacaaattttttaaagacactttgagacttaggtagagatagatgttcagtgggtaactgcaacttaggctagcagttggagctggatgtatgtatacatagatttgggggttagaaatatgagtatagccactatataagtctggggagtggggctagtcacatatgctacaatgtgaatagtagcctgttgtggggaggtccctagtatttggtggcaattgaagccatggatgggaataagatcctccagggagtaagtgtaaacagactggagagaagagaaaaacagaaggttgaggacatagccctggggaccagctgttgtacgtaatgctctggccacactagagtgggtttcatttgccaagattttctcctccccaagctgtccccagacatgggtaatttagaactaatccaagcacatcaagaggctggacaaggttggtttggtcttctaggcaaaggaggattcatctttcacatggtacttgtctgtgtcctcacccttatccctgttagagatcatcacagaatgtagttcgtggtctgcagccagcttccctgggttctccaagcttcacatagtctggtactcagagaattgttctggcacctgaaagatgtcttcacatctctttaagcctgccagagaaggagccccaactataagcatggagctaaatgttttgaaacatctgggctgaatcacttctccatttttcaaatggcctctttagcactggcctagaattgtcccccattcccccaatttacctttccagtcctgatttctagaatcttagtgaaacgtctttctttatccacagttctcaaggcagacttcctggagatgaaagttgaggctacaggtatgcagtccccatccctgattacaaaatcttgttccacataagccttcattacgggatctgatattttgaggactggaataacatgtagatcagaagggtgggaactcacttctacgcctcagttcattactctatcactgcctgacccttaaatttagtgactttcaattccaaggttttgtgtgattttaagtaaccttcctctttcatttctttttctcctagccaaactatggcgcgcttttacagattgcctttgaatcaaatttattaagaatcctaggctgtgacattttgggaaagtacatttacttctctgagcctcagtttcccagtttctaaaatgagaaggttggaaccttctaactctgacacctctcgggcctttaaggaaaccaggaacatgctttctgatgttataacagatgccaagaggctaccttagtgtctgtagatggattcattcctgcagaccaaatcattatttcagtcttacccacctgaaccttcattcttagtcctttatgtttgtccaatgcaaagcactttcacattcattatttcatttgatgcatatcacatgccaggagaagggaggataatatgtgttctaactcaacaaataaaggaactgaagttcagaggggataagtgacttgcaaaggtcacaggagactcagaggtcagggaaattcctttctctatcataggagttctgattgtttgactatcagattgctggcatgatgtgacctgataacacacataaatgagatccaagtatctggagcttggcttttcatgtgctccctaaccttctttttttccctgtcactgccagtcctcagaggtccgtgggtagataagcttctccttatcagcccctatggaggtgaagtccctgttaaaaggaagtttatagttattgtatgaccataaaggcagtgggcatgatgtgggaagaaatctcagaggttctagtatcaggcttctatttctccatgtagattttggggagtttgagttgaggtcaaaggcacaaagtgtccagccctggtcatagcaccatcttaggcctgtttcatgagatttgacttgtaagagcctttgcccagcaatccgctgttgctcagaagatgagctaccaattataggcttagctacctaccaagagaagccccactgatcagtggctgttaagtacttgaccagtcctcgctaattccctactctcttctttctctttcaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagtaaaatactctttttacaatccatataagcccttgattggaagggcttttcaaaatcatttagtctaacaactgcccagtttccagtcgggggaactgaggcagagcaaggtagtgatcacaccagtacaagatctcaggtcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagagtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcaattgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggcaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataagtggcctccatctgcagttttgtcatggaaacaatctttgagcatatcattgaggcatgatggtacatggaaccactcactacctactgcttgtgttgacttctacaaatctaaggaaacctaagtaaagagttcttttgcacctaggagtctccatttacagtctactttgaacaatggcctcgcagttccctcaggcttcacaacatcattttgtgacaggtgacaggcccattttacagataaggaaacttgaggcttagggaactgagaaataatttgtccaagattacacagctaggttaactggaaactacagaggccttcccatttccatttctaatacaattcacagcccccagtagtaaagaaaagaaatccctagggtaaatggagaagattcttagaaataggaatgataaacatctttaagtcttgctactcaaaatgtggttcgtcatcagccttggcataagcattagctgggagcctactggaaatgcagattctcggaacccactccagcatgtggaatcagaatctgtactttcacaagatccccaagagactcctatgcacattaaagtatgacaagcactgatatgaggtatttgagacagcaaagcagcttgaggaaggagtccctttggtgagacaaagaccaaaagtggtggataaggatgatctggtatgttgggagtgggtacaaagattaagtcatagttgcctgcttttttgcattcctttatacttgtgctttgatgacaaagtttctccacctcaaagaatagtgaaaccagcctggggaataagaagagtgaaaagtacttggctttcaaatctctgagcagtagaagcagtggaaagacaacatgaggccatgggaagagctcctttcaggagccctcatggtccagaatcagcgctatcattgcctccccttaatgttgagcaaatccctctccctctctaggcctcaaattctctgcctttaaaccaggtactctcaaaggatcttttcagctttgatattctgttattttgtgatgttaattataccacagcctacattgtaatgaaaacatgggcaactccactggcctttttctggccctagtttcacatattcagtttacataagaaggggtaattcaggaggaaagttcacagtcatggcaaagcaacatgaatggaaatcacagggaactagaaggggcatgatctaggtagccagcttgaaattggccagtattttaattaaagtataacaaggcatccaaactgctttgaacaagctgctgcttcatatcacacgctgatgaatcaatttatgtattctaaataagctttactttgaacgattcatgaattcctctgacttgggtcttttgagggggcaaaagggacttacaaaacagggaatactaccactccctgcatctgccactcatcttcaggtgattctgatgtcc

SEQ ID NO: 17038 - DNA, 8658 bp, Human
aatgtgccaatgtacaaatgtactgcatttcttcacatctttcagacttcactttggctagtgtaagatagatcattcatcagctttagtgctgtatacaggactgactaatgaagaaattgtgacagcatggagatagaagaaaaaggaaaatcaatataattttagaactggaatgtgactaagatcgttaaatctaaccttttgaacttaggatgagacaaggttctactctatattgtcccagctctgagcttaaaactgaggggaaaaaaaagatatcactgagtaatggtagaagttcaccagtaactatcagtcatgctagctccccctaattgttttctgtctctagatgtttatgcctaagacttcgcatgttggggttgagaccttaaaagtgagaaaatctatatacttctcttttgtcttaaaattgtgtgcaaattctgcaatacatcttagatttaatctttaaaaaccttttctgctgggcatgatggctcacgcgggtaacccagcattttgggaggctgacgtgggtggatcacttgaggtcaagagtttgataccagcctggccaacacggtgaaaccccgtctctactaaaaatacaaaaattagcgggcatggtagtgtgtacacctgtagtcccagctactcaggaggctgaggcacgagtcatttgaacccaggaggcagaggttgcagtgagccgagattgtgccattcagcctgggtgacagaggctgaacaacaaaaaaaagggtgaaaaaaaacaaaaaaaaaaacccaaaaccttttctgacctaaccttccactaaaatagctagatatagatcttcagctggagaaacccaaggcctgaaaggcttggtgtctttcctggattagtagtgtagcagtatagcatatgaccctagaattaaggagccccaaatttgcatctggattttcagattctggaagaagaacctggactcttctagtcatgtgctcttggacaagttattcaacctttctgagcctcagctttctcctctctacaatgagataattacagtacttttagaattaaaagatagtttaggggagtgagagatcacctccaaccctccctcccctttgctcttatgtgggctctttggttgaatctaggaaccaaattgacacatggcagattaacaagagaaaagcatactaattttactagttttacatgtacatggggatccgcacaaaagagtgaagtggccaatgtaagatgcctttatactttttacacgaactacaaatcagaagaaaggggatctggctaggggcagtaaatttctcgcggagtcattaggagaaaagtgtgtgtgttggggtgtaaacttagtggaagataacggttacttcggaaagtatattcaggtccaaagcagcccccagtttcgtctctggtgataggtgctattttctccctctggtaagggacgggtactccagaggaatcctggaggaagctttatggcttgctgcatgcaggaagagataggtcatcaaaccttttctgaaactacaatttctccaatattttcaactcgaaataatcaatgtaccaattccatatatttttgggatggcacatccatcagtccttcaatagaaagtaagacgatgcccttaaaacatttagcttcctgcctggcacaaagagctgaattaatactgtccacgctcccatagctattaacagcaaataacagaacccagctttaagccttggtctcctaattcctgacctgtgttcttcccatcacatcacaaccaatacttcttagaatgtagcacgcaaaatgccccgcctactccattggcctcaccctggccgagaggtgcttacgcaggtgctgaacggcagtcgtcagaactgcgcctgcgcaagcggcctttctctgttcgcgatgtgacgtaacgcgcctgcggactgggcccagcttgtcctctatgacttacccagaaggcaacgcttctctttctggtcaaaatggctggtaagcaggccggtaagtaactgggggtcttcttggccggcatcgtcgcgcttcaccgtttatttttgctgcagcttgctccgttttctctcttctttgtaagtggccaagtttgtcgcggaagggaaattggctgcttcagtccagtgaaaaggatgtgcttccccactcgtttgctgtccccagggcgggcttgcctgtatagggttgggatgttaacccgctgtttgtgaaggtgcccgcggtggctctgacagccctggagttccagctgcccgtgctcggaagtccttccccttggccttagaaaagttaaagggcacaagaggataactagtggatgactttcaacccgaatgagctcagtgctttctatgacccaagtgctctatcgtgtgcattggccctataaattttcttgccattgcgacgagggagatattaatttcccttttacgctgataagataactgaggcaaagtgacccaaggaagtagaattggaaatatcattgcacccctcgcgcttctcaaactgcgaatcagagacagttgagcaagggatacgagcgacgcttcaggttgaccttggattatctagagcgtcagcttgatcagtaggtttggagaaatttgaatttattgtaggttctttttttcttttttctttctttttttttttttttgctaatctctgccctctggcggtacaagttggagtagccgttttgtttgtttgtttgttttgtctttgagacggagtcttgctttgtcgcccaggctggagtgcaatggcacaatctcgtctcactgcaatgcaaccaagttggagtagcttaaaaaatgttgatccttttctccccgcccccagcaattgtgaagctgttaggaaacatcaggttgccagaaacatccgttaacctaattgacattgagctttttgggggtgggggagactttttaaataattattttattaatttggcagatattgaaggagtcttactaaattcaagacactgcttctgtgcgtgtttgggaactacatagaccagatctcaactcccattagctaactctgaccttgggtgggatcacttctgtaagccagcttccccttctgtagtaacagacatgtaaataaatcagctaatgttggtaaagcaaataggaaagtgtttggtgcacaataagtgcttagtgaatattattatagtcactgataggtggttgaatataatctgtcttccacaagtatgtttgtagattgttgactgatacttgtttttctagcagcagttttatacatgactcttaatttccaaggagatttgctaaagccacgtaatctgtagtgcactgagtttgcaagcaaggagagttgagtgaaaggagagtttgctttccttccttggtaagggctaaccctagacaaaattttaaaagagaatacaaacctgttctacctctccttttgtaaaatgtctctcctaaaatgtcagatacggtcctgctgtacttggaccctgctgggttacttcatcaggctcagccctgttccccaaacagttttaaaattacctatttctcatcctttttcaatatccattcccttggggggaacttagttgcttaggaggaggtaaatggacttcttttacgaatccatattaatgtttaaatgactaatggtatcaaaatcctccccaaaatacatacatttttaaagaatgtggccaaatgaaataactgtaatatcgagtaaaaattttagaggatgagggtcatttagacctgccagtctatgctgaaatctcactgtcttttccctacaactccagctctcttgaaatgaaaagtttacaattatttcctgtgatctatttatgaaactacaaatgatggaaatttccaagtccttttcctatctcccaccccttcatttctgaaggtaacagggcaggcataagggcacacgatgtacctatggatcttttgtacattcagtgtttgagtttacccttttctttcatgacttgccaccattttcctgcaaccacttttgctcataaataaaataagcactttttatcaacattttatagagtataaacttttttcttttaaatctaattcttttgattaaattcttgctgtatatactatatacttttaaaaggaaatttatttctatgtttgcattcatcagcaagataactgagtactggttgcttgcctatcaatgtgttcatatagtataattaaattgtagcaattaacagtgtgacaattatcagtttcagcatcaggcaagtggctggatggtattcgaaaatggtattacaatgctgcaggattcaataaactgggtaagcagctgtgctgtttaatgttttttgttgttgttgttgtttctttgtttttttttttgtttttctgagagtattgcttttgcaagtgttactgtggttccaaaaaccatttcagttcttgtatacatcagaagattttaaaattaaatcacattatgttaaatccagttcctttttaaagtttttttgagagaagagggatgaaagcctctaaaatgttcgacttggtaatgatttaagtagtaagacattttccttctacaccccctttcccaactcttccacttaaaattttatttatttatttatttatttatttgagacagagtcttgctctgtcaccaggctggagtgcagtggcgcaatcacggttcactgcaacctccgcctcccgagttcaagtgattctcctgcctcagcctcctgagtagctgggattacaggcgtgtgccaccacgcctggctaattttttttgtatgtagtagagacggggtttcaccatattaggctggtcgcaaactcctgacctcaggtgatccacctgcctcggcctcccaaagtgctgggattataggtgtgcactactgcgcccggccttccacttaaaattttaatttaaattatataaacattgaaagtagagagtttttgaatattaaaattttatcacgtccatgcaatcatatgattcctaagcttttttagaactttgtaatttaccatgaacttcatcttttactattgaagcttgaagaaagtgtaagcaaaagtcactgttccttagtatactatcattttaagattctttaataccttgatctcagatttaaactatgagaaaaaagagatgtggtttattaatgtgtgtttaaaaacaaagtaaacatttaaaatattttgtaaatggtttagataaaatatgaattttgtggcattggattttaagaggctcatatattgtttccatagtctagttcaagaagtaacccattatatcaagtaataactcattacttttaatggcaaaactgcaattacttttgcaccaacctataatgtatgaaatgcattgaatttccattgaacctagtgatttgaattcgatagttcaccaaaagttgtaagttataagtcataaaggtattttactaatttaaaaaaaccgcgatttttgagatgcatgtgcaatctaactttgtcatctatcatagggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtagcacagctttatctacctgacagtgttgctcattaaggatggagttttagaaacaagagaaacatgttcatttgcatagtgttagagttctctgagtcatgtcaaataaatatgtgaggttaataaagcaaatgttatttccgttttagaagaaaaccacattgagtcttacgtgtgaaatgattcttctgaaattactaagcaagtctctaatatagagagccaggactaaaatccaggtctgttgcctcccaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagtaattgcttttttcttgttattgaagacctgttgagtgtttgggatatatcagtacgtgatggtaacatataatatttcattcattctttaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatactgtccccatatcccagtgacttttccactttggaaatgattgttatgaagtttaagggttggatactagtcagttaaaagttttaagattatagggtaatttttaaaaatataaattagaatcattggcaaggcatggtggctcatgcctgtaatcccagcactttgggaggccgaggcgggcgggtcacctgaagtcaggaatttgagaccagcctggccaacatggtgaaaccctgtctctactaaaaatacaaaaaattagctaggcgtgatggtaggcacctgtaatcccagctactcgggaggctgagggaggagaattgcttgaccccaggaggtggaggttgcagtgagcctagatcacaccactgcacttcagcctgagcgacattgactgtctcaaaaaaaaaattaggattattcaatgttgtcatcatttccactcctaaattctgaaatgctttctttggtagaggtgagagtgtggagccacagctagtagagaaggaacagtaggacctgcagcctccctggttttccaggacaagtcattgctgtgtgtggcaggaatgccttacctcaaataacaaaacagtgtgaaaaatgaatttgtgttacatttaaagtttgtaaagcaatgagaaatgtgtgtatcataaagagcatctttaaatttttgctaaaatattagcctcttaaattctctaggaaccccctcccccgcttttttttttcctttcgctggtcgttatttttctaaacctatcctgaaatcatgtcaattttcttttgtatggttgaagacaactagatcacttgataatggttttgctcaggtcacattgtgacaaggttttaatgtagtcctactttgcagaaggaggccaagaagatgggctgtctagaaccccctttaaaagcatttgtctattcagaaaattttcctgagtagatctctgcaaaggctcttttaatagtgatttcaagatcacgtttgcaggactctggtctattcgttcagacgtctactgtgcacaattacaaggagactacaactgaggcatctcaaagagcactgtcaaggtgtgtagggagccgggtgggtggagggaggctgggctctgaccctagaaaccatgcttatgaatgctgttaatgtttaaagcaagcctaagggcactgctgaaggacaggggaacaaatagaactgaccaagactgaggtataacaggaacccccaggctatccacctgctcaaggtaaagtgtggtattacataaggcaacctctgattttgtaagagttcttcctaaagccaaagtgtatgcctattctatgtttccagattacttcattcttctaaatgagaacaagtgtgcaaaagttctttgaacactagatcaatgttttgtgttcattataaattatggttatcgtcctgcttgttatgaagactaagaaagtagatctagtatttggctcacacaggtgaatgggtgagaatttgttaatccatcagtgaagtcctttcatttgaaagagagggcctttctattatcaaaagccgtcctgtgtggaaaatcaccatgagagtgc

SEQ ID NO: 17039 - DNA, 5498 bp, Human
gggaaggcgctcccgggctttcgcccgctgggggactggtgtctggggctggggcgctggagaacagggaggaagggcaccaaggacagcctgtgggtctacattccacccagacgtccccaaacccagctcgcagaggcggggaggaggacggatgaaactgcggggagaggatggaggatggcgagctagagggaatctgccgggtgacctcgcggcgggctgggtgcggggcaccggaggagaaggaagccgcagtgccgcaggcggggactgggtggaaggcgggcggacgggggaggggagagctggaaaaggatgagagagggggaagggggactcatttgggaaaggagaggattggaatacggaaatggattaaggatgaggcccgccgggggcttgagagggaggaagagcagaccttctctgggtctggagccgcctgaggacacagaccagaggaaatgaatacagactgcacctccccagccgctctccacccctcccctggctcttctaccctctccagccccagacccatttcttccctttcttgctctggccattgctcccccttcccctcctagatcccaagcccgcacaacatctcaaacaagagtcctcgattcaaaagccagatgccgaccccccttcctcctggatctggctcagggcagcagctccaccccgggacagagagagcattgattgtagctgcagccgccgcgggatcctagcctcacccgtcaaggggctgagcgccagggaccctgaactcgtctagtggtgcgccctgcgcacccgggcgcactcaaccgaggcaatgccctgcgcgctctcgcgggtgcacgccccttctgtggcctctcctgggcgagcactgctctgcagataggctagactaccggctccgcgtcgcctcgccaagggttggttcagccaaggctgcaaaaaacaaaaaaagaccaggcagacagcctatccagggtggctattgaaactgggctggaaaactgcagtcccaggaactccagagagctggacattgggaagcatccttggctcacatacaatcggagatcactatgtctttctctcctccaggaacacgattagcttgtgtcctatccagataggaatagatgctccctatctgggagcatccttagctatggtgaatggtatctagccatccactggggatggcgagtgacttagggatttgtgtctcacgtatatgaagcagtcatcgccagatgttggttgtttttcttaacccccatcataacccggtgggtatgtaagattcagagagattcattcattcattcacaataaatatctttggagtgtatgctatatgccagtaatctgcaaacggaaacggttttgagcattggggattttcttctgaacaggaaatgggaagtccctaaatggggagtctttgtttaacagatacagagttttactttgaaagacaaaaagagttccggagatgggctgcatagcaacgtgaatgtatccagcactgctgaatatactgaatttaagtactgaatttaaatggttaaaatagtaattattatgctttttgtattttaccacgattaaattttttttttaaatacgaagcctcagccctcataggtcttatattaccatacactatgttaatgtaagaagaggagaaagagtggtaaagttacttaaagtcacccagctagtaagtgctccatggccaagcgcagaaacacaccgtgactgggcttgttctccctccttccttgctttccctgagcaggaaagagccagtggcagtatcatgttcagtgagatgcagggacgagagggggaatggagagagggacttagatgactgccatagccactatgccatgttcccagggacccccagccctggtggtaagtgtggcacagcttggctgattcccatcctgttcccaccccagatccaggactgagatcccagaaccatgaacctggccatcagcatcgctctcctgctaacaggtacccggcatggggcaggactggggctccaggcgccctggcttccttccctccagagaagcagcttctccctcacagtctcagaaaagcgcaggtgacaaagagagggctctttttcatcctgaagtcagccaatccaccgcgctgatattctgacggcctgaggtggtttttgaaaacacagtttgctgagccctccttcacactattgaactagaatccccaactgagaacccggaaccagcatcaactccctaagatctcctgtccttgaaacacattgataggatccaaggctcaagcagagtggggagggaggctggggtctgcaaaggagaagtgggatccctggggtggggaaaggcactcagagagcagaccccggtcccctccctagccaggcccatctctccacttcaggtgggtgggaggcccctgtgccgcaggcccctccagtttgaaggaggcactgctggtgccagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagaggtgagacaagcccctaacaaggtcaagtgagctgggagagccaggctcggggacagcaggcagttcccttggctggactagagaggagaatagccccataacgctctcaccctctcccaactgctgcctggtcaactggggaaccattgccttcggtgtgaatggggtgaagagctcagggccagacaggcagagcagtgtggttccaccagaactgtgggcaaggcctttggcctccctaatcttccttctcccagcgggaaaacagggatgacaccacctccctcagccagttttcttgtcatgatgtttagtaaggttttcataagatgatatgtgtgcaagagatcagtaatctgcaaatgggaaagatggctggttctgtgagaccgggctgttcctggtcccagctaagacattgcagtacccacctcccaaagggagtacacccttgctttgggcctgtgcctgcctgagtcctgatccgtcttccttcctaccctgcccccggcccccttctctttctgcagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttctcagctctggtagttcttcagaaatgtaccctccaggcacatccactattgcgagggtgagcacgaagggtgggagatgcccatgtcctcaaggcatcacttcctaaatccaaaagcatcggcaggagaaaggactggggacaaatactgtcccttcgggagtagggagggaacactgaggcccatccctggctccttccctaaaagtagagtaaaatggaagcgagcatcctgggattgggggcaagagggggaccgcagggtagctgtgggttccaactgctgtcagagtcagagaggcagccccaagccagcctccctgctttgccagggaatttgggggaggaaggtgacagctgcccagaggctgactcatctgatatttagcactgggtaggatgattgtttctgagc

SEQ ID NO: 17040 - DNA, 27617 bp, Human
agaagtcactcaatgcctgctttcttgatagatttggaagctagacttaggaacccagcctacctctatcctactgttcattgattcatttaacttacaaatattgaccaactaccaagtaccaccatcttaagcatcaacgtttgcatataatggtaggtatttttagtgagcactaactcggtactaggcactctactaagcactttcattattttcctatgcgctggatactattattatccctgttttacgtatgaggaaattgagacagattaaataacttgtccaggaattcacacacagacagtttaaatcttaacccctgataacatgatgaagtatttgtttcttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgctcgtctcggcctcccaaagtgctgggattacaggcgtgagccaccgcgcccggccgaagtatttgtttctaacaagagcattctggacattaaagggccttagagtatgagagaaaaaagccagaaaaaaaaaaggaatagtaataataattttttaaaaagtagaaataaaaaggtaaggagttaacatccattagattccattttctattcaaatatgtatatttacatacagtactgctgaattgactcacagttcttaggtcctatagaggagtgcagtgaaaaggaagacaatttacacagtacagagctgaacataggacttacaaacaaaaaaaaagtcaaggaatacaaagtagctttcccaggtgtaaagtaccgggtctagaattctatgaggctagggagaagataaacgacaaaagctataagagatcagaatgaaaagagatccacaagcctaagaagcccaggcccttgaggagaaccatgaatttgagcaggatttcactaattcctttaaaaagtagccattgcctcaaagtacgactccatcagcataggcaggaaagtgggagtgaggaaaggcttagagttttccagcctggctggggtcagacaatttgcctggggaaatagtgggagctgaggttgaaaagaccgattggcttcacgtttgtggcaggccttgtccaaaaagcaataggaagtcgttgaaaggttttgtgcaggggagcgacaggattaaggcactacttagtaggaagtcatatcaaaagcagcaacctgacaaatggcaaatacgacagaaggaaaaaaaataacaggaattttcttcacaatgactcgactttgaggtaataaatgcctgagccacattggaagcaggggtctcagaaggaaggcgcagatgggaaaggcttttctgggcggtggcgtttcaatgcaaggagggcgcttgaatcactgacagacttcaagttaagggagttttcgtggctgaggttagtaagtcacacgcacagctctccaaaggcatgtatggggaacgccagccttggctaaaagactgattcaagttatgtccgtcaccctgagcaaccaaaaccacccactacagggcaggtgaccccacaaagcaaaccaagccatctggtccacgctccccacctcccggagggagatggaaaagtttcgggagtagtccccggccaatcggaaagacattttttcattcctcaaccactactctcaggtgctccagggagggaggatgacttcctgacggtcctcctgccgctcctccctcgggccaattatgaaactctgggcactcttgacctcaccccgttagggccgggaggggctccctagtataaagttcgcagcaccagacagttgagctcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtaagttctccccctctggcttccggccgccccaaagaggagacaaataaggaaggctcctgtgcatttgtcattcgacaagtacggagttgtctccaggttcaagtgtgctctatttaaaattacgtcttgttttgtgagtctgtcttccgctatggtgggactggggtgggggggactggggatcgatgttaaaatgctttttattggtgaattaattattggcatatatgttatgcatggattgaaatatctccttattaaacaaaataaaaagttgttgaaaaagcttttttttttttttttgaaaagttgccagtcctagaaatctaaaggcctggaacgcactgttaacatttcatgtcttgttcctttttgttggagagtggggaatagaaactagcgtaagaaattttttggaggggggaaaaagcttttctcctctgtcttgcgctcagttttctaaaacctagcctggtttagctttcccggaggagctggtatgcgccagtgccagttggctgagctccagacacaagagaaataaaacactggtcgagggtatctggagcagaagggccctgggcaggtcctggcgctccccaccgcccttcgcccctacacctgctgcttgcgtttttccctgcagcctcccaagcagcctctggagcaagcgttctgcacttgctgctaattgcactccatagcctgtgatcgctgagggtatttaaatgccagtcttcctatttgagatgatttagttcaaggggaaaatttttctaaatagcctttctgttaaaaaaaaattacttctttccaattccttaaacttcagtttaaggaatttgaaagagtttgaagtcgtatatgaatatcttaataaaaaaataaaagttaccaccagtctcatattctccctggagttggaatgaggctgattccccagacactctaactctacctgtgaaggatgtgactgttaaattattattttggcacaccttatctcaggggttgagagacctaatgaaatgcatactatgcataattgaaacttacaagtctaagtccaggaacacaagtggaaactagatatgtggtttctgccaaaactgagctaagaaagacttgctagaagattctcagtaaacaatgtggctttgctgtctttgttttgaaaagaattaaattagaaaggtgacagtcttcctagagttagaaattaacctcgaggtcagaataacttagcacttattattttccccacatgtaaggttgcatctgaacaatgcacatgtctgttctgggtgtttcattgaatattctaatttgagacagcaagagcctgtgaataacctggttactacccactagtgtgtgtgttgtgtgtgtgtttgttgtcatgaaagtgcttacctccttcattgcattacttaattatagttcatctatttcgtcagctgccaagcccatttccaaatgagttaggtcagtttctgttttcccagtttgtttggatatttctctgccactaggaaagttcctgtttcaagttctgtattatatctctaaactctattcagttatgcagagcccatagccttattttggcaagaccacctgttatttctgaaattgccttctttcccccaaacaaaatatttcctaaaaatacttttcccaaatcttgtccttcccccagcaaaaaagagcgagacatttattttaaattttagcatacatgttataactgctttatgtagttatgactagggaataaagttccagcctccacccttaacacatacagatttaaattgctatgcacaatcatttggttacttttaaattttacacttgtttaatattgaggctcttgttttataaattggggaactgtgacccaagttcacatagaaaaatagtgacaaagtgagagtccacacttgggcttgctagcatttttggcctactgaacattaagtagaagagttgaaataccggataacatttttttaaataatctataattttagagcagaattttgtcttttttatcttgtgatttttctaaagagaggaggataaatttttatgttgaattctgcagttatgttcaggggctttctatttaacatcaaacatttttattcatgcctacatgggtttttgaatatgttcctgaatgacatctccaagataatttagtcgtacttcatcaatgagagagaattaagcagaagaaatattcttttttgaaaatatgaggagcataaatctcaatgagacaataggcttgtctttgatcatttctgttgactctgagagtttatgagttacctgagtcttggcacaacctgagatgacaaatcttgtcagaaaacgtgatgacaggcctttcctgtctggattttgaccaggtaccctcaccaccttctgcacagtcttgccatgtgagcagcttgggtaattggggtgtctgattcagcactaagacccaaatccaggagttgagaagaaaactaacagttactaaatgcctactgtgtggcagccatgttgtgtattaggtgctttaaatacatcatcacctctacttcttaaaataactgtgtgaggtagatttgattagcccagtgaagtcaagtaccttacaaagactcagagatagtaaatggccaggtcactctgtgataatgaggaaagagccaatgagattcagggttagcaggagcataataaacatagcagattctaatagagaagttccagagtagctggggctgctccagggttcagaccctctcataggcacagcacatgtacaaatggactttctgactctgtgcaaaatcaggcaaataaaaggtgactattctcttaagctgtgctaaaatatgttgaatttttacttaatgttcataatttctaatcaacacagttcccctaagatatgatttttattatgaagcagtcattgaagtcagttgactggggcccttatttttatattttccaaggtttacattaagtaaagcaataaagagggtaacttatgtctgttttattccttgtattctttgtatattattgtgaattggatatagcattgataagggatcaacttgggatctatagcccattcctgttaactgtgagaacgtaaatgtatttccttggtttaaaaaaaataacaatactcatataatcacttcggagaaactgaatttgaatgttttctgtctatttttgcaaaagaatctcccatttcctggttaatgttcacgtgaaagatgcaaatgtcaagtaagaaatcctcttcaaagagaatgtaaattaaggtggggtttcctcatctgtcaatctttactttgagtgtaggcctgtacaaatcatctaattaatatggctgtaactgctgctgggaacattccatcgggagacaatgagaacacttcccagtggtgtaatagaagagatcctcagggaggagtagtctgacagccattgccttgacatggcaattctggaacctttgaaaaaatgaagtaatgccacatactcagcgtcttctggagatgcagtttacctaagactgggtgtttagttatagggcacataaaggttgagtggccttctaggttaaagtaatgatttaacttactaggatactatttataatactcaggatgatttgataattgtccagaaaaaaatggattttttaatatatctcataagactcttaatatataggtttatcctccatctccttttttaaaaatttcagtagcatttggggtacaattggttttttgttacgtgggtgaattctatagtggtgaattgtgagattttagtgcgcctatcacctgagtagtgtacattgtacctaatgtgtagttttttttcaatccctagcccaccttccacccttccccttctgagtctctaaagtccattatatcactctgtatgcctttgtgtactcatagtacatagtacatagtacatagtactcatagtacacatagtacatgtataagtgagaacatatggttttttggttttccactcctgtgttacttcacttggaataatggcctccagctccatccaatttgctgcgaaagacattatttcattccttttaatggctgagtagtattccatggatatatggatgtattccatggagatatatgtaatattcagaaagaaaagtattaaacattaatcttttaggttaaaaattctcaattttaaatttgaggcatgaaagtgattgatacgtgcacacacacacacatctttatatatgtaagttttatagtcttgaactaagaggcatagtgtatagtgtataaaatacagatttcatgcaccagttttttctttcatactttcagaaagagtgatttatctctgagcctcagttttctcatccgaaaaaaaaaaggttgtccacaataaccttgtcaggtaattgtatgtagatttaatggataagatgatacatgaattcatagaaagcacttttaaaattagagctgtcatcataaaaatggtttcttacaaaaaaaaaagcctcatttagttcttaggatgcctttttagcccagaaagttgttattgttcccgttttacaaatgaggaaacaggagtacacagcatgtaaggctttgggtttgaatacgcttgtatcctttactgtcaatgccctcaagtcactctttacttttggtgaaagtactcatcctttaagactgaaaaaggagccacttccttaggcacttctctgataagccctgaccctcctccattgcacctttcccattccttttgtcctatggccctgtcacaccacacatcacactgtaagtgtgtgtataactctatccctccttgctggtgctatagtcatcttttatcatttctattgtgataggcttatattaaacacaattaatatttgctagatggatgatcacattgatactttatttggagttatcaccactatgttatagactcaattagctgcactttaaaaatgtatttaaaaatattaaaaaagatattttgagaagcaaaatacctagaggttaagtaacagttttggaaaattcaattctgttgttgtttctgatgaagtctaataagttttcttctctctctttcacatttttatctcttattatattattatattattcagtattaactgaagatatttgtgtgtgtgtgtgtgtgagagagagagatagagagagagagacagaaagagaggaagagaggaagagagaggggttactgagctatgatatgactgaataaagtggcagtgatatgactgccagtggcagaaagagaagcattgttttagaaattaaagaaaccttagagaaatctaatccaaacttcatttcaccctctaccccacctcattccttgttctctgttttcagagataaggcagctcagttgcagggaaacaaaataagtatgtgagctagaactggattccatttctcatgagtctaatgcagggtttttcaaccttgtctcagttgacattagggactaaataattctttgttgcagggaggctgtcctatgcattgcagggtgtttagcagcaaccctggtctctacccactagatgtcagtagcatccccagtcgtgacaaccatcatagtctccagacattaccatatggtagcaatggtccccaggagcaattttgccaatgagggatacaattttgccaaccttggttggcaattttgctcctggtttagaaccaataacataaaatatacttttttttaattgctgttacacattgccacccatacttcacagtttggaaaattagtgcttgagttaccaagacaaaattaattttaatgataatctggatacaaatataaagcccattctcatgtttaaaaaatcagcttggcaatatttattgctgattttagcaccgttcacatctaataatgatgagtcttatttacgatggaatcatgaatactgtctctgattattcctttgataaccaccctttacttccttttacaactctactctcttagctctcagcaaacttaattttcttttttctctaatttctttttctcttttctttgccacttctgtctgctctctaccacctgtttctcaaagttctgttattttccagttcatactgttttccttggaacatataaatgtcttccattcctttaaaggcagtatctcctcatatgactttcaaatagacttctcctaatctccaaataaattcttattcctttactgtattcccaacagcctcaaaaatataaataggtaatacctatagataaacattaaactcaaatatgttcactcccttcatgccttcatgcccaaatgccaccacaagcctgctgtcctgcctatgtctcctccttttttaatggcagcattctctgttttttttttttctgactagaaacttggcatcatctataaattctctcctttccttaccacccttaggtgtccaacttctttaagtctatttagggcaggaacaatgtcttttgtaccagttttctttccagtgttttgttcaatatcttgcatgtagacaacgctcaatagatatttattgagtaaacattatttgacaaatgtagttactaaaagcaaggatggggtaagctgccctcctttttgatgattggattgtaactaagcccatcccaccagctatcatgctatggaggcatatgtggctctcactgaagtcaaggtcgccaatgtcaactcaaactatattttcataaactatattatctgaaagtagaattccttagcagcctgcagtgtgtgagttgtattatgtgggttctctgaataaaaagtaattaatttcgagtcttttgaaatcatctttaatggattccctttctcttgttttgtgtgctctcactgattaaaactttatccttgcagattcatgtttggccataggcatctacagagaatacaatatagtcaatatgcttctcaagatgccattaaatatccaggcttcctgccacaatgtggccataatgaaaagaaggcaaattgcagacacttatagtccaaactgttgcgccttcaggagatgtttcttttggaataataatgtaagaataatttaagttggatttatagaagtgagaagcccgatggaagggagtcaaggtagaaaaggttataaaaaagctcttcttatgtaagattgtcttgagaaaaaaatatgtttccaacagaaaatttgaaacaatactctataaatgaagctttggcttttaggggaggcaagtcccacctttagagattttagtcacagagttccaaacactcagattaatttaaattgtacttttttttttttttttttttttgaaacagagtcttgctctgtcaccaggctggagtgcagtggggtgatctcggctcactgcaacctctgcttcccgggttcacgccattctcctgcctcagcctcccgagtagttgggaccacaggcgcccaccaccacatctggctaattttttttttttttttttttttttggtattttggtttcaccatgttggccaggatggtctcgatctcttgacctcatgatccaccagcctcagcctcccaaagtgctgggttgtactctttacataagagttggtatgtattctcctgcattctggaaatacttccgttatgaacaagatatacatctttaaattcatatttagtgcaaaatagataattcccttatattttgactcactgattctttatttgactagctttaagtatagcattgtatgataatatgtaagcgaaatatattagcatttgaagtatgatttagaaatgactacctaaattggaaagtataacttaatgcttatgactagaaacacatggcatattaatatttttgctacttgtcaaggaagattctatggctatttttcaaaactcaaaattaaaataattacttatttttaacctgttatattaaccttgggtttcatatgttttatctcaaattgctatagaccgtttttaccttaggtcttaatgaagtgcagttacaaagctaacattaaaaatatataggaatagaattattactggcagaaggcaaggttagttttctatagatttatatatatgtgtgtatatatgtgagtgtatatatatatttatatataagtaatatatgtatatatgtgttcatatatatttatatataagtaatatttataagtatatatgtatgtatatatataagtatatacgtgtgcgtatatatatctatacacacacacacacacacacacatatatatactctctgaaaagtaggttgctactagaaggtgctgacagtcttttcagtatctgatgtgataatgagttttagagttattttgaccaaggtgaagcaagagcttatcaaatagtggaattaaatttaaaacaaaaagacatccaaaaacagtgaaggcatattcactccttaaaagcacacaagatccaacaagcctattacgttatagacaaattctaaaatcacagactgccatggaagatggtagaaaatgaacagtctgagtaggttggcatgtgaccacagcaaaagtgtgaacaaagaggattttgctatgtgtttgggctggacaaatgctatgattctgcacaagtttgcttttctggtctaaatagcctaaaaggttaaactgggaaaatgagatgcatttcttttattctgtaatctatctgattttaatttggatcatttttattttcttgattgttttccagaatagtcattttaccctaagatttgcaattattttgctgacttggcttggtcatccagtcaccaaatcctagcctcctctgtactggcctccttctggatgagccctcagtgcaatccttaggaagcaaggtaaatccaggcacaatggctcaagcctgtaatcctagcatttttggaggccaacatgggaggatcattgagcccagggattcgaggctgcagtgagcagtgattgcaccactgcactccagtctgggcaaatgagtaagagcctcgaaaaacaaaataaatataaataaaaatgaagcaaggtcaaaataaaccgtatgcaataggaagtacattttctacatctggcattttgtctgactgttgggcaaccacttcttagtgctccagggcccacgacatttactgctattgccattcctatgatggcactcaacctctcccacgcgcggtccccaatattgtgtaagggtgtaggctcggtcctgactcacagggaagaggcgatttgtatcctctgagtcactggcaccacttcctgctggcacatctgagatttcactgaaacataatctgaaaaatgaaggcagagagatatataggtgaggttcacattcctaaaacccatttggaaatttgatagaaacaatgacctctgaatgcatttccatttttgcagctgtattgtaaaagaagcgccaactgccaattttgagtttacagatcatctgtgttatatcacctggcaagaaattcctctgtatcttagttaccaatgccaccagacaagaaatgccaccagatctgtttttttgacatagatactatctaaaatatttagtatcgtagtgaattatttgcttaggaagaatctactgtcaagaatgaaaaagccaaatatagtatttgaggtccaatcatagagaaattatgttcaaacaacactaaggtcatgaaaagcctgacattaaggaaatatatgcatgctttagcatttattccctccctgtatgactcattaaagtaatgactagcgattcttttttttttttttttttttttttttttttgagagggagtcttcctctgtcgcccaggctggagtgcagtggcgcgatctccgctccctgcaagctccgcctcctgggttcaagccattctcctgcctcagccgcctgagtagctgggactacaggcgcccgccaccatgcctggctaatttttttttttttttttgtatttttagtagagacggggttttaccgtgttagccaggatggtctcgatatcctgacctcgtgatccgcacgcctcggcctcccaaagtgctgggattacaggcgtgagccaccgcgcccggcctgaccagcgattcttaaggttaacaggatagtggatgtaatatttctctggagatagattttttattcattggatcgcattcactcttctaccctagtttgcaagtgtttgggagcagacgcatattgcaggaacatttgagaaccactattttaaagcaatagtgctgtgcagatggacatgacttagaattaattttgctgttttcttggccacatccatccatgatggaattgcagttatacactttaatttgaaaggaacatttaaaattatatacgattccacctgtaaaatatcctgctgtaggattaatgcagcaagtctcacagaaactatcctgagcgatggactgtgtccaagggagcgtcacgagtaaggaaagtccagtctttgtggaggcacaccctgggctgaacattctttaattaacaaagacaaacatttcacctgtggcctgaacaactggaacaaagtttccaacggtggaaaaactaacaactactaaaaacctttaaaaaagaagactaacagcaacactccaaagtaagttggattctataatagttgcaggttgcaattggaggcaattccaagcaggaaaggttaggctttagtttatgcaaaggatagagaaactagcttcaaatgtgcatttttttccccctggctagcattttcctggagggagaattggtaatgtctcctccaaagctttcctcagttgaagaaatatgtaggaataggaatgtcaaggatgtaagcacgtgcaactaaaactccaatttgtaccgaggaaactgtattagttaaaggatttcattcttcagtagtgaaagtatggtgaaattattattgggatataaaacaaaattgacttgaatgagaatctagcttatcctccataaaaagcttagtgaaatagttttcaactctgttcaactgacaatgaaatctaggctttagctatttctttgtcattcaacaaaaatatattttttgtagttccacaagagcaattgaagcagcatttatattgtagaaaaagcatggagtggggaggggataattctgaactttaaagacaacagaattttcaaattgttgaagaacaggagacttgatttcaaaagataaatttgtaactcttctcttctgtggtcacaagtgatcttagacaagacatttaatttaaatacactgagggtatttgagactaataactacttcacagaattaagtgtgaaatttgatatatgaagttatacattatgatgctgatgccgatgtgtaatttacttttcagaacccaaaaatatacaatcggcttaacagatacaagccttctctaactgagaaaaaataaaattcttgtattacacgaattaaatctttctttacagtaccaaattacagagatagacaaacttgttataaaccagaagagggcactgtccacatacactgctaaaaccagaggctagaagttgagagtcaaggaacatttatgggctgtgacagccatttcagaaaaaaaaaaaaaaaaacattagtttatttcactgtattctccccaaaaatctataagataggaaaaattaacacccagaaaagtaaattaattttttttcaagatcacgtagctcaagttttcctcacaagactgcctttccaccataatttgtggcctctatgttgggttaaatactctacttcaattacagctatcataatttgttctctgtgatgtccattatactctagtattattgcctatttccaaattctataaagtggcccatttaacaatatgtatccttgggaaaagttatttaaactctttatgccttagttttctctaatggggataataatagtatcttcctcaaattggccctgagaggactaaataatataatacagataaggtgaataggaccatacctggttgtattagtttgttttcacactattataaaggacttccctgagactgggtaatttataaaggaaagaactttaattgactcacagttctatatggctggggaagtctcaggaaacttatcatggccgaaggcgaaggggaagcaagcccctttttcacaaggtggcaggagagagaggcgggaaggaggaacttccaaacacttataaaaccatcagatctcatgagaactcactcactatcctgagaacagcatgcaggaaaccacccccattgattcaatcacctccctccttggacacatggggattacgggtccctctctcaatacatggggattgcaattccagatgagatgtgggtggggacacagagccaaactatatcactggtacatagtacatgttcgagagatggatcgtcctctgtctgaactgtgaaagaaatggaaagttgaatatattttgttgcctttatggaggcattaatcatcctttcataacagttaccacttacttagctacttcaacgaaacaggttgattcaaactcttcctgtgcttacagaaactggattctcagtgtggttcatctggcatgcctattccttctcatattagataggatatattctgattttacctagattacatttacctagctgcctatcagtcaaggagaattttcaggagtaggaagtcattctagttatcacgcaccctaggccaataagcaccggaatccaaacgaaaatgtccaaccgactaaacaaaatcacataggaggtatttattctcaaaagacaacctttagggtgtagaaaaagcaagcttaacacacatgtcattatcccccacggtaggtattattcatttcttcaaacaaaatatgtctaatttttttcaaatctcagttctgaaattcgttattccccaaagcaattgcaagctgaagccattaattaatttagtggagcttaattgctgctactactactactaccaccaccattagtatttactatataacagttacttaaataaattggaaagagtgtttgaagtgcaaatacctaaagcttaaacagaagcagctaaagctcttaactaaacatctgtgaaattacaagggttcttcttatgatgattcctacacaattcagaaagtacttgagtcattcttgatatctatgttccaaaattttatcttttcactgaatacacatgatgaaacagctgattcagactcttcctatgctgatagaaactggattctagggctcagtatggttcatttgggatgcctgttcctcctcatattagacaagatatattctgattttacctagctttcactgtattaattaaaatctatactcatgtgtaatgcaatgcaaagagtaacttaggtacataaatcaataatgaatgtttcttaggttgagtttcttgttgttactgtaagtggaaaccgattttttatttagagcctttttttgtgatggggtctgattaggagcatttctctgaacacatgatggaataaaacagtggaaattctccaactgatgtgcgtcttaagaaatcaaacttcaaaatcaaatctttgaaaatgttactgtgaaatatttagagcaggtcaaatctgtaaccgtgaatgtaatgccaaggcttttatccttccacagaatagctgggggagtttgtattttctgttacatgcctgtttccatgaattattttgttttatggttttgatggaccaaatctgtgaaacaaaacaactctataagtactgcagttatgtagaaatttgatcaagatttctttccttaacacattagttatatattcgatttttcttcataaataggtttccatcttctacaggcagtcctcagtacaactgtgattccatcatgtatcccaggagagtccagtgataactgcacagctttaggtaagcccaagtttgtcaatgtggcatcaagagactacatatttttaaacagaaatataaactcaaagactataagtatgtgataatttttaaaaaaagggtaagaatagctgctatattactttttaaatcaccatataaactaatgttctgaaaaaattatataaaggaataactggtaggagagggaccggataaattatatacacagatttgattgtgaagagatagggaacaacaacaacaaaaaattgcattccctttggccgtctcctggcactttactgcgaaacatcctcagagaccacactgactggattccaggcaaaacagcaaaacaggaaaactttgtacagaataggttctctatctctctctttctacccctctctctctctttgtaagaagaacaaatgatagtcgtttctttctaggcacagtgttcattcagaaaacatttatcgagtatgtagtatgcaccaaacgctgtgctaaggcatacagatacaaagataagtaatacagttttttcccctcgaggactgtggactccagatatggtccaagggggatcagctttatcttcattctgagttattgaatcaagataactgagttattttgaggaagcaggatattttccataacaactttatcttttgtccctcaccatcaggttctctggaggtttggtcagcctcctccgcaggtttggtcagcctcctccgcatcatcttttttttttttccttctttggttatttgggcaagagtattacaatcaaattgctattttaaaagtaattttataagcatctttcacattttggtatctaaagctttctaaagtgaattttacacaaaggctcctattttcattgctgttatttgtctaccagaggcctttctcactcagggtttgtctagtttggattcaggcctcattatcagagatattgggagactggttaatttcattaatggtaacctcagcaacttgaaaacatacaccaaagccagccttactgattaaaaatccactgtagaattaagctcctttgaattaattaatggtatgagcttgcaactgctttggggagtaatagatttcagaaatgttttgggacttgagaaaaattagacaaattttgcttgaagaaataacacccacttggaggataatgacacctgtgtgttaaatttgccttctctacccttacaggttgtcttttgagaatgaaatcctttcatgttatcttcttttgtttagtctgttggacattttcctttggattcaagtgtttattgattggtctagggggtgtgacaactagagtgacttcctacttctcaaaattctccttgactgattggcatctgacttgttgtgtagaagtagttcagtggttactgttatgaaagagtgagaaattcttccatgaaggctgcagaatatattcaactttccacttcttttacagttcagacagaagacaatccacgtgtggctcaagtgtcaataacaaagtgtagctctgacatgaatggctattgtttgcatggacagtgcatctatctggtggacatgagtcaaaactactgcaggtaatatgtcagaaataaacaaacacagtttgtaaaattttgttttatagatttaggggtacaagtgcagatttgctagtggatatattcagtagtggtgaagtctgagcttttagagtacctacccctcaaatagtgtgcatggaacccattaggtaatttttcatcccttaacccccccaaaactcttctaccttttgaagtctccagagtctattactccactctctatgacaatgtgtacacattatttagctcccacttgtgagaacatgtgataaacaaatgcagttttactctttgtatttctatttttatattttgaaattaccctatatttccatgggctgttaaatgcagtatatatattattagaaacttttctgagtttttaaaaattaggtagtaaatagtagcttttaaattgcacacatatgtcagaggtgcagagcagggaggacttctgatgcttctcacacttgccaagatggtgtctctctgctttggatcttttccttcaatttctatatcaggtattgttttaagaattgattccaggccggacgcgttggctcatgcctgtaatcccagcactttgggaggccgaggcgggcggatcacggggtcaggagatcaagaccatcctggcgaacacggtgaaaccccgtctctactaaaaatacaaaaaaaaaaaaaaattagccaggggtagtggcggacgcctgaagtcccagctactcgggaggctgaggcaggagaatggcatgaacccggggggtggagcttgcagtgagcggagatcatgccactgtactccagcctgggcaacacagcgagactccgtctcaaaaaaaaaaaaaaaaaaaaaaaaaagaattgattccaggccaggcgcagtggctcaaccctgtaaccccagcactttgggaggctgaggcgggcagaccacttgaggtcaggagttcctgaccagcctggccaacatggtgaaaccccgcctctactaaaaatacaaaaattagcgaggcgtggtggcgcaagactgtagtctactcaggaggctgagataggagaattgcttgaacctgggaggcggaggttgcagtgagccgagagatcacaccactgctatccagcctgggcgacagaacgagactccatctcaaaaaaaccaaacagacaaacaaacaaaaaaagaattgattccactgatttagacaaaaggaatctcaaacctgtacaacttacaaaacaccactgtggactgtcagccaccatgacagctgaacacaaccgtcattttaatactacaatttagtccaagagctacgtggagcccttttatcattactggtctaactcaatctttgaaatcctctttacaatctttagcaaattttgttgatttcttgcattacagtgtgatgttagtccttataaaactaattcataaccatgatttcctttttaagtaactgatctttctttcttccgtattttccttcaggtgtgaagtgggttatactggtgtccgatgtgaacacttctttttaaccgtccaccaacctttaagcaaagaatatgtggctttgaccgtgattcttattattttgtttcttatcacagtcgtcggttccacatattatttctgcagatggtaagtcagtgtggttttatactctgcttttacaaattacttttacataatgcagacctataaactgggtaaaaatatggataaagtattagagagataagatcaaacctgtacaaatgatatttacaagagttgagaaactattaagtattatgcccaacacctgagtgatgggatcagctgtacccctaatctcagcatcatacaatatatcctgttaagaaacctgcatgtgtacccccgaatctgaaataacttgaaattattttttaaaaatatgtttttgctgcagaacatctggattgaactttattatcagctctgatacttattacctatgtgaccttacataagtcaaattgagagtatcaattcccttctttatcaaatatggacagaaattattatcttacattagttatagggtggttgcttttagtatgtaatatgatatttcatgtgaaagtaaatcataggataggtgctactgttatagttaaccacctgaatttaattcctcaagtcacattttttattttataaaaaacaaccttgtaaattaataaccttagaagcttgggttatcttacagtttaaggcagactggtggaactatttctagacaattataaaaaatggttgttaaaaaatagtttgtgtcagtcccccaaaacagtcgtacctcatcctcatgtgcattattgtcacaagctgaaaacagaaaaatagaaagtgaacattgaaagtatagtttggcatttttttaagggttaggagcaaaggatgggaacagtgtgaattaattaataacagttccctttaaaatgtctccatgaaacatattttgaaacaggtacaaattactcaaggtgaatttacgtttttatttttctgtgaaagtagtgcacttccaattttgaaggtctgaaagtgtgctactttcataatattaaatttattttgtccacatttgattctaagtatccatcaaataataatgccttcctaataagttgccatgacagaactaaatattattaaaactgaaatatgcctgcaaatctttgaccacaatcctttcctttatagatggggcactgaggtttagagaggttcattcaaatatcccagctcatatagttgacaaatgccagagtgaagaacaaattctttctaattcatattcttacagtaaacatagacatgatgtggtttcctcaaagctacatgtcttatttccaaaatagggacaaaataaactcaaaaatattaggaaaatagcttaatgaataaatgaaagaagattctaaattacgataaatctatgaatcctagctatgagaccttggaccttgggcacattatatacaacccatttgtatttcactttcttcatctgtaagatgaggatggtaacagcaaatgtgagagtaaaataaataatgcatgtatagcacttagaaaattgtaggtcaccaaattagtgcctgataaatattatttttattttgattagtgatagcattatatcaatgtgatggaaagagtgtattaatgtagcatgatttgtaaatattcattccttagaagggaggaaggaaaaagaaagagagacagaaaaagaaaacctaaaattcagacttaaatgtggccacacgcctcttggaatttcacaatattcatgatcacgttaaagactttgagaaactctttaagtgtattttatcatttcattccaaaattgtttgactacagcacatcacctcttcatccctctttttttttttttttttaacattgtccaacctaaatctgttcaactttgtcattttggaaacactatgctaatgtgcctttggagtccatatataacacacttgttcctttgctattaactgcagtgctaacagtttcgtttgtgaatatttccaggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcatatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatacagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggtgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcctctcaatcttggtttttcagttgatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttaaagtaacttatttgactatgaatattatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgacaatgcagcctcattctttttttttcttttgcaattttttccccacaatacattaaagggtttaaaagcagtgacagggatataatgtgtgtagatataatgactcaatggtgttaatttgggaaaacattctataaatgtatcacgttttatagccagcatagtgaagaatttcttgtaatagaaggagccacattagttataaaattctaggtgttggtatttaagaatcctaggagttaggattgattgattgattgattgattgattgattttgagatggagtctcactctattgcccaggcaggaatgcagcggcacgatctcggctcaccacaacctccgcctcctgggttcaagcgattctcctgcctcagcctcccgggtagctaggactacagtcacgtgccaccatgcccggctaatttttgtatttttagtagagacagggtttcaccatgttggccagactggtctcaaactcatgaccttgtgatcttcccgcctccgcctcccaaagtgctgggattacaggcatgagccaccatgcccagcctggggttagtattttttaaaataatattttaaagagtattttaaaagagtatttctaaaaagaatagatatcctattgggaagtagcatttgaaaagattcatcagccagaatggtgccttatgattctctcagcctctgcaaagaggcttggctcccctgagcctttagagcagacaagcttgattcttcccacccttcatcacagtgatggatggcttccttggtatacttattcagcagcctacagagtacttgctccattccttagctccttggatccttcattagcttgcagctggggaagggacctatggcttcaaccctttgacagggaggttaagcaattgtcctgggtcacaccactggcaataggtggaggtgtcatgagaattcaggtcttctcactcctaattccactgatgttcgggccatgtcagaggcagaggaagattataaggagttagtctcagatctagtttagagttttcttgggagaaatagaaattcttgtaaaatagaatctttgaattgtcattgaatcattacactgattttgttcaaggtctgagaatccagaagattaaggaagagaactcttagaaacacttttttttctcttggtttccaggatatcacactcatctgcttttctacctgcttctcagtctttagctagatcttcctcaatatttccctattctctaccatggacctatcaaaaatagagtgccccagagctcaatattgtaatttttctctccatatagccactccctacttcatttcatacagtttcatatctttaattgctgtctatatactgatttctcccagtctagatatttgccatgagttccagatatctgtgtccgattacctaacatctccacttacatattcactaggcattcaaaggtgacacgatcaataactaatattcccctataaacgtttcttcaatatagttactatttcaataaaattcaactcaatctttcttttatctcagaccaaaaacctgctatctctctctctgggaattgctaaattactcatcttcaagtgatttcagagagaaataacctaaacttttacaatgatggcagaattggtcattttgaagagattatgcagagggaggaaaaagattccaagaaactggagttaaacagaatatcagagtcttcaaaaggacaaaattataagcactgaatttgactctgatcaattctagaacatatttttccctaaacagtcataaaacatgaaatatatgtgctgttcattaagttccaacatgaattcattaagaaaagacataaaacatggatcacttttaaatatcctgtctggtcacccactaatgctaactatctgtcatacaaaatcaaacacagatactctgctcagtttatctaaatttcagagaaatacttgggaaaa

SEQ ID NO: 17041 - DNA, 21204 bp, Human
aaagctaaggctcttcattagatataggaaaatcaattcaaagtttctattcagtcatgatgaatttgagatttttttaggtttctttgtatttaacaatatattacattataatgttgtggtgaaaactaaatggactaatattattcttttcatttgttaaatgaaaaagtatgcacaaagtatatgtgagagtgacaaaggcctgaatttgtcaattagtaacaattgtattcaacagtaaggattttatgtttgggtaggcctttcccagggacttctacaaggaaaaagctagagttggttactgacttctaataaataatgcctacaatttctaggaagttaaaagttgacataatttatccaagaaagaattattttcttaacttagaatagtttcttttttcttttcagatgtaggtttttctggctttagaaaaaatgcttgtttttcttcaatggaaaataggcacacttgttttatgtctgttcatctgtagtcagaaagacaagtctggtatttcctttcaggactcccttgagtcattaaaaaaaatcttcctatctatctatgtatctatcatccatctagctttgattttttcctcttctgtgctttattagttaattagtacccatttctgaagaagaaataacataagattatagaaaataatttctttcattgtaagactgaatagaaaaaattttctttcattataagactgagtagaaaaaataatactttgttagtctctgtgcctctatgtgccatgaggaaatttgactactggttttgactgactgagttatttaattaagtaaaataactggcttagtactaattattgttctgtagtatcagagaaagttgttcttcctactggttgagctcagtagttcttcatattctgagcaaaagggcagaggtaggatagcttttctgaggtagagataagaaccttgggtagggaaggaagatttatgaaatatttaaaaaattattcttccttcgctttgtttttagacataatgttaaatttattttgaaatttaaagcaacataaaagaacatgtgatttttctacttattgaaagagagaaaggaaaaaaatatgaaacagggatggaaagaatcctatgcctggtgaaggtcaagggttctcataacctacagagaatttggggtcagcctgtcctattgtatattatggcaaagataatcatcatctcatttgggtccattttcctctccatctctgcttaactgaagatcccatgagatatactcacactgaatctaaatagcctatctcagggcttgaatcacatgtgggccacagcaggaatgggaacatggaatttctaagtcctatcttacttgttattgttgctatgtctttttcttagtttgcatctgaggcaacatcagctttttcagacagaatggctttggaatagtaaaaaagacacagaagccctaaaatatgtatgtatgtatatgtgtgtgtgcatgcgtgagtacttgtgtgtaaatttttcattatctataggtaaaagcacacttggaattagcaatagatgcaatttgggacttaactctttcagtatgtcttatttctaagcaaagtatttagtttggttagtaattactaaacactgagaactaaattgcaaacaccaagaactaaaatgttcaagtgggaaattacagttaaataccatggtaatgaataaaaggtacaaatcgtttaaactcttatgtaaaatttgataagatgttttacacaactttaatacattgacaaggtcttgtggagaaaacagttccagatggtaaatatacacaagggatttagtcaaacaattttttggcaagaatattatgaattttgtaatcggttggcagccaatgaaatacaaagatgagtctagttaataatctacaattattggttaaagaagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacgtaagaaatccatttttctattgttcaacttttattctattttcccagtaaaataaagttttagtaaactctgcatctttaaagaattattttggcatttatttctaaaatggcatagtattttgtatttgtgaagtcttacaaggttatcttattaataaaattcaaacatcctaggtaaaaaaaaaaaaaggtcagaattgtttagtgactgtaattttcttttgcgcactaaggaaagtgcaaagtaacttagagtgactgaaacttcacagaatagggttgaagattgaattcataactatcccaaagacctatccattgcactatgctttatttaaaaaccacaaaacctgtgctgttgatctcataaatagaacttgtatttatatttattttcattttagtctgtcttcttggttgctgttgatagacactaaaagagtattagatattatctaagtttgaatataaggctataaatatttaataatttttaaaatagtattcttggtaattgaattattcttctgtttaaaggcagaagaaataattgaacatcatcctgagtttttctgtaggaatcagagcccaatattttgaaacaaatgcataatctaagtcaaatggaaagaaatataaaaagtaacattattacttcttgttttcttcagtatttaacaatccttttttttcttcccttgcccagacaagagtgaggttgctcatcggtttaaagatttgggagaagaaaatttcaaagccttgtaagttaaaatattgatgaatcaaatttaatgtttctaatagtgttgtttattattctaaagtgcttatatttccttgtcatcagggttcagattctaaaacagtgctgcctcgtagagttttctgcgttgaggaagatattctgtatctgggctatccaataaggtagtcactggtcacatggctattgagtacttcaaatatgacaagtgcaactgagaaacaaaaacttaaattgtatttaattgtagttaatttgaatgtatatagtcacatgtggctaatggctactgtattggacagtacagctctggaacttgcttggtggaaaggactttaatataggtttcctttggtggcttacccactaaatcttctttacatagcaagcattcctgtgcttagttgggaatatttaatttttttttttttttaagacagggtctcgctctgtcgcccaggctggagtgcagtggcgcaatctcggctcactgcaaactccgcctcccgggttcacgccattctcctgcctcagcctcccgagtagctgggactacaggcgcccgccatcacgcccggctaatcttttgtatttttagtagagatggggtttcaccgtgtgccaggatggtctcaatctcctgacatcgtgatctgcccacctcggcctcccaaagtgctgggattacaggagtgagccaccgcgcccggcctatttaaatgttttttaatctagtaaaaaatgagaaaattgtttttttaaaagtctacctaatcctacaggctaattaaagacgtgtgtggggatcaggtgcggtggttcacacctgtaatcccagcactttggaaggctgatgcaggaggattgcttgagcccaggagttcaagaccagcctgggcaagtctctttaaaaaaaacaaaacaaacaaacaaaaaaattaggcatggtggcacatgcctgtagtcctagctacttaggaggctgacgtaggaggatcgtttggacctgagaggtcaaggctacagtgagccatgattgtgccactgcactccagcctgggtgacagagtgagactctgtctcaaaaaagaaaaaggaaatctgtggggtttgttttagttttaagtaattctaaggactttaaaaatgcctagtcttgacaattagatctatttggcatacaatttgcttgcttaatctatgtgtgtgcatagatctactgacacacgcatacatataaacattagggaactaccattctctttgcgtaggaagccacatatgcctatctaggcctcagatcatacctgatatgaataggctttctggataatggtgaagaagatgtataaaagatagaacctatacccatacatgatttgttctctagcgtagcaacctgttacatattaaagttttattatactacatttttctacatcctttgtttcagggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttgtaagtacattctaattgtggagattctttcttctgtttgaagtaatcccaagcatttcaaaggaattttttttaagttttctcaattattattaagtgtcctgatttgtaagaaacactaaaaagttgctcatagactgataagccattgtttcttttgtgatagagatgctttagctatgtccacagttttaaaatcatttctttattgagaccaaacacaacagtcatggtgtatttaaatggcaatttgtcatttataaacacctctttttaaaatttgaggtttggtttctttttgtagaggctaatagggatatgatagcatgtatttatttatttatttatcttattttattatagtaagaacccttaacatgagatctaccctgttatatttttaagtgtacaatccattattgttaactacgggtacactgttgtatagcttactcatcttgctgtattaaaactttgtgcccattgattagtaacccctcgtttcgtcctcccccagccactggcaaccagcattatactctttgattctatgagtttgactactttagctaccttatataagtggtattatgtactgtttatctttttatgactgacttatttcccttagcatagtgcattcaaagtccaaccatgttgttgcctattgcagaatttccttcttttcaaggctgaataatattccagtgcatgtgtgtaccacattttctttatccattaatttgttgattgatagacatttaggttggttttctacatcttgactatcatgaatagtgttgcaatgaacacaggagagctactatctcttagagatgatatcatggtttttatcatcagaaaacacccactgatttctatgctaattttgttacctgggtggaataatagtacagctatatattcctcattttagatatctttgtatttctacatacaataaaaaagcagagtacttagtcatgttgaagaactttaaacttttagtatttccagatcaatcttcaaaacaaggacaggtttatctttctctcaccactcaatctatatatacctcttgtgggcaaggccagtttttatcactggagcctttcccctttttattatgtacctctccctcacagcagagtcaggactttaactttacacaatactatggctctacatatgaaatcttaaaaatacataaaaattaataaattctgtctagagtagtatattttccctggggttacagttactttcataataaaaattagagataaggaaaggactcatttattggaaagtgattttaggtaacatttctggaagaaaaatgtctatatcttaatagtcacttaatatatgatggattgtgttactcctcagttttcaatggcatatactaaaacatggccctctaaaaagggggcaaatgaaatgagaaactctctgaatgtttttctcccctaggtgaattcacctgctgcttagaagcttattttctcttgatttctgttataatgattgctcttaccctttagttttaagtttcaaaataggagtcatataactttccttaaagctattgactgtctttttgtcctgttttattcaccatgagttatagtgtgacagttaattcttatgaaaattatatagagatggttaaatcatcagaaactgtaaacctcgattgggaggggaagcggatttttaaatgatttcctgaccaagcttaaccagtatattaaatcctttgtactgttctttggctataaagaaaaaaggtactgtccagcaactgaaacctgctttcttccatttagcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaagtaagtaatcagatgtttatagttcaaaattaaaaagcatggagtaactccataggccaacactctataaaaattaccataacaaaaatattttcaacattaagacttggaagttttgttatgatgattttttaaagaagtagtatttgataccacaaaattctacacagcaaaaaatatgatcaaagatattttgaagtttattgaaacaggatacaatctttctgaaaaatttaagatagacaaattatttaatgtattacgaagatatgtatatatggttgttataattgatttcgttttagtcagcaacattatattgccaaaatttaaccatttatgcacacacacacacacacacacacacttaacccttttttccacatacttaaagaatgacagagacaagaccatcatgtgcaaattgagcttaattggttaattagatatctttggaatttggaggttctggggagaatgtcgattacaattatttctgtaatattgtctgctatagaaaagtgactgtttttctttttcaaaatttagatacttatatgaaattgccagaagacatccttacttttatgccccggaactccttttctttgctaaaaggtataaagctgcttttacagaatgttgccaagctgctgataaagctgcctgcctgttgccaaaggtattatgcaaaagaatagaaaaaaagagttcattatccaacctgattttgtccattttgtggctagatttagggaacctgagtgtctgatacaaactttccgacatggtcaaaaaagccttccttttatctgtcttgaaaatctttcatctttgaaggcctacactctcgtttcttcttttaagatttgccaatgatgatctgtcagaggtaatcactgtgcatgtgtttaaagatttcaccactttttatggtggtgatcactatagtgaaatactgaaacttgtttgtcaaattgcacagcaaggggccacagttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaatttaaaaattagcaaaattgcagcccctgggatattagcgtactctttctctgacttttctcccacttttaaggctctttttcctggcaatgtttccagttggtttctaactacatagggaattccgctgtgaccagaatgatcgaatgatctttccttttcttagagagcaaaatcattattcgctaaagggagtacttgggaatttaggcataaattatgccttcaaaatttaatttggcacagtctcatctgagcttatggaggggtgtttcatgtagaatttttcttctaattttcatcaaattattcctttttgtagctcgatgaacttcgggatgaagggaaggcttcgtctgccaaacagagactcaagtgtgccagtctccaaaaatttggagaaagagctttcaaagcatggtaaatacttttaaacatagttggcatctttataacgatgtaaatgataatgcttcagtgacaaattgtacatttttatgtattttgcaaagtgctgtcaaatacatttctttggttgtctaacaggtagaactctaatagaggtaaaaatcagaatatcaatgacaatttgacattatttttaatcttttcttttctaaatagttgaataatttagaggacgctgtcctttttgtcctaaaaaaagggacagatatttaagttctatttatttataaaatcttggactcttattctaatggttcattatttttatagagctgtaggcatggttctttatttaattttttaaagttatttttaatttttgtggatacagagtaggtatacatatttacggggtatatgagatattttgatataagtatacaacatatataatccctttatttaattttatcttccccccaatgatctaaaactatttgcttgtccttttatgtcttatagttaaattcagtcaccaactaagttgaagttacttcttatttttgcatagctccagctctgatcttcatctcatgtttttgcctgagcctctgttttcatattacttagttggttctgggagcatactttaatagccgagtcaagaaaaatactagctgccccgtcacccacactcctcacctgctagtcaacagcaaatcaacacaacaggaaataaaatgaaaataatagacattatgcatgctctctagaaactgtcaattgaactgtatttgctcatcattcctaccatctacaccaccaaaatcaaccaaatttatgaaaaaaaaacagccccaacataaaattatacacagataaacaggctatgattggttttgggaaagaagtcacctttacctgatttaggcaactgtgaaatgactagagaatgaagaaaattagacgtttacatcttgtcatagagtttgaagatagtgctggatctttctttttataagtaagatcaataaaaactccctcattctgtagaagttatgatttcttttctaagagacctttagaagtcagaaaaaatgtgtttcaattgagaaaaaagataactggagtttgtgtagtacttcccagattataaaatgcttttgtatgtattatctaatttaatcctcaaaacttcttcaatttagcatgttgtcatgacactgcagaggctgaagctcagagacgctgagccctctgctaacaagtcctactgctaacaagtgataaagccagagctggaagtcacatctggactccaaacctgatgcttctcagcctgttgccccttttagagttcctttttaatttctgcttttatgacttgctagatttctacctaccacacacactcttaaatggataattctgccctaaggataagtgattaccatttggttcagaactagaactaatgaattttaaaaattatttctgtatgtccattttgaattttcttatgagaaatagtatttgcctagtgttttcatataaaatatcgcatgataataccattttgattggcgattttctttttagggcagtagctcgcctgagccagagatttcccaaagctgagtttgcagaagtttccaagttagtgacagatcttaccaaagtccacacggaatgctgccatggagatctgcttgaatgtgctgatgacagggtaaagagtcgtcgatatgctttttggtagcttgcatgctcaagttggtagaatggatgcgtttggtatcattggtgatagctgacagtgggttgagattgtcttctgtgctttcgtctgtcctatcttcaatctttccctgcctatggtggtggtacctttctgtttttaacctggctataaattaccagataaacccattcactgatttgtaactcctttcagtcatgctctaactgtaaatgaaggcttaaactgaagtagaacagttacaaggttttacttggcagaacatcttgcaaggtagatgtctaagaagatttttttttctttttttaagacagagtttcgctcttgtttcccaggctggggtgcaatggtgtgatcttggctcagcgcaacctctgcctcctgggttcaagtgattttcatgcctcagcctcccaagtagctgggattacaggcatgcgccaccacacctggctaattttgtatttttagtagaggcggggtttcaccatattgtccagactggtctcgaactcctgacctcaggtgatccacccgccttggcctcccaaagtgctgggattacaggcatgagccaccttgcccagcctaagaagattttttgagggaggtaggtggacttggagaaggtcactacttgaagagatttttggaaatgatgtatttttcttctctatattccttcccttaattaactctgtttgttagatgtgcaaatatttggaatgatatctcttttctcaaaacttataatattttctttctccctttcttcaagattaaacttatgggcaaatactagaatcctaatctctcatggcactttctggaaaatttaaggcggttattttatatatgtaagcagggcctatgactatgatcttgactcatttttcaaaaatcttctatattttatttagttatttggtttcaaaaggcctgcacttaattttgggggattatttggaaaaacagcattgagttttaatgaaaaaaacttaaatgccctaacagtagaaacataaaattaataaataactgagctgagcacctgctactgattagtctattttaattaagtgggaatgtttttgtagtcctatctacatctccaggtttaggagcaaacagagtatgttcatagaaggaatatgtgtatggtcttagaatacaatgaatatgttctgccaacttaataaaggtctgaggagaaagtgtagcaatgtcaattcgtgttgaacaatttccaccaacttacttataggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtaagtagataagaaattattcttttatagctttggcatgacctcacaacttaggaggatagcctaggcttttctgtggagttgctacaatttccctgctgcccagaatgtttcttcatccttccctttcccaggctttaacaatttttgaaatagttaattagttgaatacattgtcataaaataatacatgttcacggcaaagctcaacattccttactccttaggggtatttctgaaaatacgtctagaaacattttgtgtatatataaattatgtatacttcagtcattcattccaagtgtatttcttgaacatctataatatatgtgtgtgactatgtattgcctgtctatctaactaatctaatctaatctagtctatctatctaatctatgcaatgatagcaaagaagtataaaaagaaatatagagtctgacaccaggtgctttatatttggtgaaaagaccagaagttcagtataatggcaatatggtaggcaactcaattacaaaataaatgtttacatattgtcagaagttgtggtgataaactgcatttttgttgttggattatgataatgcactaaataatatttcctaaaattatgtaccctacaagatttcactcatacagagaagaaagagaatattttaagaacatatctctgcccatctatttatcagaatccttttgagatgtagtttaaatcaaacaaaatgttaataaaaataacaagtatcattcatcaaagacttcatatgtgccaagcagtgtgtgctttgtgtagattatgtcatatagttctcataatccaccttccgagacagatactatttattttttgagacagagttttactcttgttgcccaggctggagtgcaatggtgccatctcggctcaccacaacctccgcctcccaggttcaagcgattctcctgcctcagcctcctgggattacaggcatgcaccaccatgcctggctaattttgtatttttagtagagatggggtttcaccatgttggtcagactggtctcaaactcctgacctctggtgatatgcctgcctcagcctcctaaagtgctgggattacaggcatgagccactgtgcccagccgacagatactattattatttccattctaccgagaaggagactaaggctctgatcatttaaataagttgcctaaggtgatgcagtgatataagtagcagagctaggaattgagccttggtaactttaactctggaccccaagtccttagctactaagctttactgcatggggtttagtcaaattaagacttttggaatatgagttacttttgagattagctttgtgatattttttgtgctcatttgtccaacaaagtctattttattttcatcttaattaggtttttgtatgaatatgcaagaaggcatcctgattactctgtcgtgctgctgctgagacttgccaagacatatgaaaccactctagagaagtgctgtgccgctgcagatcctcatgaatgctatgccaaagtggtaggtttattgttggaaaaaaatgtagttctttgactgatgattccaataatgagaaagaaaaataatgcaagaatgtaaaatgatatacagtgcaatttagatcttttcttgagatggtttcaattctggaatcttaaacatgaaagaaaaagtagccttagaatgattaacaaaatttagactagttagaatagaaagatctgaatagagcaatctctaaaaaattttgatctttttttctctttttcacaatcctgagaacaaaaaaaaattaaatttaaatgttaattagaagatatttaacttagatgtaaagtgagttaacctgattccaggattaatcaagtactagaattagtatcttatggcaaattatagaacctatccctttagaatattttcaaatctttttgaggatgtttaggaatagttttacaagaaattaagttaggagaggaaatctgttctggaggatttttagggttcccactagcatatgtaatggtttctgaactattcagaatcagagaaaactcatttttcctgctttcaagaagctactgtatgccaggcaccatgcacaaacaatgaccaacgtaaaatctctcattttggagagcctggaatctaactggaaaggtgaactaataataataatatgtacaatcatagccatcatttattaaacttttattatatgcaaggcactgtttaatttcattagcttacctggtttacagagcagctctatgagatgagtgccatctttgcccctattttagggataaggattctgaaatgtggagatggtaagtaaaattgcacaactgaagaatgagttacatgacttggctcaaatactggtcattgaactccagagcctgaatattcttaaccacttacatgatgcaagctcaccaaataaatagttcgaatgtattgtgacagagcggcattgatattcatctattcatgtggctttgagtaggaagaagaaaggatatcattctgaccagaggggtgaaaaacaacctgcatctgatcctgaggcataatactattaacacaattcttttatgtttcagttcgatgaatttaaacctcttgtggaagagcctcagaatttaatcaaacaaaattgtgagctttttgagcagcttggagagtacaaattccagaatgcgtaagtaatttttattgactgattttttttatcaatttgtaattatttaagacttaatatatgagccacctagcatagaacttttaagaatgaaaatacattgcatatttctaatcactctttgtcaagaaagataggagaggagagataaaatagttgatggggtggagaggtctatatttgaatgtagtctaaaaattgttctcttaagattggaagtatgtaggctgggagggtaaataccaaatcttggtatatcagaactgagcatgtcccttgaaggttaagaaatagttaatgggcaaatagagcatggcaatattttgtagagcagcaagtagtaggccttgaatagatgtcgctcaaaaagtaatatgtaagctgaacacaaaaatgtaacaaatgaatttagatacatatttgaatattaaattcaggttgtttgggagatgcacctagtctttgatggttaaacctttccctccatagaagagacagagacagaatggcttgctggactaatgtcccaattcaatagagtcttatctatgaaggttaaaaacaagaagagacatattatacagtagatatttattgtgtggctcatacacatggtgctcttctgattatggattttagagataataacagtgaacaagacatagtttctttcctcgagtagattaaagtcatacattgacttttaatggtgactggcattcttaatacatgattattatatattaggtaccatgtcagattaattataatactttactacttttaatttaacccttgaactatccctattgagtcagatatatttccttccattttctacttgtatctttcaagtttagcatatgctgatacatatgaagctctctccaggttttattgaaagaagaaattaataaatttattaatgtcactgaattaggcaactcactttcccaagattatgcaagtggtacaggtggaactcaaagccaagtttaactagttgttcaggagaatgttttctaccctccactaacccactactctgcagatggagataatatgatgaatggaacatagcaacatcttagttgattccggccaagtgttctctgttttatctactatgttagacagtttcttgccttgctgaaaacacatgacttctttttttcaggctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatgtgagtctttaaaaaaatataataaattaataatgaaaaaattttacctttagatattgataatgctagctttcataagcagaaggaagtaatgtgtgtgtgtgcatgtttgtgtgcatgtgtgtgtgcatgcatgtgtgtgtatgtgtgatattggcagtcaaggccccgaggatgataattttttttttttttttgagacggagtctcgctttgttgtccaggctggagtgcagtggtgccatctcggctcactgcaacctccgcctcccaggttcaagccattctcctgcctcagcctcccaagtagctgggactacaggtgcatgccaccatgcctggctaattttttgtatttttagtagaaaattttcagcttcacctcttttgaatttctgctctcctgcctgttctttagctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaacgtgaggagtatttcattactgcatgtgtttgtagtcttgatagcaagaactgtcaattcaagctagcaactttttcctgaagtagtgattatatttcttagaggaaagtattggagtgttgcccttattatgctgataagagtacccagaataaaatgaataactttttaaagacaaaatcctctgttataatattgctaaaattattcagagtaatattgtggattaaagccacaatagaataacatgttaggccatattcagtagaaaaagatgaacaattaactgataaatttgtgcacatggcaaattagttaatgggaaccataggagaatttatttctagatgtaaataattattttaagtttgccctatggtggccccacacatgagacaaacccccaagatgtgacttttgagaatgagacttggataaaaaacatgtagaaatgcaagccctgaagctcaactccctattgctatcacaggggttataattgcataaaatttagctatagaaagttgctgtcatctcttgtgggctgtaatcatcgtctaggcttaagagtaatattgcaaaacctgtcatgcccacacaaatctctccctggcattgttgtctttgcagatgtcagtgaaagagaaccagcagctcccatgagtttggatagccttattttctatagcctccccactattagctttgaagggagcaaagtttaagaaccaaatataaagtttctcatctttatagatgagaaaaattttaaataaagtccaagataattaaatttttaaggatcatttttagctctttaatagcaataaaactcaatatgacataatatggcacttccaaaatctgaataatatataattgcaatgacatacttcttttcagagatttactgaaaagaaatttgttgacactacataacgtgatgagtggtttatactgattgtttcagttggtcttcccaccaactccatgaaagtggattttattatcctcatcatgcagatgagaatattgagacttatagcggtatgcctgagccccaaagtactcagagttgcctggctccaagatttataatcttaaatgatgggactaccatccttactctctccatttttctatacgtgagtaatgttttttctgttttttttttttctttttccattcaaactcagtgcacttgttgagctcgtgaaacacaagcccaaggcaacaaaagagcaactgaaagctgttatggatgatttcgcagcttttgtagagaagtgctgcaaggctgacgataaggagacctgctttgccgaggaggtactacagttctcttcattttaatatgtccagtattcatttttgcatgtttggttaggctagggcttagggatttatatatcaaaggaggctttgtacatgtgggacagggatcttattttacaaacaattgtcttacaaaatgaataaaacagcactttgtttttatctcctgctctattgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattgccctttatggcctgacagtaacttttttttattcatttggggacaactatgtccgtgagcttccgtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatatagaccagcaccgaccactattctaaactatttatgtatgtaaatattagcttttaaaattctcaaaatagttgctgagttgggaaccactattatttctattttgtagatgagaaaatgaagataaacatcaaagcatagattaagtaattttccaaagggtcaaaattcaaaattgaaaccaaagtttcagtgttgcccattgtcctgttctgacttatatgatgcggtacacagagccatccaagtaagtgatggctcagcagtggaatactctgggaattaggctgaaccacatgaaagagtgctttatagggcaaaaacagttgaatatcagtgatttcacatggttcaacctaatagttcaactcatcctttccattggagaatatgatggatctaccttctgtgaactttatagtgaagaatctgctattacatttccaatttgtcaacatgctgagctttaataggacttatcttcttatgacaacatttattggtgtgtccccttgcctagcccaacagaagaattcagcagccgtaagtctaggacaggcttaaattgttttcactggtgtaaattgcagaaagatgatctaagtaatttggcatttattttaataggtttgaaaaacacatgccattttacaaataagacttatatttgtccttttgtttttcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaggaatataaaacatggcttttaccttagaaaaaacaattctaaaattcatatggaatcaaaaaagagcctgcagaaccaaagtaagactaagcaaaaagaacaaattacctgatttcaaactacactataaggccatagtcaccgaaacagcaaggtactggtataaaaataggcacacagaccaatggaatagaacagaatagagaacccagaaataaatccacatacttacagctaactgattttagacaaagaaaacaaaaacataaggtggggaaaggacaactttttcaacaaatggtgctaggataattggcaagcacatgtaggagactgaagctagatcctcatctctcaccttatacaaacatcaactcaagatggattaggaacttaaatctaaggcctaaaactataaaaattctagaagataacattgggaaaaacccttctacatataggcttaggcaaggatttcatgaccaagaacccaaaacaaatacaatgaaaacaaagataaattgctgggacttcattaaactaaagagcttttgcatggcatggcaaaagaaacagtcagctgagtaaacagacaacccacagagtgagaaaaaaatcttcacaatctatacttctgacaaaggactaatatccagactctacaatgaactcaaatcaacaagaaaaaaaaatcccatcaaaaagtgggctaaggacatgaatagacaattctcaaaagaaaatatacaaattgaaaacaaacatgaaaaaatgctcatcatcactaataatcatggaaatgcaaatcaaaaccacactgtgataccaccttacctctgcaagaatggccataattaaaaaaataaaaaaatagtagatgttggcatggatgcaatgaacaggaaacacttctacactgatggtgggaatgtaaactggtacaattactatggaaaacagtgtgaagattcctcaaagaactgaaataaaactaccatttgattcaataatcccactactgggtatctatccagaggaaaaaaagtcattatacaaaaaagatacttgcacacgcatgtttatagcagcacaatttgcgattgcaaaaatgtgggaccaacccaaatgcccatcaatcaacgagtggataaagaaacagtatatatcactgtttctttatccactcgttgattgatatacatcatatatattgatatacatgatgatatatatacacatatatatagatatacatatatatatgtagtatttcattgtgtgtatggatatatgtatatatcaatggaatactactcagccataaaaaggaatgaattaatgacatttgcagcgacctggatgagactggagactattattctaagtgaagtaactcaggaatggaaaagcaaacgttatatgttctcacttataagtgggagctaagctatgaggatgcaaaggcataagaatgacacaatggactttggggactcataaaagactacaaacatggtacagtgtatactgctcgggtgatgggttatgggtgatgggtgcaccaaaatctcacagatcaccactaaagaatttactcatgtaactaaacacgacctcttccccaataacctatggaaattaaaaaattttaaaaaataaaatagctagtaatattacaaaacacccatatgatgcaatgttataccatcactcaatagcattttcagggccatttgtcctgtaggtgttaaatttattaaatacttattatatgccaaaatgtaaaacatggcttttctttactattcagacactataagaaattttgaggaacaaaggagatagagatgatgataagtgtggttgacagaattgggggaaaaaagtgatcttagaagaaatttaagacagtttagaataacagcactcaaagagtgtaagaagtttggagaagccttattggaagaggaattagaacacctggagaaacatacag

SEQ ID NO: 17042 - DNA, 12309 bp, Human
gagtcaatttcacaacaccaatagagggaggctcaggccctgccaagagctgacatgataattctaaaggtaatcagagtggatcctctccaagccagaacacagaaagccccactgcgagccttgttgtcacccagtcagccccaggcagggttggcaagctgcagcctaaggcacattgtaacttcctcagctggcttctcaggggacagaatgactaagaacaatagcccagtgaatacttagagcagtgttctcaaggaatcctgcagaggcggcttctgaaaagccaaggtagtatctgcctgctgaaggtgttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactcctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagagacagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtagagaaaaaaaaagtaaaatgtggtcaattcttgctttgttttattctttttagtctttctttgtaaaactgaagtatatgtacccggatctgcttagctttttcaggaatgtgggggaaattaaatagcaatacatttgacttcctggtcacttacacttcaattgtccaaatattaattgagcagctgtactttggagggctcctggctagtaccggataagctaagaaaacaaaaaacaaacaaacaacaaaaaaaccccaatccctgcccacagaattttagaatccaacagcagctatcatataacgaaggtaatgagatactccttaagacctaaagacaggtgaaaaggggataaaaaagaaggtgggggtattaccagcagtggaatctagtgtaaatgtcctaagcaaggtaactgagacttcgggaaactgaacatactgcaataggaggtaattttatgtcctggcatagtgcctatatggggcgcactgagcaggggtcacacactcagatggtggatctcacacttgagagatggagactggaatgaaaaattgcctttaacagttactttgggattgtggaaaaaccagaggggatctttgcctggagcagggattgaaagtggccggtgctcttgtcccagtgcaagtgaagtgaatccagtacacaaactaggtgttttatgagcgtagtccccagggtgtttctgagaaataaaggtgatactcctttaagactggaaactcataagccactgggctaatactctgctatcagctggggagccagaacccattccattaaaaggaattttttttcctttcatgtgtttttgcaaattctaagggagatctagatttttgatggtggtaaaatgaatgaaaataagactggtttggatgaaaggtcagagttggtccttgaaccaaagcctagaaggtttgagttgctttcagctgagaaagacaactccacactcaaaatatgatttaatatggaaaagttatttagagtttctttgtaagctgcgttttgggctgattttattgttccatgtcttagaatgctgtatattctttgttatctcttggacttaaagaaaatcagcagggtggatgatttcttctgtagttgaaataatcttagtaataacaagtattgtttaaagtctcaatgcacaccagggctttgcacactttcaccacattccaccagtcctacaagacaaggcttatcaagctcatttcacagatgtagagcctgaggctcatagagtttattaatgtgcccaagttcacacagctagtaagtgatagggctggaactagactgctggtctgaattcctctagagcccacactgttccactcctcccaaactgaagcttactgtgaattgcttaattcattttcttctacaaccccaaagtgtgtctcaggtaagaaagaagaggtctctgtaccccaaacactggattggaatacataaccagagcaagaagaataccaaaataattgacagatgtgaattaaagagaaaaagaaataatactcggtgacaatatgatcaccgacagaagcaaaattggatagcttcaaaagatcaaaagattacaaaaatcatctggctccacccttttctgtagaaagtaaaacttttagaactaccctttggttggtgaagtgaaggaatagatcagcatgtttttttccctgagagcacaacatctgtcctaggctctccaccttccgtttcagtttcccaacatcacatcacttctgggacagggacctcttctctgcaaggtttgcaaagaggaaactggtcaaatttttgcagggatgtgacatttccctggaagagtttgatcaagagacagaagccaacatgagaaccctcatgaatgaatggtggggagaaaaccactccaaaatgtaagggttcatccagaccctcaggagagtgacctcagttcagtagatagaggagtcccaggttctgatacatgtaaaggcgaggagcataaatgaagactgatggaaggacccagccaaaactgtggggttctatggagtcctttccttattatctgtttttgcaggttgcaaaaggactgtgatcatatgaagatcatccaggagtacaactcgaaattctcagaaaacaggaccttgatgtgagaggagcaggttcaggtaaacaaagggtaagttacaggtttgctcacttgtcaaggtgaggacctgaatgtggactaagggtagctagcacccacatggcctcacaaagtcccctctgctgtcagccctaggaagccttggcggagatggcaggctgaattctgcctggaaagtctcagggagatgactggttccgtctaattggggcagcctcagttttacagagcgaagaggccgagaccctaacaagaatcaatgtagggcttttaagtgttaagaggggactccaccagcagatgagtccccacagaattcaccccgttttgaggcatcagacagagctatctacctaaggtgcctctcatttccgcctggaaggtctcatggaggatggggagcgtggggcctgaagggagtagcttcagttctgcctggagaggaaaccagagtcacggtgaggactctgagagctgatgagaaggcctctgcccaaaacgggactttcacagagccctgccgctgctgtcaggcctgtgaggcccaggcaggggtggcctgtgtggcacgctcagatttccaccttgggggctgagagaggtggggctattgtttgaggctggcggatttgggtcagcaggcggagtcgtcccagactgctagatactaaggtgaggacccctagtggggacgtagggaccagcgacgctagaacagttacgtccagaagcgtaccacccctgccgtcagccaggaggccacgggctgccggatgtggctcatcctgacttccgctttgaaggcgaggaccccagcgagcgtaagggcgcagtgtccgcctggcggatttgggtcagcaggcggaagtcgtcccaggctgctagatactaaggtgaggaaccctagtggggacgtagggaccagcgacactagaacagtgacgtcccgtagcgtcctgcctctgccgtcagccctcagaggccctgggctgccggatgtggctcatcctcatttcccttttgaaggcgaggacccgagcgagcttaaggagtggggtgcagcgtctggtcagccgagggtgaattctcaggactggtcgggagtcaaggtgaggaccctgagtgtaaattgaagagaccacccccacccgtaacaaagaggtcccctctaagtcccgcttctgcatttggtcctgggaggcctcaggtaaccagatgggtagcaccctgactgtctcttcagcgactcagggagacgaaggctttggcctaagccttatagactcaggtcaatagagggaggagtcctaaaccctactacccgtaatcccagaactctgggaggccgaggcaggcggatcacgaggtcaggatatcaagaccatcctggctaacacggtgaaaccccgtctctactaaaaatagaaaaaattagccaggcgtggtggtgggctgctgtagtcccagctactcaggaggctgaggcaggagaatggcgtgaacccgggaagcggagcttacagtgagccgagattgcaccactgcactccagcctgggtgacagagcgagactcagtctcaagaaaaaaaaaaaaaaaaaaaaaaagtcccgctcctgctgtcggcacacgcaggccccagtcagccttggtgggatgtggcccactatgactgtgaacttaggtccaaggaatatgagaacttttgtctacggggcatggtgttaggagcagttgatgggtggagtcccagaaagagtgctgagtggaggtggagacactgagtgaggaaatggcggctactctatacacgagggagacaattgcgcctgatgctgtccctgggagtcccaggccagagctggcaggctcaagtactccctggcttctgccttcatagtcttagagagaggagggccttggtttaaggcctcactgccccagttcagtagagagataggagtcatacgccaagacaggtgtcaaggtacaatttctttatgaggaatgaggtaaccgtctagtccagaacaggcaggaacacagtcttaccttggcgttcattccttagaagccagggttagaactctcaagttgagatgcccctcatttccttcaggtactgtttcaggtacataatggctttggtttaacatgaaagcccttgtttagtacagggaggaggcccagttcctaaaagatggtgacactgagggagtatgaggggaccccctccaagaaagaggtaacacagatagagccctatccccactgagacctgggagatccaggtatggtgacatgatgagtctcactcacttcttcctagagcatctcagggaagtggggaacttcatcaaagggggcagccttatgttagcagctagaggattcctaggtaattccaggagtcaaaaagaagaccctgagaactgggggaaccactcatcccataacagtgaaagaaacacggaattccttcctgattttcatccttgggagatgatggacaattgtagccagatgggaaaagtttcacttcttcctcagggagttgtcggggggtgctttgtatgactggataggcgttagatcaagacagagaagtcactgagggaggaatgagatgagcatttacctagagagtggggcttcaccaagttctaccccctctcagctctgggaaaccccaggcagaagtacccagatgtgtcatcccctcaagactagccctgggtactcagagaggtgaaggcttttgtatgagcctggaagaatcaagtgggattagagaggagctcagactctgcttgagtgaagactaaagagaacaacgaccccagaacagtggagccccatagaggacgtggtgactggatgtgattcaggctttctttcatcttgggactatgaggcaatgagaatcttaatctgatgtaaggggcctcaggtcagtagagagaggatttccaggttgtgccaggcctcatagagaggacttgagggaactcccacctcatcagtggggatccctcagagtccctctgtatgtcagcgctaggaagccccgagcataaatgtcagaaatgcccctaaattcctcttcagaagtaacagggaaatgaaggtcttagtcagatgggttagcaggaggggtgggaggcattttaggccctcccaggagtcaaactggagaccttgagtgaggaccatgagtggggctacacatcacagggcttcaacctgccagccacagctttcagcctctggagaatatgggcattgtgaccagatacagccaccctcatttcctccattgggtctcaggcagatgtaggccttactatgagtaaatgtcctcaggtgtagagagaacagagccctaggcccttctgggagtcgaagtgtgagtgtggactgaaggcaccattcccccaagcccccaacccccaccccaaatagaggaaaaacaacgatgctagccctgtctctgcacttagctctgaaaggccttggccaagggttgccaggctgagactttatttctttgcatcaggtctaagggaggtgacagctttggtctgaagatgcagcaccagttagcagaagacaggttcccagaacttagatatagatgagatgaggactctgaattaagattgaggtccaactagcccaggacagagagagttccatagaactgtcagcactgccatcccgcccagcccccggtaaggatggtaggttgaagcagtgcctcatttttctttggtggattccagggagctttgaagtgtcagcttcagagcagcacaggaaggaggtcccagacccttccaagagtagatatgaagatcctgtatatgaattgagagggcccttgaacacagagggagtctacactgccaacctctgctgtcacccagtcagccccaggcagggttggcaacaagaacccagtgggttcctagagcaatgccctcaagaaaaccagcagaagtggctctctaaaagccaaggtggtacctccctgctgcaagtactcacaggatctcattctctctccttcaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaattatattacttgttcagtggctcatttattctcaccataaattgagcatctgctctttgtaaggctctgtgatagtagtgattgtactaagttaaagaagacccttcgcctgcacacagatttttagtctaaggacagttattatttaaagaagatggtgagatacactctaacatgtacagatttttttttttttacatataaacactcatttaaaaaaaaaagaagtgagaatggtgggagaaggttcagacaagagcagtcaagtgttaatttcctagccaaggcacttcgtggtgtgggacaatgcaagtccctcgttgggaggtcattttaagttagctccatggtgaactggatgaggttgtgataatcataagaaggtgccaaaccctcagatcatgagccttagagttgagagattaagcctggaaagggaaactgcccttaacagttactttgggattgtgggtaaagcagagagaacctgtgtctggaggaggagtggaagaatacagtgctctcgtcccagggcagtcaaacacagtgcacaaactagttgttttatgcacattgtctccagaaagtgtttgagaaataagggttatacttccttgaggtgagatgccaagaagccactaagctaacactgttttccctaagcttgtgcagccagagcctactccattaattaggtcttctcatatataatttcgcaaaactccaaggtagggctagattcattggtgacgaaataagtgaaaataagaatgtttttgtaggaagggaatctcagagggaggggagtcgttggtccttgacataaactctataagcttagagttgaattctgatgaagtccctgctcccatattaaataacatattctctcatggggagaatttacatagcgttacttgctttgcagcattttggcttatttggtggtggttttttagagcactgaatgttctctgacaattcctggacaaaacaaaaattttccagagatgagaatagcctttcttgtgtgaatataatagtagtaactgccattcattaaagacccaatatttgccagtcattttgccagatgccttacatacattacatgtgttccaacaattctacaagatggggcttatcaaattaggagatgaaaaacttgtaacattctcaagttcacatggctggtaagtgccagggctgggacaaaacccctggtctgaatgtttctagggcccacactgtcctgcttctctcaatctgaggccaaactgtctcttaattctcactgttccacaatatctctcaagtgataacaagtgccctgtggccaaagtactaaaagcaggcctcttagtgaaaggaaagttaaaatgagaaacaaagttttggactgtctgtggggttcattggcctggggttttcccgccttagcccacaggttcctctagagctgactctgctctggtcccagcacataagtctagtccagtgctttccaacattacagtgcccttccctggggtcttccccagtgtgcccccctgtccacactggaactgacctactggtcaacttcactgcatctttctctggagcctgcacctgctcccagaggaaaagacagcccagactcacctgcgttttccctgacacagagggttccaactgcttggaggtcccacccctcaccacagatgccctttgatagcaacagcccctttcgtgtaattgttcacttcaaacagtgaaacttagacacctcttcatgtctctgggtactgccaccacactgttaaagtgttttcaaatctactggtgaggagtgatttagcgcagaatctactgtttcttggtttataaccctgaggctagaaaagaggctttttaaaaccaccctgatatttgcagtaggattttaatagagtattttatttgagacaggccactgaacacatacaccaatgagtgaatttacctatgtggtcaacatccaa

SEQ ID NO: 17043 - DNA, 12309 bp, Human; identical to SEQ ID NO: 17042

SEQ ID NO: 17044 - DNA, 8916 bp, Human
tagaagcaaaacaaacatgatggcatgcatatatccagtttaatattttgttttgtttcgcttgtatttgtcttttacattgaacttttcttttaatctcttgcaggaggatgtatttaagcttttgtctcatgtgttccatgatgaattaactgacttgagtaactagagtaggtcatggccaaacttaaatgttcagttctgcaccagtcagtttccttttgtcccatgttctctggaccacaacccttggccccagcagttctttccgagatatttcctctagtgtctcggtcttggtggcctcactgtggttagagaagcagccttgaataaagtgtgtgctttattcaaataaagtgaagtttgcagagggggttaggactgaagtgaacgtgcagggagacagtagggggacagcttggggaagacttccccagtgttggtttcagtaattttagcttctatgacagtgattttcctactgtcagagacagctcattaaagtgaaaattataaggaaaatgtcagtagacttagtcacatcatttcagtaaatattttttaaggatttattcaccatcccagctgctagagtgcaaagatgaatgaattaggtcttgtaggtcctgctaaggaattttgtctttattgtggggagccattgaaagttttcaaacgggtgacatgatcaactatgaagtctggcagggatgtggaagcaagataagatgtaagtgacatcttttatcatatagtccaaaacattaaataaaaataggtttaaaaatgaacactgatacaggagtctcagagaatatgctaagcataaagcataggtaacagaacatacacgctataatttcacttttgttgaaaaaaaataaactaaaagatgaaaaaaaactttagaaatacaccaaaattcaaacagcttctttctttctttttcttttttgagacagggtctcactctgttactcaggctggagtgcactggcacgatcttggctcactgtagcctcaacctcctgggctcaaaccgtcctcccacctcagtgccccaagtacctgggactacaggcatgcatcaccatgcctggctaattttttgaacttttttgtagagacagggtttgccttgttggccaggctggtgtcaaactcctgagctaaagtgattcagctgccttggcctcccaaagtgctgggattacagttgtgagccaccacggccagccctaacagcttattgtgtgtgagaagattttgtgtaatattttctttctattcttcatcattttccaacattattaatacaatatctatgtataatttttagtatcaataaaagacatgcttttttttaattaaaagaaactagataactctgagcactgatacacttgaacactgctttctttacttgatgtttggaagtgacattgaccctgtgtctttaatccatcagcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtagtctcattgaggattaaaagttagaagagaagggggagccagccctttaatatgtaagcacctcagttgctggcttttctgtcatagctgtgagtagaagcactcatggtgtgccattggtgattccaggtgtccaggtcactggagaatgatggcgtctgtttcaccgagcaggaatgggagaatctggaggattggcagaaggagctctacagaaacgtgatggagagtaactatgagacactggtctctctgagtgagtagcagttttctccctagaattctgtctcagacatactacaattcctggctggcagcctgtaattcagaccacacctgtggctcctgtggctgtgggtcctctgtcggcctgcacgggcagagaaatgccagtctctaggtcctcccatttacagacctgcacgggtggagaaatgccagtctctaggtcctcccatttacagagacttttggaaagctcgcagcattgtgccttttgtgttttttttttttttttcctgtggtcacatagtctgttcttgatagtattttctaataaataaaatgtcatataccctatagtgtgatatggctagggttcctcatgttgttttttaatttattttatcttttttttttctttttttctttgagacagagtcttgctctattgcccaggctggagtgcagtggcacgatcttggctcactgcaacctctgcctcacaggttcaagcgattctcctgcctcagcctctcgagtagctgaaattacaggtgactgccaccacgcccagctaatttttgtatttttagtagaaatggggtttcaccatgttggccaagctggtcttgaactcctgacctcgtgatctgcccacctcagccccccaaagtgctaggattacaggtgtgagccactgcgtctggcctgttttatccttttttttttttttttttttttttgagactctgtcacctaggctggagtgcagtggtacgatctcggctcactgcagccttgacagcttgggctcaaatgattctcccacctcagttttccgagtagctgggattacaggcacatgccactgcgcctggctaattttttaaattttttgtagagacgtgggtcttactgtgttgcccaggctggtcttgaacttctgggctcaagtgatccacccacgtcggcctcccaaagtgcagggattacaggcgtgagcctccgcacctggcctctcatgctgtttttaatatttaagactatttgagatgggtgtggtagctcacatctgtaatcccaacactttgggaggccaaggtgggaggatagcttgaggctaggagttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgattaggagtgctgcttaatagatataagtctttatatgcaaaatgttacctattacataataaatgtgttttgtttggtagacaaagtcttttaaaacctaggtacatggaggagtgtcaagtgcctggagcagagtaggaggtaaaggaaatagaaaatgggccagaaaagtgaccttgtaagcttggttgggtcacatgctctcattgtgactgtttccttgtctgtcccagtgcccatcttaccttgcagtgccttagcaaggatgaaattagatcccctgaaaggaagcattggcaagacttaagctgcacgcacatggagaggcagaggtgggtggtggtgccatcaagggcagtggtagctctgtagcctgcctgcctgagccacagcccctctaatggaggagcactggaggcagcagctagccaagtcagttgttatgattggccagaattttataattgtcccaaactgctaggggaaactgacaagaacagtagcctttgaatctatatttcctccctgccattggtcatcttggtcactggcagctgatcagtgtgcagtgagctttcactctctcctgggctcacactgtgctgtttcccacccagaggtccttggccagacagagggagaagcggagttgggtacagagatgctgggtgacttggaagaggaaggtcctggtggtgcccacccaggtgagtggctctggaatattctgttccccttccatagccctctgtagcctagagtgagctttcccacggctgaagtgccaggtgctgacttggtgacctcatctggcatctgcttgttctggactcctttatgattgtcgttagttcagctgttacatatgcctcaactcctaccaccctgtggggtctttaagactaacggccacatcaatcattattcttcatgccctacagaatagagtaccgtacgaggcggtagtcaaaacctgctggagattgagcgtaggtatgtcagagcttcaggagggaaggcagtgcaggaaaagcacttgtcagtaggtaatttgggaggttatggaggaagaacagagctggacatgaattcttaagctgtaggtttagtttgtctttaatcattcaaatttgttattttaacactcttaattgagtatagttgttacagtgtattctgtcatttttcacagggattaaatataaatttgtagacaagcttggagaactatcatttacagtattgttttataagagtaatacatttatatttccaatcaacattggaaaaactgtacatgaatatagttttatagaagtcttggaacctagccagtgtcatcctcctccacgttatcctaattcacttattcctggggtgcttctgaaattcacagatgtttgtttggtcctgaagaaaccaaaggtactagaatgtgatcttttttgttggtcttcttccactttgcagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagcccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcatactggatgtttttctccgtttgtcaagaacactctcctggggccaaggtggaggagaggcacctgacctggagtgatgacagggaaggactgatggcacagcctaacctgcacttttacttaaacctaggacagaagacaagatgtggcatgggtgaaaattttcaggggactgtacttatgatggtggagagctggagacagtctgggtgatggctattgggaggtagaaagagtaggtgaaatgtgggtaccccagggagtgccaggtagctgttacgagcattggcttagatatatgcgtagccatctggatccatcttaaacacaatgccgaggggaaaaggtaagaaattgagatctataatgtaacaccatttatataaattaaaaatgcatgtacacaaaacattttgtaagaacacttgggaccaaaggagacccgttaaaagacattacagttttccacggggagagcgagcaaataagtagaaggaaacttggcttgctgtaaggcaggggtccccaacctttttggcaccaggactggtttcgtggaagacaggttttccacagacagtggtgggggacgggatggttttggaatgaaactgttccacctcagatcatcaggcgttagattctcataaggagcgcacaacctagatccctcgcgagcacagttcacaatagggttcattctatgagaatctaatgccgccgctgatctgacaggaggcagagctaacctgctgtgtggcctgattcctaacaggccatggaccagtactgatccacagtccaggggttgaggcctcctgctataaggtatgggattgtcttgttacagaaacaacatggagggaatccttgtagggctggcgctgtgtgaggtgggtaggtagcttcgtcaggaaaacctttgcagtttctttcctgtttcttctgcagttttttcttaccctcaagcctttgccttatagacaccccctctgtcctgtccttagttactcttacttcccaattgttgagcgttttaatgtgagcagccttgggccttgtgttgtggggaaaagcgaagcacaaaatatggtcctacttctccaataaagttaagttttccttgaggctgggaaataattgtatcaagcaattggactcctgctgacacttgttgaatacttgtgtgctaggcactattcaaattatttccatgaaaacaaatccttatagttttgggtggtgagcatgattttacctagttttccgtatgagatgtgggaggaggcctgagaagtgaagtaaggtggcagaggtgatggaaacccagagcatcttgcttccgagccacacacttggctgtggggtggtggtgcttctgcagttaggaactcagtgtcaaagctggatcctgtgtcctgaagtgtgggctctctgctggcagcagcggcatcccctaggagtgtgaaatggtgcagactcaggctccacctagacccccgagtcagaatctgcatctcagcaagctccccaggtgattctgtgcatgcagaggcactctcttatggtatacgaaagattcgcctcttcttgtctgcttctgccatcctccattgaaagcctgttctgccaggtgctgaggagaaaacaggaaatgcactgtcagaaggacagggatgatcaagttagaaagattgaagtcaacagggaagaattaaatgccaaatattagtgactcatctatcctgccttttctatcctttctgttcccacagttaaggtcctagtcatcattcatccaaacttttcagtaaccagtaggtcttctgctcttaatcacatcctttttgattccagagttaatgtccttgcacacaactggatgtagactttcctcaaaaccttgcaatggcttttagcagctactgataatgagcagtctttttagtatagaactcaagactctgaaaacctgcgtcaccctgcattt

SEQ ID NO: 17045 - DNA, 49408 bp, Human
  misc_feature (1)...(49408): n = A,T,C or G
atttaatagccagccttcatcaatactaattttcagctatggaatcaaacatatatggccctactctgggacacacctctaccagatttaatagacattcctcattaacactttcagctatggaattgcagacagttgatgatgaagcaatgatatcataaatgaatatcaagtcagggaagcagaatgatgcccaagggtggatgttctaaaacgtgacaagaattttctctcagtgatgacatggcagagaaataagctaggaaaaaatgataagataaagtttctctaaccaagacctcaaagctggactacagtgatggagggaaggaattgagagagcaagccaccaagcggaagctgctcttcaccctgggggggtgggcaatggacagcagaaggactcagacacagatgcttccagccagcccagtctctgttgtggtactgcaaggttgatacactccctgaagcaccacggcatgaaatggaggttcctacagccaagaagaaagagaagcaggttctgagcagaagacgattaagaaggagcctgtcatccagaagtccagcctgctatttggcatggggctatcagggatccaagccagctacctcatctctgaacaccagcaggtgactcttcccatgcagatgacagccaaggagtctgaaaacagcccagaggacaaaacaccaaatcacccctcccagtctacagtgtgttggaagggaatagctaactctgcctcaaaaaacaaagataaagggaacaagacaaacaaacaagcagagacctttctgcactgagctgccatctgaagggatatccaggacttcaaagggttcattagtgagtggatggacatcaacaccaaggtcttcacaggctggacagtgccgcatgtaacatgtaacaagggatattacacggttgcaaagcagccactggccccaggtacagaggtgaacactaagggcctggtgaacactacgcctttgcagaacaccaccaacaacaggcatgacaagattggcaacttcccttggcccttcacacgtctgctctgtcctgatgtctgggtcattctgtagcttcgtgttcccctatcctagctagtctcatggtgctgggcatgaggaagtaagtttttgcctccctaacctcaaagaccggctgtcccctctatctgcccccagctttctcaccttggatcagtacctgaacagcctctcacagtattcacaacaagcaccatctaaaaaaaaaggcttacatccatgagacatgcaggtctggttgtgttttatcaggtgaaggattacaccaagtggaaggaggcctgcaggagttgctgctggtccctgtcgttgtcactgtgggactgttagacctgcaaggcagatccatccaagtctggaatgaagtaataccattccacaggtatagccagtgcataggatgatagaatcaagaatcaaaaaatgacgattataaccagctcagaagcagtgagcactaagacaactcagccttcatggagaagtggctgtttccaggtctgaagcaaagaatgacatgatgtacccaaaaccctctgtcttgctggaaaggagggctggaactcacaggtggggagggtcttaagtaatcaccacagctctgtgaagagccccctggccataggcagtatagttggagtgtggtaaggacaaggccaaggggacaaatgaggccacatctgcttgcatccatcatactcctttatggcaagtcatgcctggctattgtgggagatgctggaatccacagtgcctagggtgtaaaaaacagttgcaaaaatgacaagtcactgtgggggatggaggggactctgaattaaagatttctgtgacaatcagggaaacctgaactgattacatatttgatgttaaaaaaatcctattaaatttttaggtaagataatggcattatggtttgttttgtttgttttttttaagggcccttccagagaaatgtactgaaaaagtctacgcaatgtctgggatttgctaaacaatacctggaaagcagacaggtatgagtggaatggcactggctgtgggctgacaggtgacgcaactggggcagggggcatcctttgagtttttatatttttgtaattatcacttttaaactttttattattgagaatgtcaaagaccctggaaacatggtgaggtaagcaagaaaatggtccccaagtgcttacatcacgaccccagaagctatgggtatatgaccacacataggagattatccaggattatctgggctggcccagggtaaccacatgagtccttgcagtttaagagcttttcctggctgagccacacagataccaaaagaagcagaaaacattagagcctgagggccctcctcaggcttcttctggtatctggctttgctggccttggagtagggggccaaggaatgtggtggcctcttaggggctgggaacaggaacctcagtcccgctcctgccagcaccttgaccttagcccagttagggaggcagattttggacctctgacttccagaactgtagcctaagattgcagtgatttgttgtaagttgcaatagaaaactcatacacataaaaactctgtgtggattaaacaatataaaatataatatactaaataaaaatagattatgtgtgtgacaagactctatatcaagctttattacagattcttttaatgcactaatctcagactgaaataaagttgaaattaaatttaatatttgtacttgagttatgtgtatcactgtcctggtgtatgaaacacagtttgctgatgatgaacagctggacagcgctctggaaatgtcaccatgggtgttcctgccactaatattaccacctttatgcttgtgaagtcaagcaaggaagatactatcttatattataatgtaaatgaaaatgaaaaataaaccagcttacagaaacttggaaaaagaagaaaatgtataaaaagagacaaagaaggtcattatgtaatgataaaggggttaattcatcaagaggatataataattataaatatatgcacccaacactggagcccctagatataaaaagcaaatattagagctaaagcaagagataaatcccaagacaataatagcttcaacaccccactttcagtattggacagattatccagacagaaatcagcgaagaatcattggatttaatctgcactatcacataaattgacctaatagatatttacagaacatttcatccaatggcagcagaatacacattcttctcctcggcacatgcatcattctcaaggataaaccataagttatgccacaaataagtctttaaatattcaaaaaaattgaaataatatcaaatatcttttctgaccacaatggaataaaactagaaatcaataacaagaggaatttcggaaactatacaaatgtatggaaattaaacaatatgctcctgaatgaccaatgggtcaatgaataaattaagaaggaaattaaaattttattgaaataaaaatggaaatacaacatagcaaaacctatgggatacagtgaaagcagtagtaagaggaaagtttatagcagtaaacacctacatcaaaaaagtagaaaaacttcaaataaacaacctaatgatgcatctcaaagaactaaaaaagcagaagcaaaccaaacccattcttaataaaagaaaagacataacagagagcagaaataaagaaattgaaatgaaggaaaacaatacaaaagttcaatgaaaccaaaagttggttttttgaaaagataaagttgaaaaaccattagccagactaagaaaacaagagaagactcaaataaataaaatcagataaaaaaaaggaggcattacacctgatactgcagaaattcaaaggatcattagagactactacgagcaactatatggcaataaattggaaaacttagaagaaacagataaattcctagatgcatacaatccactaaaattgaaccagaaaggaactcaaaacctgaatagaccaataataagtaatgagatcaaagccataataaaaagcttcctgcaaagaaaagcccaggacctaatggcttcactgctgaattctaccaaacacttaaagaacaactaataccaatgctactcaaactattcaaaaaaatagagcagtagggaacacttccaaactctgtctatgagaccattattacccagacacaaaaaccaaagacatcaaaaaaagaaaactacaggccaatatccctgatgaatattgatgcaaaaatcctcaacaaacagcaaatcaaactcaacaacacattaaaaagataattcatcatgaccaagtgagatttatcccagagatgcatggatggttcaacatacgcaaatcaatcaatgtgatacatcgtataaacagaatgaaggacaaaaaccatatgatcatttcgactgatgttgaaaaagcatttaattctgtgaagaatgtcaatggtagtttaatgggaatagcattgaatctataaattactttgggcagtatggccattttcatgatattgattcttcctatccatgagcatgaatatttttgcatttgtttgtgtcctctgtgatttccttgagcagtggtttgtagttctcctcgaagaggtccttcacttcccttcttagctgtattcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgcaaacaaagacaatttgacttcctctctttctgtttgaatacggtttatttctttctcttgcctgattgccccggccagaacttccatactatgttgaataggagtggtgagagagggcatccttgtcttgtgctggttttcaaggggaaggcttccagcttttgcccatttagtatgatgttggctgtgggtttgtcataagtggcttttattattttgaggtatgttccttcaatacctagtttattaagagttattaagagaattcagctgtaaatccatctggtccttggtttgtttttgtgtttatttgtttgtttgtttgtttgtttgcttgttttggttggtaggctcattgcagcactattcacaacagcaaagacatggaatcaacccaaatgcccatcaatgatagactggataaagaaaatgtggtacatatacaccatggaatactatgcagccataaaaagtaacaagatcatgttccttgcagggacatggatggagctggatgccattatcctgagcaaactaatgcaggaacagaaaaccaagcactgcatgttctcacttataagtgagagctgaacaatgggaacacacagacacagggaggggaactacacacaccagggcctgtcagggagtgaggttgggggagggagagcattgggaaaaatagataatgcatgctgggcttaattactaggtgatgggttgataggtgcagcaaaccaccatggcacatgtttacttatgtaacaaacctgcacatcctgcacatgtaccccagaacttaaaaattaaaattaagaaaaaaaaagaaataaaaataaacaatgtgatgttggtcactgactcaaaaataaagcacttactaaaatacaatatctcttgatgataaaaaaaaaaaactctcaacaaactaggcatagaaggaacatatctcaacataagaaaggccatatatgacatacccatagctgatatcatactgaatggggaaaaaatgaaagccttttctctaatatctggaacacaccaaggatgcctactttcaccactgttattcaacatagtactggaagccctagttagagcaatcagacaagggagagaaatagaagacatccaaattggaaaggaagaagtcaaattatccttgtttgaagactatataatcttatacttggaaaaacctaaagacttctccaaaaacctattagaattgataagcaaattcagtaaagttgcaggatccaaaaatcaacacacaaaaatagtagcatttctatatgccaacagcaaacaatctgaaaaagaaattaagaaagtaattccacttacaataactacaaataaaaaaaaatctgggaataaacttaaccaaagaggcaaaagaactctacaatgaaaactataaaacaatgatgcaaaaaattgaagagttcacaaaaaatgagaagatattccatagtcacggattgggagaatcaatattgttaaaatgtccatactacccaaagcaatctacagattcaatgcaatccctatcaaaataccaatgacattctccacagaaatagaaaaatgatcctacaatttatatggaaacacaaaagacctagagtagccaaagccatactgagcaaaaagagcacaactggaggaatcatattatctgacatcaaattatgccacacagctataataaccaaaacagcatggcactggaagaaaaagagacaaatacaccaaagaaacaaaatagagaacccagaaacaaatctacacatctacattaaactcattttcaacaaaggtagcaagaacatatattggggaaaaagatagtcttttcaataaatggtgctgggaaaactaaatatctatatgctgaagaatgaaaccagactctgtctcttgccatgtgcaaaaaacaaatcaaaatggattaaaaacttaaatctaagatctcaaaccatgaaaccactgtaagaaaacattaaggaagctctccaggacattggtctaggcaaagatttcttgagcagtaccccaaaaacacaggaaaacagagcaaaaatccaccaatgggatcacatcaagttaaaaagcttctgcatagcaaagaaaagaatcaacaaagtgaagagacaacccacaaaatgggagaaaatatctgcaatctatccatctgacaagggattagtaaccagaatatgtaaggagctcaaacaaatctataggaaaaaaatctaataatctgattaaagaatgggcaacagttctgaatagacatttctcaatagacatacaaatggcaaacaagtatatgaaaaggtgctcaacatcattggtcatcaaagaaatgcaaattaaaactacaatgagatatcgtctcaccccaagttaaaatgacttttatccaaaagacagggaataacaaatgctagtgagggatgtggagaaaaggaaactcttgtacactgttggtgggaatgtaaattagtacaaccgttatggaaaacagtttggagtttcctcaaaaaaatataaatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagataaagaaaatgtggtacatatacacaatgaagtactattcagccataaaaaaatagatcctgtcatttattccaacatagatagaacttgaggtcattatattacgtgaaataagccaggcacagaaagacaaagttcgcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataagatctagtatttaatagcacaacagggtgactgcagtctacaataatttattgcacattttaaaataactaaaagagtaataattggatggtttgtaacacgatgaaatgataaatgctcaaggtgatggataccgcatttactctgacatgattgttacccattgtatgcctgtatcaaaataactcatgtaccccatactatatgcaatactatgcacccataaaaattaaaaagaaagaaagaaaagaagtctgcaataaaaatccaaagaatgtattctctcttatttcattcttctcaaaagacaatagtgttctgcaatgcactcttcttttcctctacaactgggcagtaagcagggctattcattcaatcttctaggcatcaaattgggagagaaaagtatttttcattcttgttatgaagcatcaagagactattcagtagtacttgccagttcccaaaattatactgacatttaaggggtagttagagaaataagaatccacaaaagaaatggaaggagcagctagataagaagaaggaaagctaagaggtcattgtcctctaagtcaaggttgcaaagcatttacaacatttctctttatagtagaaggaaatgagcaacagtatcaaattcagcaagctgagagcttaagtaaatgtggagagacaactattatatatacctgctgggaagtcatagcaaccttagaagagagctggtctggtgtagtacaaatgttgatttgttattctgactcttccatggactgcactccttagaagcaggtctgaatgttttggtccccacagtacctaggacagtgcctggaatgtaagaggcacttaataaatgtttggcaaatgaatgaactaaaacaaagtaaagtatgtagttgatttggagggaaaagatcccaatgacatttaaaactgcttgtaataagatgcaccaatatttccttaattaaatccctaagtctaaaattatcaccatatatttggcttcttccccaaaggccctgaagccaaaacaactcagttcctaaggagaatatataatctgccacctacaaagataaagtctcaaacataagaagcaaccctaaatttctgtgcttagagtgaccttttgagttgccagagtgatgtcattagtgttacagttttctgcaaggttaggcatataagtatgtgttaaatagttccatgggctcctgcttgctcatttaataaagaagagttcattaagagtatcccaaatgcgtagctcagggccactgacactagaaaactgcaaccactttgttctttccctgccccgtatctcacttgtccttgcagctgtcaccttgaggcctcagcactggtaggaagtgagaagacactgagaagtggcacccagtagaagcttctagaaacagaaagagtatccataaataattaaacttatgaaatcagaacctgagaggttatagtcatgtttctcggctgcccatcataattacctggacagcttccaaaaatacattaatgccagaggcccactcccagagattctcactggcctggagtgagatccaggcaccagtattttttaaaattcttccagataattctaatgtgtgaccagcattcagaggcactatctttatgtctttatatctcagaatgggtatcagaacttaatgctaatgagaaagtacttcagattttatcaccctatgtctcagaaaaccactttcctctattgagtgccactgacccataagaaaaaagatcaatagtctaaatgtacaagtacaaagtgacttaatcgaatttttttacaaaaagagaaaattcaatccatttgtttttaagtttaataacggggtgaaaaaagagtaaactattggttagtgtgtgccactaaccaattattatgttattatgtttcatggtctactttaaacacttttacatgtattgttttacttagtctcccaagcaacccagaaaggcaaatattattattcccatttttacagttgaggaaacaaaaactcagagacggtaaattgacttgtccaaagtcacagagttggcatatggtgatgccaggaggcaaacaaacaaatggccccatctgctgctctcacttatcttttcatcaggccatgttgccctatctaaagaaaatcttagtgaatgatacttcaccaagcaacagaaattttctgtccaagccaatgaaagggatagatggagctggacaattgaaagaaggaaagagaagaagtagagagtaagaagaatgaaagacagtgcaagctaagggaagggtcagaaaggaaacatcaactgcacccagcagatgagtcacagtgcatgaggccaaagtcatactaatggccacatttcccaatacatacttagatggtcaaggcagcaaatacagccagtgtgttactatgtgtcctggattgtgctgtaagggtgcatgagacacagtcctgccctacagatgcttataacctagcatgggaggcagatttgcacgcaaacaggatagattttgccttgccttagcagaagtaagtaccgagaactgggagcagagatgaagaaactgttcatatgggtcagagaagacctcacagaagagggtcatctgagatggctttgaaacagggtaactcattcaccatgaaggcagaaggaatggccgaactgaatcatggaaacagaaactagcaaggtgtgtgcttgagaaatggaaagggccctttataaatttctgagacggggaaattatcacattctcactgactccctccttttactcagggctgagattatatctttaagctttgaattttcacatcatactcatctgcagttacataggaatggttctgccaggttcactccagttcctagatcatttaatggtggaattagattcaggtttcctctcctcactgcccacagctctgttcagccactatacaacgcagatctctgttttacgtgaggattccaaattacaaaattgtgtaaagtactttcttttttggtctctatatccctatcctgatcacaattcaaatgaaaagtttcttgtcctataaaatgagcaaaattgaattaatatcttaaggagttcaggggggctgtctttgagctgggaaagaacctctaagccagcttccattaacatatttggaattctaggtgtttctttgaagcctggaaatttttttaacctgcacagaacctttgtactgttgcctttaaagcagctactcccttttattttaattaacaatgacttcagcaggttttaaataatggtttgtctttatgaaagaaaactagggtggaaacactccaaatccacttattggaataaactgaggagtcactaagtcctttccaacaagatttagacagttcattagaataaatatatatttaatctccctctttctatatcatcttgaaacagagcaaagatacaatgctggaataatgacacacagtctgaaaaatattctaaatgtattgaaatcactgcagctcctttcactttgtatagtttcaaaacatttataatttgtatgatgtgtctattaaatgctgcctaatagccaggaacaggacagcactcaggaatttattggtttagctagactcaaattgtgcccaaaccctgtgaaggaatgactaaagcaatcagaggattccaccagagtccaagttgaaataacttcttgaaagtttaagccaatcctcattcttatgaagtaattcattcaatttagatgaaaagtattcttatttcctgaaagttaactggttttaataatggatgtagtccctattctatttgatattttagagatgttcaaaaagaaacaaataactttaaacaaccaggcctaagccatttaaagagatagcagatttaatttctacgtctttctaaatctagtgtctagggcatccattcaggtgaatcctttgattcctgccattatcctagaacaagagtagatgtatgaattcttgcatctgtactggttactaaactctcagcctctgttctacctcccacagtctctgttcctcatagctctgatgctgacccaagggttatagaaggagatcaactcccaaacctaatcccagaaagtaaatacacaacgatatagtatatgcttagatccattcttcagtttattgaatcacaaaatattggcgctgagaggaatcttagaagccaacagtttcaaactctccgtggtacagactaagccctaaagatgttaagtgactttctcaaggtcacacagctagttagtgacaaaacagggcctataaccaatcacttattatgagtgcatgctctgatcctttgctgctcgctgttgtttgcagaccagcaatatcagcatcgcttgagagcttgttacaaaggcaggctctcagactccacccaagaccctctaaagcagaatttgaattgtaacaaatctttttctttttttttttaaacagggggtgtcactgtgtcatccaggctggagtggtgcagtgacacaaccacggctcactgcagcctggtactcccaggctaaagctatcctcccaccttagcctcccgagtagctggaactacaggcacacactaccacacgtggctaattttttttatttttaattttatgtagagacgggatcttgctatgttgccaggtctggtctcaaattcctggactcaagcgatcctccctactaagcctctcaaattgctgggattataggcataagccaccacaactggcccaaatctttaggtcattcatatgcacattacagagctgaagctaagccaggcacattggcacgcaccggtagtcccaactactggggaagctgaggaggtaggatttcttgaacccaggagtttgaggctgcagtgagctatgactgcgcatgtgaatagccactgcattcctgcctgggaaatgtagcaagttctcatctctaaagaatatatttttcatttaaaaactaaaagaatggaaggcaagtagatactggtttgaagcatgggtctacctcttctaaatgtaagcaaaaatctcaaccttctgaaagcatcatttagaacctggaaataatatcactacccaccttgcagagttttcattgtataagcataacacagatatatgcatgttcatttcatgaaatacgtatgtgcataaataatacattcaaagtgtgtggcatatagtagataatatggtatatagtagctaatgttatttcccatctcatgcttatcattaatattgtgcttaaccaaactgaaagccactaatgactatgcatccatgaaggaatcaccagtcttccttcctttgttctaatgtgttaaatatcattttaacttttatatatgattaaggcttttttatttaatgttcctaactctcaagaaaattattattatgtggaaaacaataatagctaactacttttagtgctgtgcttagagaggaaagaacttctcccaaagccaagtcataataataataataataataataataacccacaacattcttaaaatatcttgactctagagcctataaacctggcttctccagaagccagtgagtatcagctgccactgatgctgtaattttcttaggcagagactcaactgccatgggcagatgccacaacattggcaaaagtggggcacagttaaagatgacgtttcatcaccaacatgtcacacttgtcagcactttaaagaaaaaaacagattgaagaggaaagaagaagttgagttttagtatccaaatttgaactaaaattttggaaaaatacagcatagtacagagtatgaaaccataccaaagtgatattttgaaggagatacttttgggaaaatgtgattttaacatcaattagaaaaccacgttctcctaaggcagtaattctcaatcccggcagtatgttacaatcagctaaggaagatttaaaaagattgaatgcaaatttctgagagaggaccaggctctagtgttttcttaaaaattcccagtcaattttaatatgcagccgggattgaaaaccactgcccctatggaatcaaaaccctgttgttatgtaagagtcaatccactgagagctatttgttgctgttaacttcattgtgtacctcttctaggtctttttgccattcctccaggacatccaccataaggaaaggagaccctggaccaacattctctaagatgtttatatggaccagtggccggacctcttcatcttatagacatgatgaaaaaaggtaaatgcactgggattctgggcacttttcagaagcatttaacctgactctccaaagaggatactgacaggaaagtagtaggcaactgagccttatgctttgcaatgtggggacagactctacagtacaggagtagggtttcagacactttggccttccttctccttgcactttacatgttcgctttcagcacatagctttgcaaaagttgttccctgtcagaaattcccatgtcacaagctctttgcttagctaactccagctctgctttcagatatcaataagaaccaccactcccatcatcttctttaaccaaacagactatgttgttgaatttccagcacctagcactgtacctggcacatggcgctcaataaatactgagcaccaaatgtattaataataatttattaactgaattaattttattaacaacaaaaaataataaaaatataatataattaataaaataataaatactgagaactactggcaattcagtttcttcttctgaagtgatgaaaactgcatttctgggcactggacatatggcagggaaggaaaacagaaagtatgagaggaggaaaagaggacatacaaatccattgagcccttaaaatccttggaagaatagcctgggaggaagggaaaaatgagggaataagaagaaagataaagggcaaaggcagcattaatgaaagacaagatgacctttgtgcaactcaatccagtcctctcacttgggtttagggagtaaatgtattcataaaattctctagtcatttttaaatatttagtcttcctctttctcattgaccttgcactattatctgggttaagtgaagctaaattttaagtataattgcctttaccagcatattgcaatgtaagcaagttgcgcatcaggcagaatctgatagaagtcaggattgatttggttgaaggaaatttgtgaaaaaataataataaaataaaaattaaaaactacaattgataaatggtgctgggcacaaggagaagaacctgaaggaggtttgcctgaatactgttttcagagctgatacttttattttccttctaaaacctgaattgcctcacagataaaaattcttttaaaaatttcaaaagcaaagttgttcttcacaataattatatattatagcaaaaattgggaagcaacttgaaaattcacaatagaaaatgtgctaaataaatcactgaatgtaatataccacttagcactttaaaatgctttgacacaatattaactgaaaaaagcaagttgaaaatttgcatgcaaactacgattgcagccacaaaaaatatatataggcaaaagtctggaagaaatagcatggtttttactgctctgctttccaaatgctttgtaacatattgttaccttaattatggaaaaaataattatatgatatttaagtaaaattatagcccagaaggcaaataatgttgccttgtcagcatttaaaaaacaagtcccagtgctcatcatgacaccaagcagattaactgaaaatttactttacttgatcatctctaggttttcactgctttttctcaaggcttaatcaaattatttttcatttgctttcaagttgaatcatctttcagcaagatcttttctgtaacactataaaatttcatatgtcatttcaaattctatatttgaaagtgcagaaagacagaggtttggtcctgcaactttcatgccaggaccaaatccaagagttttgttgccctacaggaatattgtaactgtcaacagccagctgtcctgaaattctgaaggctttattagagcaagcgaagtgtaatatatttctttcaccttctatttactctcagcaaataatttaatatattttgctactttttatgaacaaaggaattaacatttaagaagcaattactgtgtactgtaggttttaattgtgttctcttaagatagatattattatgctggcttcacagatgaggaaactgaggctttttaaataactgagtgattttcaataacttccaaaggcccaacaactagccagtgatggaatcaggatttgaacccagctgatgctctctccctgtaccccagtacctgcccaggctcttgtcaaacttgaaatatttggagtgatagtgaacagccaagcccacaaggggaaaagtatgttaaaatagagttggatattgcatatcaaagaagataataaacatgtgactgacgtattggtaatatttgtggagtttgaaaggtgtgaacaattagcttagtattctgcatcagtaagattctatgaaactgaaattactgttttaattttttatttttaaagtatgatttcagaactatgggatttataataattaaaatattgactatgaagaaatcatttttcagctttatttatgggatggggatgcaaaagcttattaaataagtctgcatggccaaaaaatacaagcaatagaatctgccattaagcaatagaatctgccattccttagtttaatgttggaagttaatttgtctgtgcttttttttgaccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcgtgatccgcccacctcagcctcccaagtgctggggattacaggcgtgggccaccacacccggcccgatccctaaatttcaagcagcaaacaaacagaataattaatttagaaattaaagaagagagaggtttttaagctaagggcattacagactgtttatcaaatattctttaaattgtttttttaaatattgaagtgatacaaatgaatatttattacatatgttaatatacaaagtgatattataaacatccaggtacccatcattcagtttaaaaaacaaaacaatcagaatttttgaagcccttgaggatgctttcccaatactattctactccccatcaatcaatatcaatcaatatcctgaattttgggcatatcattccccgattttttttcatgagtttatcacatttggatctttaaacaatatattgtttccatccaaatgtttggagacttcatgtaaatggaatcatgccatatttattctgcaacttgtttttttcaccaaacattatgttgttatgatttaccaatgctggcgtgagtcgctgcagttcattttatctgctatgtagtctcccactacatgaacatactaccatttattcatccagtctactgctgagcaacatttgcattatttccagttcttttgtcattgccaacaatgatgctattcttctacatgtctctttgtgcacatgtatgaacatttcttaagatttatacctaacatgggaatggttggttcaaaagtacacgcagctttaattttaccaagtaatgccatggttttccaaaggagccatacatgagattcccattgctcaacagccttgtttagagttttcggatttctaattttcagtaatcaagagggtattattattttaattttcatttctcagattattaatgagattgagtatatttccttagtcgttttttctgagttgactgtttaaatatttgccccaattaggtcaaatacttgactgtttaaataatttgcaattatttcattagatttatatttaagtaacattttgcagcaattataatcatacctcttaccatttttctactggattgtttgtcttttacttgacttgcaggaattctttataaaagtccatattaattatttatctgctatatgtatgtaaatagcttctcccagtttgtggtttggcttttcactttctttttcatgtcttttgataaatatattaatatgttcttaatttttttattattatacttttaagttttagggtacatgtgcacaacgtgcaggtttgttacatatgtatacaggtgccatgatggtgtgctgcacccattaactcgtcatttagcattaggtatatctcctaatgctatccctcccccctccccccaccccacaacagtccctggtgtgtgatgttccccttcctgtgtccatgtgttctcattgttcaattcccacctatgagtgagaacatgcggtgtttggtaattttaatatattctaaattaacaatttttggaacactttgaaatcccgtcctactccagtttcaaatagacatcctcctgcacagttttctaaatttcatgtagcattatctttcacaattacgtatttaatcatctggaactgatacccaatatccagtttttatatggataaccaattgccccagcatcatttattggagagtttctcctttccccattgatctaaaaatcacttgtcatatattacatttccatatatacatggatatgtttttgaatctctattctgttctagcggccagttttgtccacctcagacaaacacctcacaacagtttacaaattttagcattatgcctgtaatacatcttgatatttgataggaccagtcacccatcttgttattttgtagtcagaagtgtatttactattcttagccacttgcacttccaagtaagttttaaaatcaggttggcaagtcacacctatcgcacttcccaaaaaaaactctagggatttttattagaattttataaaatttattaattaatttgtgataaatttacatctttatgtcaccaagtctttctctgaatgaatacgattaacctctacattggtttgtcttccctagtatctcctaataaagttttgcatttaaaaaaagtgtacatcatttattagatttattcctaagtactacctttgtattgaaatggcattgaatttattgactaactgaattgttttaaatattgagtctccacatcccggaatataattccttatttattcatgaattatatcatgaattatcatgattgcagtatcaatcatgatatcattttgcaattatttcattagatttatatttaagcaacattttgtggcaattataatcatacctcttatgttatatatgtgtttttactgctgatgtgtagaaatgctactgcttttgtagttactgatttttttctatcaatcaaccttgtagaactcagtatgcttttaaatagttgctgatagatttgttttgatttccctatttgtattttctacaaataacaatgtttctttgtttccaatccttacggttttttctcatgtgttacactcttactctattggcaggaactttcaggataatattgtagagcaaatcaattatgattactaatatatttgggctgccttttccaaactcaagttactttttaactcatcatttgtttgtgtaattttggtctgtttaattcagccaaactaattaagtctttaaaattgtattctattttctcccatttggaaatttggatatttcatttatgtttttagataattacattttcatatgtgtgcatgaattgaccaatatgaagataattaatgctttcattatcctgccaaaaaagaaacttgaacgacccctactctcataacttcactacgttgttgttgttgttgttgttgttgttgttgttgttgttgctgctgctgttgtttttctaatcgtagactcaggaggtacatgtgcaagatttgttatatgggcatattgagtaatactgaagtttgggcctctattgaacccatcaaccaaatagtgaaactagtacccaataggtagtttttcaactcttttttcctccctccctgcccccttttggagtccccagtgtctactgtttccagttttatgtccacatgtacccattgtttaactcccatgtgttaagtgagaacatgcagtatttggttttcggtttctgcgttaattcacttagggtaacagcctcccgctgcaaatgacatgatttcattcttttttatggctgtgcaatatttgatggtgtatatgtaccacatttgatgaacacttaggttgattctatgactttactattatgaatagtgctttgataaacatatgagtgcagatattctttgatagaatgatttcttttcctttgggtagatacccactccagtaatggtatcaattatggttgctgggtcaaatggtagttccattttcagtaatttgagaaatctccacactgcttttcatagaggttgaactaagttacatttccaccaatagtgcctaagtgttcccttttcctctcagcctcaccaagatttgttatttttggctttttaataatagccatcctgcatggtctcattgtggtcttaatttgcatttctctaatgattagtaatgttgagtactttttcatgtttattggcttgcatatatgtgtcttttttttgagaagtgtctgttcacgtcctttgtccacttttcaatgggttatttgttttctccttgttgatttgtttaacttcctgatagattctggatattagtcctttgtcaggtgcagagcttgcaaatattttctcccattctgtaggtagtctgtttactctgttaattatttattttgctgtgcagaagctctttagtttaattaagtcccatttgtcaatttttggttttgttccatttacttttgagcactgtctttttttgtaatgtttaaattacaccatttttgctaatatataaaaaggcaattgactattgcatatcactttggtttcagcaactatactagtttttgtttgttttttgttttgttttgttttttgcaaaagggtctcgctctgtcacactggctggagtacagtagcacaatcgtgattcactgcagccttgaaatcctgggctcaagcaatcctcccacctcggccccccatgcagctgaaactacaggcatgcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcagtaaactggctttttgggaattagccattgagaaactgatcctttagcaagttggcccttggcgtatcagtttgcttctcctgtacacacctatctaatcagtctcattgccatacactgcaatgactgacatctcactcagctcccttgggactctaagtcttatttatttggtatcgccagaacttagcacattgtgtttcatctgatgaagacttagaaatgttgactaatgaataagcaaattaattcataagtggcctttatgctgccttaacctgaatacttttctccttctctttataggatagctaccaagggaatctgaatttaaatgggtgtgacagccaaggaggaaaaactttctttcacattttgctctttatatccatatttgtatgtgcatggcctcaaaaataatttgtttatgaattatgggctgacccccaatatcaaacttcaagaaactacataaaaggagctcaaaataaaattttactaggttgactaatgcttggcgtaaaattgattgaagccttactaaacaattgaaaatattttgtttacaagatatttatcacaaacacttttgttatacttggatttgccctgtagatttattaataacttctattctccaaaggctttgaacagaatgttccctatatatagtaaagactgcacatatctactatttgttattgtcaacatgtggttcaccctgaagccaagactatctcaacagaccttaaatatggtgctttgccaggacacaccaaggctagatcagcttcaaacttataaagtcaaattcctgctctacacccactgttgggcagcacacttagtcaaaactgaatttgtagtcataccccagactcattcttcctcctgagctctccacatcagtgaattgtccctcattccattattcttagcactaccacccccaccctcaattcctctcaggtagattcataaagaatagacagaaagaaccaaaaggtgataagctatcagccttgttaatacttacatggtaactcacacattacaaggcttcctagtatggaagaggatacatagggctgtggcccaaaatatggcatcatgctccttccaactagcactgaagacaacatggtgtagaaggggccaactaatgcaccctgtctcaggctgtgaacaccctctttcccaactgagacttactacctttactacttggacatgcaaaaaaccaaagcctgaacaaaagcaagtccaaatgataattttttttttacaaaaattatgccacacataagcaatgacccaaaaaacagaggtggccctctgactggcctatctcaccattgagattagtcactcctctgcctgtgcttaggacactaaacttgtgtgtactataaatgtacaatcactttcttcctctttagcaaggtcagcagaagtcacctctttggatcctggaagagtagggaaatacggaagcaagaatctcaccttaccactctccatgatttctccagtcatccacatcaagtactagagcataaatctaaactatatcctttttcttacttcctcatcatcccctgtattctatcagccaccaaatcctgaagttctgtctcatagatatttctccatgtatcgtttcttctttatacatcctaccttgatcctagatccagccctcactgtcctttgccaacactacagtaacaatccccccattcctctctctgatttaagccttatcctgtttcttaaactctgcacagaagccagagtgatcattttgaaactcaatcgtgtcaccctctgacagattcctattcactacagaataaaggccaagctctttagaatgacttacaaaacccttcatggcctacctacctttgcaaactcatctgcctctttttccctgtcccataggcatctcagtaatattaaaacagttgtagtttctgatattcaccatgcaattgcaagtctccatccctttgttcatgtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattcaggagaagtgtgtgaacctaaactgaactctttgctcttccaaatcatttattcatttcttttattttccattaattctataatcatttactaatgaattccatgggtatggcccactccactcacccactttcattttgctgggtagtatcctgatttctcagatatttttgggctgtatgaaaatcattcacttttcccctctctatacattccagagcatatcaaaaacatttgttaaccactttcaaattgtgatttgtttttgaattacacgtttgaatcatttttatatgcttcttgttctgatgacactgattacacttcttctcttttatgggtataggctgacataagtgatgctgtgtgacagtctaataccctggaattgtgagattatgctccctccttgctgtcttctatctgcaggaaattcagatctctatggcagccatcagagttaaatacatgttgataaataatataagtgaagtaacagcagattattattttacagcaggtctttgaagctactcagactcagcctgtctcttcctgattcagaaaagctttcagcccactggctttagctgctaacggacactgattttttaaaatttgagttcctaaagggtgaagttttaaaagctttgatgtaaatcctagaatttccaaacaaaatctcaaaaaagaatgaagaaacacagagggtgggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaatgatgataaacaaaggcctgtatttagctctgactctcctactacaatgggctcacttctcaaggaaagagtaagatttatacaaaccacctcaaaaagagaactttaaaataataataagaagaagctaatcagttaattttgcacaaccaatacttagattaataaatactcggccctacaacctcatggaaatatattaagtacatacacactccatcacctctataaggaatcaaaatgtttagcaaccagcccagaagggatcagccaatcagaacagatactggccataaacaccagtcaggccatcctggagcacaaagctaaatataagccctgaataaacacacaactgcgcaaacaacaggcatatcttccctcccccgcaaagttccactttagagtcaactctggttcctctcccaagcaacaagagcgattagccataaaaatttgaatgaaaaatctgaagttattcttgtgcatattggctttttgcctgaagctaaaaaaaaatgacttcagtttctttttccattttcagcattttatttgtcctccttgctgtttctaggctctaaaggccagcgattttcccatttccactgccctgcaatccaaagctcccttctcaaaatagacattgaaaaatcatgagctgtttcttggtcacaggccttgcaggaattcctgagcattgccttcctactcaagcttctcatcatctccccaagcacccagcacttccgcatttcttttctaccttctcctccagacctggtttcaaatccaatcctccatccccaagctttatacactactcattttcttgccattttgtccattaaaaattctctggagaatagtagcaattttaggatgttctgatgtccgtgtcattgagctgtagctccccaccccatttttgaatgggagcatttattactaatctcttgtcactcattgtcttttttttttcgagatggagactcgctctttcacccaggctggagtgcagtggcatgatcttggctcactgcaagctccgcctcccaggttcacgccattctcttgcctcagcctcccgagtagctgggactacaggcgcccgccaccacgcccggctaattttttgtattttttttttttagtagagacggggtttcaccatgttagccaggatgatctcaatcgtctgatcttgtgatccgcccgcctcggcctccgaaagtgctgggattacaggcatgagccaccacacccggccaaatctcatgtcagtcattctcttaaataatttgcgtgtatcatgtcacttagccattaaaatgcatttaaacattattttcactttgcaggcgactggggatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacacttttctaactcaatcgaaagttttcacatataagaatagctgggtcaccactctacatcttcacactgcttatcaatctcaagccaacaaagccctaagcagctctcagcttgagaaaaatgttaaccaaaataacttctacctatcactactgaagaaaaatgaaagattaatttgatatattcctagtatatgttgccatttatttgaatcaatgctccattaggtattccaaaattatctaaaaatcaataatgatcagatttgggttaaatggtaaagtcaacaaacccaaagcattattttgagggttgaggggattggtttctttctttagaattagatagaaggaaaattaatttgcagttaagacattggccccagagtaaagaaggagggcttatttctgctcaggactggtacacatacaagcgtgcatgtgcttgtgagtgtgtgtacatgcatgtgtgtgcttgtgtgggaggtagtggacacacactgaggtccagctgcactgaagcaggtttggagggccctaggaaggcatgggcagaaactgacctgctctctaggggcatgctgattaactaaacttaatgtaagaccatattgtttttaacctcagaaatatttaccagaaaatcagggaccatgacctcctgggacaaaaggaaaacagtcacagcactgaaggcaggagaggaccgagctattctcctgggactggctatgatggtgtgctccatcatgatgtattttctgctgggaatcacactcctgcgctcatacatgcagaggtaataccactgggtgggtgggaccctgctgtttgtctcctgctccatcctcccccatcacttaggcaaccctaaggtcatcttcctcaccttctttcctgataagaactttgagaagttcctggtaaataatacttttcaataatgttatctaataataatgatacatatagctctacgtataatctggatagcaggtgtcaaagacttctacttctttaattatcacaattactctataaggtaagtataaatatactcactataaaaacggcaaaactgaggctcaagagagatatgatttccccagtgtcatacagctcttgcttgtggcagagctaagattcaagcccacatctcgcttattccaaagtcactgttcctgccacttcacacttctgtccgttccccaccctcctcccttttccaccccaaccaacccctccctcaccttccacgtgagtggttctcaactgtatattccaatttccccagaaactcttaaaaatgctaatgcccagcccccatcatcatcaacccagaaggtcagatttaattggtccggagtgggacccagtcaccagtatctattaaagctccccaggttgttctaatgggccttctaggctgagaaacactgctatgcatcaacttttaaaaataacagattttgaatcttttcatttcaatatttgctgtaggtgtattgaatggatagggaggcaaataaattgtgggacagcaagtgtactcctgtcctcagtaagccacgtagtaaatcccaccagcatctctagctaactgttgtccataaattggacactctaaacataggcgagcccagccctgatgtatcgaatgaagtctcacagcagttcagcttaaagaaacaagaccttttcaaatgaaaaattgaggtttcaatccaaaagaaaatgaaaccattttgtggcatttgtttctccatctaaattaatactttcattttagaagcaaaatctagctgaaatacagtaatttgctgaaattaaggcatcatctttcacatttgtggctgctctgctctgtttctatgacggccttcagctgtgctcattttctatgaaagtgctgatgcctcaggccccaagtggtcgttgattccaaaatgctttcagctcttcacatctggttagaaccatcagagactttttcctcagtatataagcaaaatgtgaccacccatgttccaggaaaatacagtttgccacaccaagggaggggatcaggtctagtatcctgcttctggaataaaacttcacacatgcaaaggggcaggaagctgtggatgcctgtccaacaaaaggaaagcgtattaatctgcaaagaaaacatgttttcccattgctatggtgatcagcttatacccaaaaccaaaccatcaattgctggtgtgttaattcctaattacaaatgttaatcttgataataaaattaaaggtatttttaaatgaccagttgaccaatgggcagctggaatccttccaggtgagaggtaacagggcacccttattcatccattagtctgcataaaagggtttcttttccattgtgtttgtggggagacagcaaaacacaatagaatgagcctgggccttagagaattacaagattggatcacaatttccaacacttactgcccatatgtccttgcatatgtcataggatttctcagttcactcacttttaagaagaaattactacccaacttgcacagctgttgagagaacaaaagaaggtaatgtatgtaaattaccaattagggtgaaaggaatgtgcagtaagtgattgctcatgacataatgaaagggttgagttatcttttttcccttattagaaagaccttaaggcattctgtcactgtccttccatctctgtcaagctggaccacatgaccctccactcctttgccatctctcccctccttctccctcacaccttctgtgcctacaaactgggctggggagggagctgggatgcagaaagtacaaagtaaaacatacagaggtaggggctggagcacgtcaagaagctgcctacaatgtagaaatacagggtgaggacaggtgatgattttaaaatatgcctcatgttaccagtgagttccataagggaaaaaagaacttaagtcaagcactggagaataccatatccaatggaagtcattgaaaacgttctcacgtgtccaagtttgtctatgttatacggtagtttgcttaaagctgttctattcgaaggcctaaactttacacagatagatcatattagagatttagaaaagatttttcagcttcaggagatgagaaataattccctcggactatacctttctcactattagctcttgggcctgtgtttactctcactcctttctctgcagcgtgtggaccgaagagtctcaatgcaccttgctgaatgcgtccatcacggaaacatttaactgctccttcagctgtggtccagactgctggaaactttctcagtacccctgcctccaggtgtacgttaacctgacttcttccggggaaaagctcctcctctaccacacagaagagacaataaaaatcaatcagaaggtaggaacttggcgtactgcatttcagttaccccacagagcttcacaccaggctctctgcctctgaagttcccctttgccagcatttcaaaggaaaatacttccaggaagcagagcctgcctcttccattcagagaacttgctatgtgactcttgcctagaaaatatttattttctgtgcaagttgtggacaaatcattcctacatttgtggtagtgcagatttagctttcacttccatttgaaagggtaaatattaatatatctttacacaaatagactgagtctttcaaagcaagtatgcaacttagagatgtacaagacaaaatcatgtgtttgtcctgtacctgggaaccatcaggtaaaggtgtattctgtttgtccatggtcaatgtcatttagttctgtgacctcagggatataacaacctttctgatcctcagcttccttttctctaaaaagtaacaaatggccaccttgcaaggtccttatgaagatgagtcctgagcatgtacaatgttaagcagagcatgctactttcaacccatggtcactgtgagtgtgtgtgtgtgtgtgtgtgtgtgtgtgtgtgttcttcacatatgttatattcatagaggctgaattttccagtccactaagatattcaagtccacatggtagatattcaacgaatgtgtattttattaaagctttacataaaatttacatttataaggtctgggatgaccaggaaggtgtcagcagaaccaacttgccattacaattttaagttaaatatattgagttttggatttgtggtaacaattcgatatgcagaataatctcatatgccaagacaactcgatgccactcttggctcttattaccaggataaacccttctgacctctaatctttcttgtaaaagcttttcttttcattaagttgtcagcacttaaatgatataacttatagttattgaaaaaaatgcagtagattcaaggttcaatactagcacatagagagtgaatgggatttgtttctgataaacccaccttgaacttttgttacaataacttaaaggaattcttgcaaatatctctgaggactcaacataataaatatttcagagaatgttgtttgaaaatgctggctctgattttctttcatttgtagtagccacaaataataccagtcccagcgctgtgctgcagtatgtaaagcctagctctctcacaaagtgcttgtctttcaagatcttcccttaagtcagatcttaaaatcaaagctgaccagtaatgacaaatgcctataaaactcttaaacctgaataggcatcaaaaagtgggacatattttcatttcctcattttgacaatttatcactacagccctgtgaatgcattatttaggctataaacggagagggaagctaccaataaatgtcccagatatgtattcaggactggtaccttatttgctctcagcataatactaggtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtaacccaaaaacaccctacatgccccctctcaataactacaggctctgcctccaccaaagacaactatcctgactgtttatggcaattattttcttacttttctttgtacttttatcacctaaggatatatccttaaacatacatattttgttaatagttttgcctcatttttaagcattatataaatggaatcacatagaatactttcctttctgtctggttttcttcacatagtgttatgtttgttagatttattccatttggttacagttcattcattttcattactgtatcatattccattgtatgagtatgtctgtttgtttactcattctactgctgatggacattttgaattgtctatagtttgggactactacaagtaattctaccatgaatattctcatatatgtctctggtgcacaagcacacacacttccatcgggtataaacctgggaatggaatatttaaatcatagagtatccatatcttaaagttaagtagataatgccaagtagttttccaaaatgtatatgcaaatatacattctcaccaaccctatgggtatgagagttcttactgctccaaatatttgccaacatttggtaatatctgtaattttaatttagctaatgtagtgatatttcctcatgattctgatgactaatgttatcaagtgccttttcatttatttattggccatttgggtatccattttgggcagtgtccgtgcaagttgtttgcccatttttctgtggaattgtttcttctttacattcaatataggaatcatttaaatatgaacctctgttggttatatgtgttgtaaatatcttctcgcattatgtggccttttcactctctgaatgtctttcagtggaagaaacttctaatttcagtgtaaccagattttgtcaatctttttctttctgttcagtgcttttgctgttctgtttaagtcttatgtccaccctaatatcataaagtcattctcctaaatgtcattctaggtgtactattgttttccctttcatgtatacagtaaaatctgactggaattaatttttatatatggatcaagtttcttttttgtttgtttgttttttcatatggacacccacgtgctccagtccatttttgaagagatcacacttttcctcattgaattatttttagaatctcatttcttcctctgttttatcagaagttatctattctgttactattctttttaaagtcagaaaataacagataatggtgaggttgcaaagaaaaaggaacgcctatccacttttggtgggaaagtaaactggttcagccattgtgttcagagaacacaaagcagaactatcattcatcccagcaatcccagtattgggtatataccctgaacaatacaaattgttctgccacaaagacacatgtacatgtatgttcatggcagcagttctcacaatagcaaagatatggaatcaacctaaatgcccatcaacagtggacaggataaagaaaatgtggtacatatacaccatggaataatactacacagtcatgaaaaagaatgagatcatgtcctttgcagcaaccatggatggagctggaggtcatcatgctaagtaaactaacacaggaacagaaaaccaaataccacatattctcacttaaaagtggtagctaaacattgagtacacatggacataatgaatgaaaaagcacacaccaaagcctgcttgagtgtggagggaggaaggagggtgagaatttaaaactacatagggtactatgcttattacctgggtggtgaaataaactgtacaccacgcccctgtgacatgcaatttacctatgtaacaaacctgcacctaaacctaaaataaaacttcacaacttgcaatcttgactaatcaaagacattgaaacattttaactccacttttttattcttttcccaacttatatattatcatttttatgttatgtatacttgaagctcatgtagacattactattgttgttgtatatagtcaatgttaatttacatggatccacatttttccatttttattattcgtattcctttatctctgttcttctatctaggatcatctttactagtatttattttagtgcaatgacacccctaaaaaatgttctcatttttcatttgtctgaaagcatttttcattttattttgcttctggaaggacacattcactgagtataaaattctaagttggctattttttttccattgtcttctggtgagcattgttactattcagaaatcagccctcagtctaactgctgcttctttgaaggtaatcttggccattcaggatcacctcattctgacttcataaactgtgatattcaaatctgaactgaagtccctatgaggacctatctatttcaggctgactattctcccaggatgcagcccttcagaatcccaacccaaagtgaataggggaattatcaagaccccagcttgataggcccacaatcataattcctgctcatagctctgcaaggctgtcaaaaatgccagttagcctcctgggctctcacccctcttccacaatcagcaaatgctcccagggaaaaaaggcaccaaacatttggctcactttcctggcccagtgattctttactttctagaaagctagcctctgcttttaatctgaaatatacacactgaaaatacacaattatctccatgtcaaaaggtcattaaaccatcttcatgcaaaatgaggaatattcaagataattctggcaaaaacataaacaattttcaacgtcaactcccctttcctgttatccttcccaagnnnnnnnnnnnnnnnnnnnntattatgtgccaatacatgcaattatttttatttagcctacttagcattagcatttcccagggcttctttccctgctccttaatattctttgtcaattttagaaaattctgtcattatctcatcaacattgtctgtagtcattctctgcctcttcacctctgggactccagttggccacatacgaggttttctcattgtatcccctacatgtcttatgctcccttttgtttttctccctccttttgtctctctttacttctttctggatacattcctatcttctaattcagcaattctttcctctgctctgcagatcaactgttaaacccatccattgagtccttaatttctcttactgtattttcaattctagaatatccaactgagtcttgttttatcatttctagttctctgcaatattttaattattgtcttttaaatctttcaacataaaaagtaaaattatagtcattataaagtctattttgatatcttcactatttgaagcccatatatacctgttctgtttttgttttctgcttgtttgctttcatgttgtcttataatatctggctatgttttattaggtttctgatattatatttgcaaaatttttataaaaaataacttcaatactaggataatgttacaatgtcatcttttccaaaaattatttccacttacttctgccaggtacaagccattcaggatcacctcattctgacttcataaactgtgatattcaaatctgaactgaagtccctatgaggacctatctatttcaggctgactattctcccaggatgcagcccttcagaatcccaacccaaagtgaataggggaattatcaagaccccagcttgataggcccacaatcataattcctgctcatagctctgcaggctgtcaaaaatgccagttagcctcctgggctctcacccctcttccacaatcagcaaatgctcccagggaaaaaaggcaccaaacatttggctcactttcctggcccagtgattctttactttctagaaagctagcctctgcttttaatctgaaatatacacactgaaaatacacaattatctccatgtcaaaaggtcattaaaccatcttcatgcaaaatgaggaatattcaagataattctggcaaaaacataaacaattttcaacgtcaactccccttcctgttatccttcccaagctcaccaaaaataatggtctccctcacagttaccaagaaatgggcatggttgtattgagatacatcaggcgctactgataataactgtcctaagacaataggaggcgaaaggatattagtcaatctgtctgcaacttggtagaaagcattttatttttacatttttaccctctctcacatagtttttctttagcctttaaacccagtgcccaacctcttgtcaacattatgaccgaagctgcttaagctgataaactgtcatgctctcctggagccactggctgactaatgggctctgggagctacaagagggctcaagggtccctgcctcccttggctacaaggctgtcactagcatcataaaaaacagcagctgagtattaattcactgtggttgttgcttttgaatacctcaatgcccatctccttcaggagtttaaaacctcttttactcaccaggaattcccaaaacatgcccctatgatttgaggttagattaaaaatgtagtttggtgcaaaaaaaggaagctatacccattttttggtatatggcataatactatatatctgttctgatgatgtagaaaaatccaaattcagtttctcctactatactctcacaacacactgctaactctgggtgtgtgtggggcttttccccacacataatgaaggtgagctcagaataataaaataattttcccagagttacacattcactaactaattatgtctgaattaaaatctaagtatttttacttcatcatgcttgctcttaaaagagtaaaacattagagcatccccttgagagaataaagacaagagttctgaaaaatccaaattctatgaattatttatccttctgatagatattttggtgaacaggtgagaatctacaccattccatcctattccaagaggcacttaggatcaagtaagaaacaatgagcaaggaatagaattatctgtgatccataggtaagattaggactgtatattcagcaccagtttatgtagagtggatattaaacagatagaagcttaccctgaaaggggctaaaaaaaaagtgggggcgtggaggaggggaatatgccctgaaatttggcatttgacatcccataattagcatcttaaatgtgagatatttcttagacatttgctgaaactgcctgtagaccatagattcagaaacactttgtgactgacaaagtttagtcactccttaccaaagttgaatctgggacagctgaagagggcacctttgtgtataagtaaaagaaagaatgtgccagaaaaaagctgatactgagcatcaagaagaaaagcgggggaaggaacctagtgcttttcaattgccaagacagagggccatggtgaagattcaaggtcagattagatatcagcctcactttaggactaattggatacatcagaatcctagggattccatggtttaagctctctggatattgtctaatcccaaagcgccgagaagattctatctccttagtcaatttcctaggtctttcaagtttcttctctactccaaatcaagcagaagtgccataatagatatgagatctgtgggcaaatacaggaaaggaaaatctctctgtagtgggacctttgtctcaatactgaaagaaacagtcatgcatagcagtgtgaattctgttttccttttcactactaaatacttggaacggtccacttgccaaaatcaagcagatactagaagttcaaactaaacaagtctaaggtaaatgttgtaggatccactttttaaaaaagtgacagtaaagagcatgaagtctcaaaaggagtgggaagaaatgaagtctcaatttactttctcgactcacctgtttatcactaatgttcaaaaaattcaaaagttcaaaatatatttgtgaatccaaggctaccagctggggaactatacattctttgaacatttgagctatgtcccattctcaagcatagaatgcaaagtctggtacattatatatgcttaataaatatgtgcacaatattcattgtttgggaacactagaaaaagttccattgactttggaactaataatatttatgtttcacatgagcaatgtttttttttccatttttggtttttgtttgtttgtttgtttgtttacttcatggacattgtagactaggacctggttactaaggagtttttacagtacatgtgtggcccacctctatgatggtacagtctttactgaaaggctttttagccacattctcaattcatttcatcacccatctgtgtttttttctgtttcgctatacattctatattgtttatgtttttgtcacctatatataacatgctacatggtatattggagccaacaaatatcgcatggattttatcaaatttctaaccccatttcaagaataagacaattccctctttataaaaaggcaaatgaagaacacacctttcccttgaagtgatctgagaaatggatagctcccttcctaccatcacaaggaaaaggaggctgacagtgaggttattcagccaaaaacactttcttactgcctcctcccttccccacatcttttatttttaagatgaaggcatgtcactcttcgcttcacacaagcctagtgaggcatgtctgaaaaaaagcccaacaggtaattctcaaaacttctgtccatcatgacaataaaaataactgttctgaaagattctggaagagaggctaaggaaaaaaaaatttagtcagttccccaaaaattggagagaagatgcaattgctggaccttcattgcccatgtaagggaaaggatgatcagaagacattgacaggacccaaggtttttcagctgggaaaggaaagagcgtgatcatgggtccatccctgtggttttcagtactaaagagaagtttctgtctgtcaagaatctaaggattgggaaaagcagtaagattttattaacaaaactcagtattaagagagatgtaagtctaaatcttccactgaatggctgcttcagaggtttgatagatttatatagtcacatgttaaagcacaaaagaaagaatgacctatagccatggtaaaatattaacatattttttatcagtactaaaatatattgtatatataaaattattactcatatattctttctgttaaatatcatacagattctaaaagctaaatcttccctttcccacacctcccaccaaaaaagagagatctaaaaatgatggatgtttattttttctatctaaattacattttccaactaagtgtatatctcacttagtaaagttttgtttattgaaatgcattctatgtattcaaaaccaaagacataaaaataccctctgaacacatgataaaatcataagataactaaatcttcactctaaattcacacctgcctaagaaacatactcatggctatcatttgagccacagaaacaaaaacctaggctcctagtgtagaattcagcacaatgcaaatctcctaagacaaaaaggcaagggacatgagatgacagccattaaacaggactgcttctgtgaaaaccatgcagctagtaattttctcatcttagagatttcatagtttattatgtgatgcttgattgacgacttttagatgatcatgtggacaaatgtgaaattccaatagaaaaacatgttaatgaaaatttattgaggctttatgtatattcatcacttaatcctcacaaaaaaaaccctgccatgaaggctctattaaccccattatatagattcaaaaaaattgattctgagaggccacataacttgcctacagtcacacagtaaccagatctcctgagcacaagttaggagcttgttatactactcatatattcatgatcaccaaaggacttatcaataataaaagtacatgactgattgacaaatagtagaattttcattttcagggacagttaatggtctagtgacagctggtttatatgtatgttgaaaaatgacaagatgagaaagagctaaaaacaccagggcagaggaccttttctccactggtatctgtctgttgctcatatgtgtaccattggccctgaggtcccacaatcaatcaagtatggaccatgcctcatccatccagcccacatgcatgcaatgaaagcccaatggctttcaactttaattaccagctcctgtattacagttctgccagatgttctcagtggtcgtttatatgaagaatcttacctagtgacagaattattgccatttttctgacaaatgtttctttaaaaatctatatttttaagctgaatcaattcacaaaagcataagaaaaggaaaaacttcactttcaatggaatgccatttttactgagatcatttcaataacttagcactgttcaccactgaaattgctactataaactatcttggcacaaaaatatacagatacctgaagcattcataatctaaattggcttggtttaaattcaaccagaaatggtttgtctgttattttttaaatgctttggttcaaaaaacatctctaaaaatgttaaagaaatgatcagggcatctttgaagatgtccatttttgaaggacaaaaataaaggtattcccacactgccttacacccttttgatccagaggcatctaactggtaggaaatttgcttcatggcagtcaaagtccagttttcatactaaattataactgattgaaaaattctgctttcttggtgataactttcacccccttaatgccttgctagtaccaggggattctctgctctactcacctatacaaatgtattcacatttattcttagctggttaaattttaaggtgtcaaccagaccttgctacaagaacagcacattaaacgtggtttacgataaatgccagcatgctcatcctccattcttaactaatcaaagaaacttcctgctgtttatagtcaaataattcaatgactacagctcagccaaaaaaaaaaaaagcaaggtgcctgtgtgcccactgataaagtcatgggaaagagtaattcaaatatatttcattagccaaaactctttgttttttaaatactttgttcctgggaaatctactggtctaaatttttctgaaatttcaggcttctaccccaaaacctatatcaatgtacctcaaagttcacccgcttccttatctgtgtctctgcatatagtcatggaggttgtgcattgcacagaggtaccaatcacattgtaaaagtcatatatgtgaatatttatagttacaatgcaaaaattggtaaatgacagtaagacgtgagttttataaaaaaaataagtttattaggataattttccaactgaaaattataatgttttgaagaaggagcacagtgtttcaactcacactaaaacactgtatagataagcagtgattctgtcagaaaccaatttaattctgataaatcagataagttaatcatttgattacataaggggcaggacagtaaaaagtctattgagaggttcttaccaatagagaagagagttaaccaaaaacccaaacatctcccagaaaagtgatttaaatcacttttttccaaacttaaaaaaaaaaaaccctcattattatatcagttttgtcatggcacatttataaaccaaggaaaataagtcacagagatttcctcagagatagcttttttacttaaaaatgtgtccaactatatctaacataaaataaaaagaaaaactacaaaaaagtgatttaattccatctgtatctagataagaaagaggagaaagggaagtgtgaacaggaagaggaacagagagaaagatttaaagccaggtgggggttgagggaagggcaaggaaggaggagatacaaaagaaaacaaaatccaaagatacaagtgtgtattaatctgttttcacactgctagaaagaacaactgagactgggtaatttataaaagtaaaaggtttagttgactcatggttctgcatggctggggaggcatcaggaagcttacaatcatgatggaaggcaaaggggaagcaaggcatgtcttttcatactggcaggagagacagcatgagggccagggggctgccagacacttttaaaccatcacatctcatgagaactcactcattatcatgagaacagcatggggaagccacctccatgatccagtcacctcccaccaggtccttccctgacacgtggaaattacgatttgagatgagacttgggtggagacacagagccaaaccatatcattctgccccggctcttcccaaatctcatgtcctttatacatttcaaaaccaatcatgccttcccaacagtcccccaaagtcttaaatcattccagcattaactcaaaattccaagtccaaagtctcatctgagataaggtaaatcccttccgcctataagcctgtaaaatcaaaagcaagttagttacttccaagatacaatgggggtacaggcaatgggtaaacagacccattccaagtgggagaaattggctaaaacaaagggaccacaggccccatacaagtccaaaacctggacaggcagtcattaaatcttaaagttccaaaataatctcctttgactccatgtctcacattcggggcacactgatgcaagagatgggttcccaaggccttgggcagcttcaccctgtggtgtggttctgcaggatacagcccctgcagttgctttcccgggctggctctgagtgcctgcagcttttctaggcacacagtgcaagctgtcggtggatctatccttctggggtctgaaggacagcggccctcttctcacagctccactaggcagtgccccagtggggattctgtgtgggaactccaaccccatatttcccttctgcattgccctagcagaggttctccatgaggtctccacccctacatcagaattctgcctggacacccaggcatttctatctatcctctgaaatctaggtggaagttccaaaaccttaactcttttgcacacctgcagtcccaacaacacctggaagctgccaaggcttggggcttgcaccctctgaagcaatggcctgagctgtacattgaccccttatagccacagctggagcagctggaaaacagggcaccaagtctcaaggctgcacagagcagcagggccctaggccatttttccctccaatgcctccaggcctgtgatgggaagagctgctacaaaaatctctgacatacctagagacattttccccattgtgttggctattaacattcagctcctccttacttatgccaatttctgcaggaagcttgaatttctccccagaaaatgggtttttcttttctaccaacatggtcaggctgcacattttccaaatttttatgcttttaaacataagctccaatttcaaatcatctctttgtgaatgcatgtaactgcacatttcaagaaaagccaggtcacctcttgaatgctttgctggttagaaatttcttctgtcagatatcctaattcatttctctcaagttcaaagttccacatatttctatggcagggacaaaatgctgctaatctctttgctaaagcatggtaagtgcaacctttgctccagttcccagtaagttactcatctccatctgaaactacctcattccagacttctttctccatatcactatcatcattttgctcaaaaccattcaacaaatctctaggaagttccaaattatccttcatcttcctgtcctcttctgagtgctccaaactgttccaacttctgcctgttacccagttccaaagtggcttccacattttcaagttatctttatagcaattccccactggcctggtaccaattctctgtattagcctattttcacactgttataaagatactacctgagactgggtaatttataaatgaaaaaggtttaattaactcacagttccacatggatgggaaggcctcagggaacttacagtcatggcagaaaatgaaggagaagcaaggcacatcttctcatggtggcaagcaagagagagaacatgagagaagaactgtcaaacagttttaaaccatcaaatctcatgagaacttactcactgtcataagaaaagcatgggggaaactgcccccatgatccaatcacctcccaccaggtccctctcctgatacatggtattacaattcaagtgagatttgggtggagacacagagccaaaccatatcaaagtgtgtagaaatacagagcggagagacatgtaaaagaggtagccaaagaaaagagaggtgaaaagatcaaaagaaaggtagcataagttctcaggtgagtggtgattaaagaactgttttattcttccttggcttataggaaaagctgttttatttttccttggcttataggaaaagctactttggcacactaaatgggtctgacccactcatctcagctctttattcaatattcctacatattacagatttctttttcagtaattcaacagaagtgtagctgtttttttatgacagttgcaaagtaaccaaataaaatgaagccaagataaaaagataagagtatactactttccctgagagaactggtaagtttttatgttatgtggacagatgtggacagacaaaatgatggcagagttgacattctgattccataaagaagtatgttcaatagaaaataattaaaacctaccatacctagctatggcaaaaagaatcctgggaatcatttaatttattttacgcatgcaacatggaatgattaaatcaagctaattaacatatctatcattttatttcaatcaataaataatatatgggtgagcaatcaagggacatcttggtcagataccttaaaacattgttttaatcaatgtgttatttattagggtttccaaaggcaccagtttgaatatgaaaagaataaccaccatggttatttcacagatcactaatttggacacaatactccaccccctcctagagtctcaaacacacatagtatcttctagtaacagtttatcttattctccacagtgctcctatatacctaaatgtggaaaaaattttgaagaatccatgtccctggtgaatgttgtcatggaaaacttcaggaagtatcaacacttctcctgctattctgacccagaaggaaaccagaaagagtgttatcctaaccaaactctacagttcccaacgtgctgttccattcactcttctggccaacctgtatgatggctggggggtgtggcaattgttgccatggtgaaacttacacagtacctctccctactatgtgagaggatccaacgggatcaataggataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaatctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaattttttttaaaaaaatctattaaattgcaagatttgaatacttcttgcattctgagctgacaagcccatggtagtccaaaaatttgtatttcaatacctttaaaaatattttgagtgattacaaagaaagtttctttttttaacacccaaacacatacacataatgctgtgaccatttgaaaaataggatgaaaaactcttttatttctactctactttaaaacatataattctgaagatactaaagaaatatttgagactatagagctgaaaatgtgcagtctttaatgttccttaggcttcccttcgagtgatccaagggtgaaatatatgtgagtgaaattatcagatgggttactttatttttacttaattctgaattttcattaaaaattcccaaataatgtttaagataacaatgtagaaatttttaaataatgacaccaaaaagagattaactgctgccttctagaatcccaacatagcaacagccccttcaagaaatttagatatatatacaattaatgctcattattaaaagagaaagatctgggactaataatgttttaaatgctttgcacatgttaactaatttcattatttaacaactctgttgggcgaggtattattattatctcatcctacagatgagaatgttgaagctcagagatgttaaataatttccccaaggctatgcacatactaagatggtgaagagctaaaaacacagtc

SEQ ID NO: 17046 - DNA, 7289 bp, Human
cacccatcctcaggacgtcccccagcatgggtctgtgggggccaaaggaaaacttcccctttgccttctgaaggtttgctgaaaaatcaactgatgaaaggcagattaatagaataaattgattcatttatattttagagacaaggtcttgctctgtccagagaggctgaagtacagtttcatgatcagagctcactgcacctttgaactcctgggctcaagcaatcctcctgcctcggctttaacaggaaatatttattaacatacatgagagagaaccacaaagtgattaccccaacccctcagtgggatacagaagcttatccaccatcttgagtttatacaaatatgggggctcagatagtggcaagacaggttatggaagggagggaagaggaggcctggttggcaaagggagtcttgttaggtagatgacacctcacaggtagcagccctcagaaagaactgagggtaaatgtttctttcagatctgtaaaggtgtcagcctctcagttaatctttcctagagttagacaagggagagcctcggagaaagcctggctacatcaatgcagatttcctctacagatgcaaatctctccacaaaaagacagctttttggttattctatttccaaccattctgaacagccaccttgaaatgtgtcaaagaagtattttttggggtgaaatattttggtttccttcaagttcttgggctgggaaacatctttgggtgcatcttttctctctaaccccatctaaagctttcagggaacacggatcccatctctttctgcttaagggcggctgagtagctcacagctggggagtgaagtaccctaagtagtggtgggatttcagacacctggaagtggttaatggaagccgagtttctttctggtgcccccagagcacactgtaaaggaaattctcagctctaagtggagaatcctggttaggggtgcgtaagtaggggacaaaagccttgtgctcggcactggacatcagttgcttttcatgtttcttcatttaatcctcaaaacaactccttaagacagagtttctgatccccatcttacagataaagaaacagaagttcagagagagccatgaagttacatgagatcctctacttcaggtgatccctgcggtgtgggaaccagaggcatggtgttggtggttactgacgtgcaaagtctcagagcttcttcatccttgctccagcgtacccaggagtcgagccggtatttggacagttttccttgagtttctgctcaccttatgaattccatcatgccgttctgccacacccgaaggctcccccactccccatgagaatctatcccacggagaatggggcacgaggaatggtcaggaaaggcagatgcaggatacacactggacatctttgctgtcgatcaaggttgcaggcgccagagtcctccctaaaggagagaccttccttctcagtgtggctcagggagtgggaggcaggatcaggtgtagggacctcgaggtctcatttggtttgagaatgtctgtatttaggggaagaaatcccaggatgagtgtctcagggacgctggggaatggtcccccgtaaaggacccaagacagggcagccctgcctgggtaggagtggggcacagaaagtccttgggggagcagagcagcggagaagaggcccgggccggccgaggctgcggaatgctcaggcccgagccagagggaggtgggaccgagggctgcgcgcctgggcgagccgcctgcagccgcggccagggtcagggtcatgagggctggatcgaggggaaggaggggggtgggatggggagggagggcgcgggagggcatcccgccccagaggccggtcccactggggaggggaggagccagagttgctggagggggtccaggaggtgggggtgggaggaggtgggggccgccccgcgagaagaagagcgggaagaggcggacagcgaggccaagatttcagctgcgggacggtcaggggagacctccaggcgcagggaaggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaaggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacggtgagtagcatggcccgggcaggagcggggagggtcgtaccccaggagaccagcgcattcccacgaagggggacagaagtgcttgggctctgagccccagccctttggagaaaaggccactgtccagcctgctggaatgtgactgcgtgagggaggtgcggatcacaccagggcttgctctgcaccctcagctggctaccggccatcctctgcctgcctgtctgtccgcagcccttcccagctggaatatttgtgaggctggaatttaagctgcagcagacaagctgccggaagagggactggaagaaacccgagtgcaaagtcaggcccaatggggtgagtgaaggggtgtgagagcaatgggcgcatgctgggtgtgagtgcatggacttggggtttggggtgtggggcacatgcctgggtgtgcatgcatgaattgggaggtccattaagaagccctgaggttagagaccccactgcgaagagcctccttagaggtggagtggctcagcctgagcccaaggttgtgagagtggctggtgggagctggggcctggcagacaggaagatggtttggttacccctggacttatcttcatcagagcagggctcacctcggtctgagttcctctctcaagcatcagggcctgggtggaaggagccggctgtgtgggtgtgtctggtgcccccctagcctagcaggactccagtcatcagtcacggtgggggcaaaccttccaccgtgggggtgatgcctgggctgggagtgcagtgactgtgttctagttcccgctctgtgagcacggcctgggctctgtattacaggttctgcaaaggccccagttccctctgtcggctcaaggagggcactggactatagcaatgattcatcaacctcaaaatcaaatcttacaagaaaataaatagaataggtgacagctgagccactctggaggcgttgggtgggaagaacccatcggaggaggattcttgccttcacacgagcacaagcagacacatccatgcatacatcacacacccatccacccacactcctgcatacaaaccacatacatgcgtgtttatgcatgtgccacacaacccatctgggaaggactcctgcctgcacacacatgaaagttccatagtttgaaaactgcatgggtctgacttctgacattctagggtggctgtgcctgaaacctgctggcctgcatgacctcttgctcctgggctcgagggcctagttggggatctggtcccatgatgggcagccctggctcccaccctcatgatgcccaggcctccctcacccttttcctctgctcaccccatgctccccgctcccccacagaggaaacggaaatgcctggcctgcatcaaactgggctctgaggacaaagttctgggccggttggtccactgccccatagagacccaagttctgcgggtaagaaggggcaagggtgcacaggtggtgacagggctgggaagatggatggaagctgagcctatgggctggtctcgaggctaaagcttggccaagcaggagggagggcagtgggggctagaaagcgctgtgcctgtttggacattctccaagggatgtggaggggatgtggaggatgctggcagccctccactggcactgcccacccctcctacactgcctgaacagttttgggcactggcaggaggctgaggagcaccaggagacccagtgcctcagggtgcagcgggctggtgaggacccccacagcttctacttccctggacagttcgccttctccaaggccctgccccgcagctaagccagcactggtaggcaccagggggctgagagcaccgtctggatgaggccagccctgggaatgctgaggggctgggctgggctttgggagcctgggaggggacaggtcagaagcctgggaggaaagctgggactggggctgaagcaacctccctcacccccaaacctgtttccccttttgtctagagatgcgtggtgcctccaggaccgctgcgggtggtaaccagtggaagaccccagcccccagggagaggaacccgttctatccccagccatgataataaagctgctctcccagctgcctctcagctccttgtgttgcacgacttcctccttagcgtagctcagaggcggccagagagggcagggggacaggacccttcctctgggaccccttcctgtgggcagggtgagcagagcctcctgtgctccagagccagaggtgcccccatgaaatgccaggcagggatgcaaatgaaaacagaagcatttaatagatgtgtggacaagaacgggcagagaaggtgctgcggggagggggtaagtgcaggagcagtctggagaggcacatttgcaaggcaggggagtcccacttccaggagtgctctgggccactcagcctgcctactgtctcccaacagctgagacgggaggctggcccatccctacctttctcgcctgtagcctcaggaggaagtaattccttccactaagttgcaggctggagcagcccagagtggcagcagctgcggacacaggctcacggatgtgggagcccttacacctgctcacagcccttcagtctgtccttgcagcatgtggagggatggtggggaggggctgctctcaggatagggataaagcaatagcccagtgtgcagggccagtgaccagtgtgaagcaactaagacgagtgtgggggcagagaggggaactgggggcagcgaggccacctgccaggctgtcctgggccataggccacgttcagaagacgaaggaagaggtggggcccgcagagctgagtacctgctccgcctgggccaggctgtcgctggcctggcggtccaggtcccagcactcctgcagtgtgtcctggaactgccggcaggcctcctccaggatggagctgctccggctgggccaggactcccagtagcctggctccacccagggctgggcctcggtggctctggggcctggactggagctgggacgcaaggagctgtccaggtctcggcacagctggtagaactcactaccacgcccaatcacacgctcaccgtcgatgactttcaggccaggcagcagctcccggactgcagcccagtaggaggggttggcacagagcgggttgctgagccgggccaaagggtctcggagccgcaggtactccaggcacggtagcccagccagacactgcagctggcccggggtggccagtaggttgcctgcggcattgagactctgcaagttctcacaggtggccagtggctccaggcccgtcagccgattgttggagacattgagcacagctagctggcgcaaggaggccagcgggcccaggtgggtgagcgcgttgcctgataggtccagccactccaggcccaggcactctcccaggcagcccaggtcagccagtcccaagccacgcagcttcagtagcaggatggactccagggagaactcgcctgtgcgtgacttcagcagctggggtgtgatctgcagtccgccagcctctcccggcttctccgctggagggtccatgagatggaagtcggttgggatggcctgggccctggcaggactgtcacagggttccactgggggtcagctggtgctcgccctggctctacccaggccagtgccaggaggcctggttccgatgccctgctcgaagccagccagtccctgaggagagacagtcagtcagcaggcagcactttctgtgtcttacgcagcaggtgacggcagggagtctgaccctgcttttaccatgaaaaccaacaatctcagccaggcaagacctgaagaccaagctgggacacaggccacaaaagccatctgagtgacagggatggggtgcaggcccaacccaaggggagcagcccagactggccctggctggttagggccatgctggatggattcaggcccaatattaccagttcttcctgtcaaatccaaactaggggcaaaacattattttactttttccgtaaccactcacgatccatccctattagttttggggtgttttttaaaccgttatttttgaataggcaataggtaaccaccat

SEQ ID NO: 17047 - DNA, 14516 bp, Human
tgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctgaggtgtatttgagactctggtcctttggccacagccctatgaggaaacggggtgtggggggagtttgggggtggggaggaatttggcaccagctgcccccaggccgctaggctgggggaggccactgggagtccagtgcaacccaaccttccgcccactgggtgccgccgcgttctgccttctctaagtgtccttccatctggaactcactctggcttagtgaaaggggcctcatccctgacccccaccagcttatgaaggcttcatctcagggaactctggaccccccatttctccctccgtccatctcccctttatcacgtttctttctttcttctctgtgtccccctctttcagagtctcccgtcccccactgccagtctccctgccccctagtcgctgtctcgctcctccgccgctgtctcctgtccagcctgcctgggctgtggcccagccgctctgcctggctggcctccctggctccccctctgcggctctgagctagccccacccccggcccccctccatccagcctctgatccatctgtggactccgaggtcgggtgcccgtcacacggcccctgggaccaaggacagactacagcccctcagcacccacagaggcttcccctcagccctagccgaggagcccccagcggagggcatgggggtgggccgccccaacaggtacgtgcctccatgcaaggcaccgctgagccatcccctcctgctctgctgcgtcgcccccatccacccctgccccagcatccctgtcctcagcttgtccccttcaagaaggccttgtcttcccatcagtgacaggctcagcgccaggagaatccacccccaggttcagtgcctccaactctcaccccatccccattttatgcattttctcactggcttccatcctttcagagaaaccctctcagtctgtctgtctctgtctctgtctctctcccccatctctgtctctcccatctctctctgcctctctctgtcttcacaatttcatctccccatgtcgccatttcttaaaacatttcttttctccttttcgttttcccaattgccctgtccgcctctatcttctctgtccccctccatctaggtctctgtccccccctctctctgggtctctgtccccctctgtctctgagtctctatcctctcaaggtctctgttcccctctctctgggtctctgtcctctctcaaggtctctgtccctttctctctggatcaatgtccctttcctgctgccctctctgggtctctgtccccctctctctcagggtccctgtcctgcttggtccctgtactttttcttggggcaccctctcaacacccctcctcctgcctatctctgcatctctttgtctttctgtagtctctgctttccaacctgctgtccagcccccaccagtaggtggggagtggtggggaacacccctggtttcggaagagtgagagtgttgatttgggagggtgagggtggggcctgggggcggggcttcttggcctcagattagacagtgactttgacacgaagttgaagcaccttaagccctgtatctcctttatatggaaacattaagctgctctcgcaggtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaaggtgagcagtggggtctgagagtccagtgggggctgtgggcatgtcgggagctcatcacgaggcctcgtacataccaggtgtgtttgaaaccagagtgctcttgagaagactgtggtttgtcactcgggccgtggctcccaggaggcctgggtgggaggctagcttttgccactcctctccccactggctgagagacctgcgacaagggactaacctcagccccagttggcttttctgtgaaaagccaggtcccttcatcaaagggctttggtgagagatgggcaagtgggggtgagaggcccaggctggggcctggggagcacaggtcagtgtcagtgcccacctgcccccccagcccacgggggtggttcctgagggtggagtcagtgctgagtggggatccccaggctggggagggctgcaggtgtagatgctgcatcctgatgttgacctccaggccgcccccttgggcaacgagcctatttcccctttttgggagaacagtctctaacatgcagggttgtcaggggtgagatagagtcaaggttggggtacactgtgggcactggacacagccaggctggtcccctcacctcagccttgcctctgtcaagtgggcctaatgaaccctcgcgaatggccaggctgcctgcgtggttgtgggaagcaggtgcagggctttgggagacccagttggtgccaaacttgacattgtctcatggtcttctttccaaatggagtgtgccaggccctgccaagaagcccctgaggatccccaggttccagcacaaattatttaacccctggaatggtttgtcctgatccagccagttcctgggaagttccccaccacagggccaagcgtttggtaacgttgcagtgaaccctgaaggcaatgaggggtgcgggtccatgcccagccctttcctttggtccaccctgacaggctgctgcgattccctccatttcttttcttcctttattttttatttttaattatttatttattttttagagacagggttttgctgtcttccccaggctggttctcaaacccctggcctcacgcattcctcctgagttggactcccaaagtgctaggattacaggtgtgagccaccgcacctgccctcttttttttttttttttctttaagagatagggtcttgctctgttgcccaggctgcagtgcagtggtagagcatcatagctcactgcagccttgaactctgggctcaagtgatcccccacctcagtctccacagtagctgcatcaccatggctggatactttttgtttttaagatagggtctcgccatgttccctaagctggtttcagactcccgggttccaacagtcctcccaccttggcctcccagagtgctgggattacaggtgtgagccaccatgcccagcccccaggcctcctgcctttcacagatgagagctgaggctcaggaaaggatttgacctgtcatccatcacacacctagtaaatggttgagcaaactgagtctctggaaaaagaagccagagatcccaggggacatggtgggtgagcaactaagccaggactgggccctcatccatatggtaagaaggcccttcctggtcttttaagaagtcccaatttccccaccttacaatggaggaaaccgagactcagaaagagttgccaaagatcagagggtcgggcatgaggcccatttcatttattttacaatagcttcattgaaatctaattcacatatcatatcatacactcactacagggtacaattcaatggcttttagtgtattcacaattgtgcagccatcacaattaattttttttttttaaatggagtcttgctttgtcgcccaagctcgagtgcactcgtgcactctcagctcactgcaacctccacctcccgggttcaagtgattctcccacctcagcctcccgagtagctgggattacaggtgcgcgcctgtaatcaccatacccggctaatttttgttatttttagtggagacggggtttcaccatgttggccaagctggtctcgaactcctgacctcaaatgatctgcctaccttggcctcccaaagtcctgggattacaggtgcgagccaccgcacctggccagcataatgttttcaaggtttatccatgttgttgcatctatcgatacttcatttctctttattgtcaaatactattcattggatgaatataccacattttatttattcattagttggttgatacttgggtttccaccttttggctattatgagtaatgctgctgtgaacatttgtgtaccagtttttgcatctgttttcatttctcttgggtacataagtaggagtgcaattgctgggtgatgtggtaattctatgtttaaccatttaagtaactgccagactgcttcctacagcagctgcaatttttcattccccacagcagtgtatgaggatgccaatttctccacattctcgccaacacttgttttttttattatagccattctaagtgggtgcaaaatggtattcctttgtgcttttgatttgcatttctctgatggctaatgatgttgagcatcttttcatatgtttatgagccatttgtataccttctttggagaaacgtctgtacagatcctttgcctactttttttgtgcctcagcctccagagtagctgggactacagatgtgcaccaccaggcccggctaatttttggatttttaatagagacgggattttgccatgttggccaggctggtctcaaactcctgagctcaagtgatccagcttcctcggcctcgcaaagtgttaggattacaggcgtgagctgctgtgcctggccccctttgcccacttttaaattgggttatttggcactagcccacatcgtgaaaccctgtctctactaaaaatacaaaaattagctgggatggtggcatgagcctgtaattccagatactcaggaggctgaggcaagagaatctcttgtacccaggaggtggaggttgcagtgagctgagattgcgccactgcactccagcctgggccactgagtgagactccgtctcaaaaaaaaaaaaaaaaaaaaaaaaagccgggggtggtggctcacgcctgtaatcccagcactttgggaggccgagacaggcggatcacgaggtcaggagatcgagaccatcctggctaacatggtgaaaccccgtctctactaaaaatacaaaaaaaattagccgggcgtagtggcaggcgcctgtagtcccagcctcgggaggctgaggcaggagaatggcgtgaacccaggaggcggagcttgcagtgagccgagatggcgccactgcactccagcctgggcaactaagcaagactccgtctccaaaaaaaaaaaaaaaaaaaaagtttggggggtgttacttatcttttcatgattgagttgcaagggctctttatatagtctagatacaagttcctcatcaggtatatgatttgcaactacagtatcttctcccattagtgggttgtcttttccctttcttaaaaagcttttttgagacatggtcttgctctgtcgcccaggctagagtgcagtggtacagtcgtaactcactgcagcctcaaactcctgggcttaagcaatcctcccacctcaaccttccaagtaactaggactacaggtttgcattaccacatctggctaattttttaatttttttgtagagcaagccccttgctatgttgtccaggctggtcatgaactcctgggctcaaatgatcctcctgcttcagcctcccaaagcgctaggatacaggtgtgtaccacctcgcctggcctctcttcactttcttgatagtgtctttcggagcacaaaagttttttagttctggccgggtgcagtggctcacgcctgtaatcccagtactttaggaggccaaggcaggaggatcacttgaggtcaggagttcaagaccagcctggccaacatggtgaaaccccatctccactaaaaatacaaaagttagccaggcgtggtggcatgtgcctgtaatcctggctgctcgggaggctgaggcaggagaacccaggagacagagattgcagtgagccaagatcgcgctactgcactccagtctaggtgacaaagtgagagtccatctcaaaaaaaaaaaaaaagttatttagttctgatgcaattcaattgatggattttttccttttgttactttgtgagcctgtttttgaaccacagctgacctcagagccctgaggcatctctccatgctgagaagcagttacaccttacgattatgagcatggaccctggagctggatggctagcattcaaatcccagtttacttacctgtggtcttggggaagttttatttattttttttttttgagacagagtttcactcttgttgtccaggctggagtgcaatggcacgatctcggctcaccgcaacctccacctcccaggttcaagcgattctcctgcctcagcctccctagtagctgggattacaggcatgtgccaccatgcccggctaattttgtatttttagtagagatggggtttctccatgttggtcaggctggtctcgaactcctgacctcaggtgatccgcccgcctcggcctcccaaagtgctgggattacaggcatgaaccaccacacccggcagtcttggggaagttgcttaaactttctgtgcttcagtttcctcatctagaaaatggggataatgatgtctgcctcataggcttgctctgaggttcaaatatgtaaattcatgtaaagtacttacaacaacctccaaattgtataaacagtataattgatagaacacaaattatgaattcagtacatagatttagcactgtataaatgcatgctgtaattattgtggcacttgctataatatcgttattgttatagtattttccgttgttgttgtacaagtatcttctatagtattgttgctgtttatcttccaacttggaaggtgagtatgggccaggtggggtggctcaggcctgtaatcccagcacttgggaggttgaggagggaagatcgcttgaggccaggagtttgagaccagcctgggcaacatagtgaggcccctgtctctataatataaaaattaaattaaaaaaaaaatttaaaaaagaaggtggctggccaggcgcggtggctcacgcctgtaatcccagcactttgggaggccaaagcaggcggatcacgaggtcaggagatcgagaccatcttggccaacatggtgaaaccccatctctacttaaattacaaaaacttagctaggcatggtggcccgtgcctgtaatcccagctacttgggaggctgaggcaggcgaatcacttgaacctgggaggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaaattacccaggagtggtggtgtgcacctgtagtaatcccagctactcaggaggttgagacaggagaatcgcttaaacttgggacgcggagattgcagtaagccaggatcatgccactgcactccagcttgggcgacagagcgagactctgtctccaaaaaaaaaaaaaaaaaaaaaatgcgtatcgttccacctatttgacagatgaggccactaagccccaccagaaagcatgcttggccgatgagctcatccattcctgttgcccctgacgtttctgccggtttcttgtcccagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcaggtgcgcccgggaggagaggcggggacttccgtgagccctgggggattgtgggagatgtaggcccgagggcgaggggcgtgcggtcctggagggggcgtggactacaactcccagcagcctcttgggcctggggcctgcgaatgggtcactgggcagctggggatgtaaacccaacagaaaggtatgtgaccagctcttcctggaggcctggatttggggcatacagagcttcctgtggcttgaggattgcccgcctgtgggtagaccccaaaagggccacgcctggcctgtcaaggctctgggccgtaattcccagaagcctctgggtcaagggacctgtccaaagatggggtggcctcagatgcagctttgcgagggggtggtggagggcctgcgtgaccgttctattactcgggtgtacaattcccactggacactgtggcacagtcggaggcctgtgacttgaggcccccgggagaagcaggccctggaatgggtgcagctcatcgctgtggagcacagttctccaggcctctaggtgtggggtcctgcggcatctgtgggagaattcattccccacctcagtggcccattgtgtcccaccagcctcctaacctctgagagcagggtggaggtggcaacgaaacgaaactgcacctcccattggcccctggggtactggctccctccctgccctgaggaaggggccttagcgttcctagaattgtggtcaaattgctcaaacatctccgttcccaagaaactctgggccggcagctgccgtggcccaagtaaagtgactttaggactctgggctgaggctggacttggagaggatcgggggtggtgggagctgcaactcccagccgcctctggggttcctctacttggggcttccagagacacttacaagaggaggatagatgcccacctcccacttcaatctcctgcctgaagctttgagataccaggattcatgaataggagggacactggctcttgcagaagtcggtggggcagtgacttggcctgggaggtggctatggaaccagcgggtaggcgggggtgaaatacccacacccccacaaagcgtgctcacacacagaatgacatggaagggtttgcagttgccctgacagctaggatagctcaggggagagcccagggataagcctgaggcagtggtgggtgcagaatgttggacctaggttgccctaactcccccttcttgtcatctgatttatctttctctggccacatactaaaagccatttttctctcccgctccttctccaattctctgttgaatgtcatccttattttccgttgtcgctttgatttcatctctgtcttgctgatttctgtgtctctatgccaatatcactctgtccctctctcctcttcccccaccacgcccctcttcccgttttctacccccaaaccctgagtctctttcctctctctttatctctgggtctctgtcccatgtcccatgttttctctggacctccatcctcccctcctgggtctctggctcccttactgggtttctgtgccctcccctgcctctctgacttcctctctctctgggttgccggccccatctcttgatctgtgttctcacccttttcttcactcctgtggtctttgccttctttctctgcatctcttcctctctctcacttcgtctctgcccgtctctgtgctccctgctgtctttggctcctcgcctcctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattgttagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccagggctggtgagtctagaatgctctggaaccctacacctagtgatgtgtgtctatttctttttctttttcttttttttttttttttgagactgagtctcgctctgccgcccaggctggagtgcaatggcgtgatctcagctcactgcaacctccgcctcccggcttcaagtgtttctcctgcctcagtctcctgagtcgctgggattacaggcatgagccactatgcctggctaatttttgtatttttagtagagacggggtttcgccatgttggcgaggttggtcttgaactcccgacctcagatgatccacctgcctcggtctcccaaagtgctgggattacgggtgtgagccaccatgcccagccgtgtgtctgtttcttaaagatattatacatatgtatattatatatatgtaatataaatacagatatctatctattttttcccttggtccctacaacaggcttagagatggagtgctagctaattggaatgaggtccttttcaaggaccccagaagctttgctctaaatcccaatgctgccccaacttactgtgtcactttggactcctcttcatgtcagtttccccatctgtaaaaacgggatattggaacttgaagttcttcaggggcctttccagcaggatgagtcctcactacaccaagggtgggatgggcattcgagtcctggggatttccctcctctccccagtgctggatcatacggccttccaggagacgctgggatgtaagatactcttggaggctggctctgaactcgggtgtctgaatcacagggcaagggtaggcgtgggctgtggctaacagccagagtcacttccctggcctagcttggggacctggggaggaggaggtagctctggacaccagggttcttcccattgtgggagagtgagtgttttagggggagacctgtcccccagattaaagaactgggagccctagcggatgtgtctgcgaatgtgtttctcgagcatgggtcctccgacctggccccctgcccatgctaccatctacctaagtgccccgcaggctgggagccaactgcagagggagccagtgacagtgaggaggacgtgttcccaccccgtgttctggaccgagggcagccactgtcattgccattcagccttcacaagtgctgcatcaacccaaatgccccctccagcttctccatctccctttatccctcagaatccccatgtaataaccggatgggattaattagctggctgctctctcagctcagggtgtctggggtaggtagggatgggggcaatggaaacgcagggttggggaaggatgttaagttggaagtgaaggggcagggagggggtttcgtttgaaaggagtatgggagcagggcagcccagcctgggtttccactggggagggcagggcctgggccactcataaaggtcagtgaggggattaggagcctccatgtctaatccgacagcttaactaggtcctggccctgaatccgtctccacctgcccagcccagggacagcaaatgaggacgaggcccagacaccacttcagcccccattacggcttccctctttacaggggtgcctgggttccctattccagccagtcccttgaccacattccgttacaaataatgggacatagaggctggggaaggggaaggggaaggggcctcagaggagggaggagtttaagaagggcaagggtggctgggcacggtggctcacgcctatgggcacggtggctcacgcctagcactttgggaggctgaggcgggtggatcacctgaggtcaggagtttgagaccagcctggccaacatggcgaaaccccgtctctactaaaaatacaaaaattagccgggcatggtggtgggcgcctataatcccagctccttgggaggctgaggtaggagtatcgcgtcaaccttgtgggtggaggttgcagtgagctgagatcatgccagttcattccagactgggcaaaagagcaaa

SEQ ID NO: 17048 - DNA, 5046 bp, Human
gcagtaagccagcctgggcaataagagtaagaccctgtctctaataataataataataataataataataataaataaaataaataaattattagactatagtctccctgttgtattatcaagtagtagattattcattctttctatttttttggggcccattaaccatccccacctctctcccactgcttcactacccttcccagactctggaaaccatcctcctattctatatttccatgagttcaattgttttgatttttatatcccacaaataagtgagaaaatacactgtttgcctttctgtgcctggcttatttcacttaacataatgactttcagttccatccatgttgttgcaaatgacaggatttcattcttttttatggctgaatagtactgcactgtgtatagtactacattttctttattcattcacctgtggatggacactttaggttgtttccaaatcttggttattgtgaacagtgttgtaacaaacatgggggtgtagatgcctctttcacatattggttttctttcttttggatatatacctagcagtggattgttggatcatatggtagctctgtttttagttttttggggaatctccaaactattatccatagtggctgtacaattaataatttacatgcccaccaagagtgtatgagggttcccttttctccacatccctagcattttttatcacctgccttttggatataagccattttaactggggtgaggtgaaatctcattgtagtttttatttgcatttctctgatgataaatgacgttgagcatcttttcatatgcctgcttgccatttgtatgtcttcttttgagaaatgtctattcaaatcttttgcttattttttgatcagattattagatttttttcatatagagttgtttgagttccttatatattctgattattaatcccgtgtcagatgggtagtttgcaaatattttctcccactctgtggattgtctcttcactttgattgtttcctttgctgtgcagaagctttttaatttgatgtgatcccatttgttcatttttgctttggttgtctgtgcttgtagggtattactcaagaaatgtttgcccagaccaatgttctggagagtttctttaatgttttcttgtagtagtttcatagttcaaggtcttagatttaagtctttaatccatttttatttcatttttgtatacgatgagagaggggtttaatttctttccctgcatatggatatccagttttcccagcaccatttattgaagagactgtcttttccccagtgtgtagtcttgacaccttcattgaaaatgagttcactataaatgtatagatttgtttctgggttatctttctgttcctttggtctatgtgtctgtttttatgccagtactatgctgttttgtttactatagctgtgtaacataatttgaagtcaggtaatgtgattcctccagttttgttctttttgcttagaatagctttgagtatcctgggtcttttgtggttctatataaattttaggattgttttttctatttatgtgaagactgttattggtatttccatagagattgcattgaatctgtagattactttgggtattatggacattttaacaatattgattcttccaatccatgaacatggaatatctttccatttttttggtgtccttttcaattgctttcatcagtgttttataattttcattagagagatctttcacttctttggttaattcctaggtatttagtttcatttgtggccattgcaaatgagattacttttttattttgttttcagattgttcactgttagcatatagaaatgctactgatttttgtatgttgattttgtatactgcaactttactgaattgttaatcagttctaatagttttttggtaaaatctttaggttttcccaaatataagattatatcatctgcaaacaagaataatttgactttgctttccgcgctacctgcagaggggtccatacggcgctgttctggattcccgttgtaacttaaagggaaactttcacaatgtccggagcccttgatgtcctgcaaatgagggaggaggatgtccttaagttccttgcagcaggaacccacttaggtggcaccaatcttgacttccagatggaacagtacatctatgaaaggaaaagtgatggcatctatatcataaatctgaagaggacctgggagaagcttctgctggcagctcatgctattgttgccattgaaaaccctgctgatgtcagtgttatatcctccaggaatactggccagacggctgtgctgaagtttgctgctgccactggagccactccaattgctgggcgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagcttactcagtgggtttgatgtggtggatgctggctcgggaagttctgtgcatgcttggcaccatttcctgtgaacacccatgggaggtcatgcctgatctgtacttctacagagatcctgaagagattgaaaaagaagagcaggctgctgctgaaaaggcagtgaccaaggaggaatttcagggtgaatggactgctccagctcctgagttcactgctattcagcctgaggttgcagactggtctgaaggtgtacaggtgccctctgtgcctattcagcaattccctactgaagactggagctctcagcctgccatggaagactggtctgcagctcccactgctcaggccactgaatgggtaggagcaaccactgactggtcttaagctgttcttgcataggctcttaagcagcatggaaaaatggttgatggaaaataagcatcagtttctaaaaaaaaaaaaagaataatttgacttcttcctttccaatttggatgctcgttatttctttctcttgtctgattactctagctatgactcccagtactacgttgaataacagtggtgacactgagcatccttgtcatgttccagatattagaggaaaggctttcagtttttctccattcactatgatactagctgtgggtttatcatatatggttttattatgttcagatatgtttcttctatacccagttttttgagggtaaaatatattgtagaaatgaagaaaatgaatgccttagatgttaaagaatttgagtgcaaagtgctgtggcccttgtatcagatataatcctttattttaggagctttattcatttagtcagtgattattatttgtttttatatgctatgcactgtttcaggggttataaccttgaacaaggctcaatctatgctcttttttttttaatcttaaagacaagatcttgctctgtcacccgagctggagtgcagtgatgtgatcacacctcactgcaaccttgaactcctgggttcaagggatcttcccacctcagcctcctgagtagctgggactacagatgcatgccactgtgtccagctaattttttgtttgtttgtttgttttgttgcccaggctggtcttgaactcttgggctcaatggatcttactgccttggccacttaaagtgttgggattaaaagcatgagccactgtgctcggccccactctgtgctctcaattagtttgtaattagtggggaattgagatttgcttaaaaaggtaattacaagattttgattacatggtgattaatgccacataatgataagatagggtgcaatggaagcattattctagtcttgggagtgaagaaatgcttcttaaataaagtgattaagttaagaaaataagaataacatacatgagttatttactgaataataccagcatgctgtggataatgttaaattgggaggtagggaccataaatacattgtgttctaagatgggctgatatagccagagaagtcttcagagacaagatttgatttaaattagatcttgcccaattgatgaatataatttttatatgattgtgattaaagacagggagagaacatcccaggtagaagtttcaatacgtgtgaaaggctgggtgcggtggctcatgcctgtaatcctggcactttaggaggctgaggcaggtggatcaactgaggtcaggagtttgcactttgcattaggtgctagggacccaataatgaatcaaatctggtcccagtacagcaaatcatagtttatagtattataaggagaccggtctaaataaagcagaggtttaatcctggggagtagtgggaaatctgaagagatagagtggggccacctgtattttgactaatgtcttgggagttcagatttgaagtcactaactttttttatagcagaagtacatttcctggctaatatgatagaaggattgcaataggggaaagagcagctcttgtaggcacagggaagtgacaaagcaggctagaaaataggctaatttttgtgttcgttctccctcaccactgcaagtatactggcttagcaggtctgagttgcaagtgccttctgacttgtctccctaattacagcttcttgtccactcaaatctagttgacgcactgctgccacggtatattcatgaaacaacatctagattctcatctgactaagaaatcttcaatgaatctctttttattaaactaataagcatttgttgagggtctttctccatatctatctatctatctatctatctatctatctatctatctatagataagtggtaagttttaggaatcaaagcaaaataaagtaacagaaaataacaaagatggtgcttttcttggataaggttttgagggttacttttccaaataagaagaaacttgagttaagacttgattggagggagagcttttgaggcttaatagcaagggaaaa

SEQ ID NO: 17049 - DNA, 44971 bp, Human
  misc_feature (1)...(44971): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttggaagccagtgtggacaccctgtgatctgtgcgtacacatgtgacacgtgcatgcacacccacagacaggaacacagagacacatttggaagccagtgtggacgccctgtgatctgtgcccacacacatcacacgtgcatacacacccacagacaggaacacagagacacatttggaagccagtgtggatgccctgtgatctgtgtgtacacgtgacacgtgcgtacacacccacatacaggaacacagccacatttggaagccagtgcagacgccctgtgatctgtgtgtacacatgtgacacgtgcgtgcacactcacagacaggaacacagagacgcatttggaagccagtgtggacatcctgtggtctgcgcgtacacatgtgacaggtacgtgcacgcccacatacaggaacacacagaggcctttggaagccagcatgggcagacaggccctatcccaaagcggccggcaggcgtctcctaagaatggttctcggacacacctctgaaaggaaaatacaactcggcaccgcagttgactcggccaaaggaaaaaaacttaagctgaaagctgaggcctgcccgaaggagcctttcctgtggcgcctgagccgagggcttcagggagagggccgcgcatcgcagcgcagctgcccgtcttcccgtggcttccctacggccgcggctcccgctgctcctttccgccggccacgcgggtcgcacgaccttcccctcccgcccaccctgaggcgctgaagccctcgacgccggcctcgggaaaggcgcggccaccgcccgtttcggattcccgtttccttcctccaggcgcgtccttcaccgtggccaaatcagcctctcaactgctggagcccggcctcggacacttctcggcttacgccgccatacagtggcgcaccccgaaaccccggaaccgacagctcggctggccttgcgcacccacactctccaaggcagggctcggtccgggggctggttttgccaaggcgaggggcgaggggcagcccaggcggccggatggataccaagagggcgcgtcagctccggcgggacggggcttccaggacccgggaggggtccaggactccccgccggcgcctggctgtcggcggagggccgcggggcaggagggagtggagactgcggccccagttcgggcagcgcggagcccacccaacgccctcctcggccctcggctcttcctggggccatcccgcccctgcacctcggcctggcacctttccggttagcctcggaggccgtggccgagcagggtgcgttcgcctggctggggggcctcagaacgttatttccgggtgacaacctgcagggccttccgcccctcgcgacctctcgggagtcccttccccggcgcccccccggggctgcaggggctgcaggttcggtctcggggcctccttaccgcagtccgcccggctttaggctagtgggctttaactacgtcgataatatgactccggcgatcttgtgcggcgatgggatgcggccgtgggcggtggagtccaggcggagtccgctctccacacgcgagggcgcctcctcctcaccgctcgccggcttcaaagctcgcgcctcaggcgacggcagccaacgggttgccggctggaggccccgccgacgccccgccccttgcgtgcccacccgcgccccgcagccccgcccccagcgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttctttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaagtgggtaatttaactttttcggagtcccaccaaccatcctgagtaaatattctggaatttgtcaacaagaatagaaccatcatcaaagccttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctctggaccctatgggtctggacccctaattaccttgccttaacggtcatacgtggtctggaagaaatctcagtggtcatttaacccagcaaactaactcttcccactttgcacatatgtgctcttggagaagagtcagtcaatcctgtggattgctgatgttgcaaattggcaggtaccaacctggttaggtcctgagcaggcccagcagctctcttcttcaccctagctgtgcagtagccttctatgtcacccctgcttccttctctctgaacacatggtcttgttgcttcctccacagggaaggtagaagccattagatcctaactttatgtcctcctctcctgtccctcaatctattgctcacctgtgaaaatgcttacctgtgtctatatttatctgtacctctttccttactgctttagaagaagaggctctgtcctgtccaagaataatcactctgtcttgtgtatactttcaagtctttaattatttactgtatctttgaccccttccttttctgatggcttttcttttgagcttgaaaacatgtttaaataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatccagtaactccagccctgtaactttcatgcatgtttctttcccgagcttcagacctgtatgttaaactgcccactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatcttgtccctccattctcttaaaatatttcagttgactcactatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttggtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagcagtttataaaacatttaaaaattaaaaatacaaatcttcatatatggttttgttatattaactttgagaaattactaaatagcacaaagtaagtcctgtagtaattaacagttgtagaatggattttgtaaaaccataattttatcaatgaaaacgttaaactttatattttgtagttgtttttagggtaaacacatgacacttaaatttttttttttttaacagaacaaaactcctttagttaatgagagcctgaaaaagtttttaaataccaaagacggtaagatgttcagtttgttcttgtttatctatctctgaatttttgaatcttgataccatttgggagaaatcaggaatttcagggctttttttttgtcttcaattgttataggtcctcattttaaaataatattttattgtacaacaatcgtgttgctattacatatttttggatttgggatgttgttgcttaaagccagttttactacaaaaagccaatattaaccattaaaaagcgaaacactgaaatctatgagatgattgtcttacagttagttacagactgatgatcccagtgaaaaaatcaggagattgagattttcattacttaatcatattattcaaagaggaaatttgtaacttaaaaaatttagaaacctttcttccattaatttagtgtatctatttcataatgttaatttaaaaaattcagtttttgaagatttgcttacttacctttttcttgatctttataggtcgtttagtggctagtcttgttgcagaatttcttcagttttttaaccttgactttactttggctgtttttcaacctgaaactagcacagtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagattgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtgcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctgcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctcaagagtgttgggtcatgagctaaactgtctggaacaaatcccaactcctcgttgcctcacttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagaacgcaggttgtcacttcagcttgtgcatataatttcattccttcatttatcaatatccagcaagcttttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccaggttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccgaggtgggcgaatcatgaagtcaagagatggagaccatcctggccaacatggtgaaaccccatctctactaaaaatagaaaaattagctgggcgcggtggtgtgtgcctgtagtcccagctacttgggaggctgaggcagaatcacttgaacccagtaggtggcggtggcagtgaggcgaggtcgtgccaccgcactccagcctggcgacagagcgagactccatctcaaaaaaaagaaaaaaagaaaatatttggataaaatacaacaaaagaatgcaaatatagtagaaaactatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttctattactttggaagaaaacctgttgtttataatgaaataaaaaattagagcttttattagcttttgactttgactgtagaaaactagctataggttaagctcactgaactaaattactgatgctttttaccaaaactgcattttaaccacctcaagaatcaggttgctgtgccccacccgctttaacctgacttttgtttggttttattggatgctcccaagccgtagataattaaagccctttcttgttttctgagcccctcaatggatcattttcatctccttcagcacctctaccatgtaggtccttatatctgtccaggatcatttcttcctaaaggttctcatgctttcagtctgtcattcactgttgcagaattatttttaaacttcagcccttcctctgttcctttcttctgtacgattgtagtgactgcactgccgactcaggagtcccagattcttcagcccttatgaaatgttctgtgtgatgtggccttaacctgtctttctagccttatgtgttttttttttttttaatgtggaaccttgtacttaagtcagattgaactttggacttactacttgaaagtggcttgtgttttttcgccttctcttatttcgttattctatcctccacttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagacggagtcttgctctgttgcccaggctggagtgcagcggcaagatctcaactcactgctgcaagctccacctcccaggttcacgacattcttctgcctcagcctcccgagtagctgggactacaggcagccaccaccacacccggctaattttttttatttttttatttttagtagagacggggtttcaccgtgttagccaggatggtctcaatctctgacctcgtgatccacccgccttggcctcccaaattgctgggattacaggtgtgaaccaccgtgcccagctggcatagtgatttttaacatactgttcacagtcagtggaagcctttgaaaatttgaagaggaatacccatttagaagatttgtggaggttagattggtaaaatatggagaagttagcagactagaaagaagtgaaacacataagaaggcaaatctagacaagaatggtagcagtaagaatagaaataagtggacatacaggctagacatggtggctcacacctgtaattccagcactttgggaggccgaggcaggcggatcacttgaggccaggagtttgagaccagcctggccaacctagtgaaaccccgtctctattaaaaatataaaaattaatgttgggcgcggtggctcatgcctgtaatcccagcgctttgggaggccaaggcgggtggatcacctgaggtcaggagtacgagaccagcctggccaacatggtggaactccatctctaccaaaatacaaaaaattggccaggtgcggtggctcaaacctgtaatcccacattgggaggctgaggcgggcggatcatttgagaccagcctggccaacatagtgaaaccctctgtctactaaaaccacaaaaattagctgggcatggtggtgtgcacctgtagtcccagctactcgggagggcgaggcaggagaattgcttgaacctgggaggtggaggttgtggtgagccaagattgcgcctctgcactccacagagcgagactctgtctcaaaaaaaaaaaaaaaaaaaaaaaaaaatacaaggaattagctgggcgtggtactcgggaggttgaggcaagagaatcgcttgaacccggcagtcggaggttgcagtaagccaagatctcgccattgcactctaacctggacaacaagaatgaaactccgtctcaaaaaaaaaaaaaaaaaaaagttagttgggtgcggtggtgcattcctataatcccagctacttgagaggctgaggtgggaggatcacttgaatctgggaggcggagattgcagtgagccgagatcgcaccactgcactccagcctgggtaacagagtgagaccctgtttcaaaaaaaagaaaaataaaagaaagaaagaaatgaatagataaagatgaccttttgagaatcaacaagacttggtaaactaatattttggcatggggcaaggtcacagaaggcaataagagaaaagaaaagctctcaaaggccagtttaaggattttagcctagaagataatatcaccaacagaaatagtgggactgaagagggagaactgaagttatgaagaacagcacattttcgtatttaaaaagttacagtcagtcataaagggatttttgtaacaaacagccagtatttactatgtacagtgtcctagagcttgtgctggtagtggatgaattgtaggaagtgattttcatttaagaaacattttaaaaacctcctccttggcattaaccacagtgctcagaaccctgtggtgacagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggacagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaatattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaatgaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacgcaacctttaggaaccagctttgtgtgctcctgagaaaggtcagatgaggtcaggacaagtcttcaaggaagttgcctaggaactcaagtgaggcttatttagaatgccgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcagtttttatccaggtgaaaatcatactgttgaatcttaaaaccatgctctcagttttactttgaaaattcctgttgtgttggcaattagagttgaaaatacgtatttttcttttgaatggatgattatatacatattagtaacattgtgatttttatttgaggaaaatagaacatcaaactatttttttgaatacgtacctattgataaattaaaaattaaacgtatttcctccaagatgtttttgtgttctgtcatttttcagacaattgcacatttgtgatcctttattcagtgcccctgctcacagtagactgctgggggccagtgctgcatactaccaaggccttggctgctttttcatcctctcctaaagatcacaaaaattgactaatccagtagattagctgcttatgaaatttaaatattagaagttttagaaacattatcagtacagtttttacatgtacttaggataagacaaaatatttaattttcagttctgtgagattcattagtcctatgctgaactttggttatgtatagattttttcactaggttgaaaatcttcaaacttaaagctttttaaaaattccacctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttagagacaaggtctcactctgtcacctaggctggagtgcagtggtgtgatcatggctcacaccacttgtcctcctggggtcaagtgcccacttcagcctcttgggtagctaggacaacaggtgcatgccagcacagctggctaattttttaaaaaatgttttcatgtagaggcaggggtctcactatggttgtccattctgatcctcaactgtggggctcaagtgatcctcctgcctcggcctcccaaagtgctgggattacaggcatgagccaccgtgcctggcccagttttcaggtattttaaaactaacatgtattgagatgctttttcacattacgtgtaggttttggggcatatgtttttgtatctttggcagtcacctgaggattttccaaaccaggcgttaccattccctgtcacactctcacaccatcctgaatgaatggatacatggatgcatgaatgttcccacacttagccctgtagtaaaattacttctctaaataattcattagtaagtcatggatcagaaactgtcgttggcagggagagaggtggggggcagaggcatgggtgaagagaattttaaatacagtcagcctcatatctggaggtttcatatgcattgctttcacacctgcagattcagtcgtatgtaaatggaaaaatggttataaaaaataataatacaaattttatttattatttatttatttatttatttttttatttttttgagatggagtctctctctgtcgcccaggctggagtgcagtggcacgatctcggctcactgcaagctccgcctcccgggttcacgggaggctcctgcctcagcctcctgagtagctgggattacaggcgcccaccaccaagcccggctaattttttgtatttttagtagagacggggtttcactgtgttagctaggatggtcttgatctcctgacctcgtgatccacctgccttgggctcccaaagtgctgggattacaggtgtgagccaccgcgcctggccaataatgatacaaattttaaaataatggtatacaactgtctacatagcattacatttattaggtattacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttctcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactccagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacacccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacgcatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaagagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccgtgtatggtggctcacggctcacacctgtaatcccagcactttgggaggccgaggcgggtggatcacttgaggtcagaagttcgagaccagcgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaagaaaaaaaaatggagttaataattttggactacattccagattccttgtttcagttgagtgctttttctattattccacgggtattttacacaatactgctctctttagtacgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatacgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacaaaggttgcacacacacaaacaggtttgattatgctcatgagacttcttttattattgaaaatatcttaaagttttatctcaccaaggaggccttttctctttccctctctttctagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggcttaaaaataagataaatgttttcattttatagttaaaaaataatgaactatggaaggtttataattattggatccataaatctgactatgcgttgttaatgcctttcatgttgtaaaacaatcccagattttagaaaaacctagacatgatttattccaacaagtaagtgtagattgagtgtcagccacttgccagggctgttccagggtggggtgcagcaatgatagaagagggaagactcctgccctcaggaagctcatgctctggtgacagagtcaggcaatgagggttatgctgcagcgtgtggggtgatgagagcagagcagtgatgggagcccgagtgtgtggtcagggcaggtgcatgtcagctgtccaaattggagggggcctcacttggaggtgcccagtgagcaaagagctagaggaggtaagggagttgccgtgggttgatggagctttggggagaggaaacagacagcagggaggcgagttgggggtagcagagagagcaagatggggatcggatgaggtggactcagagatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtggggtgtgggagactacagaggatcaccaaggaagcaggacctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcagttttaaaggtccccttgaggttagtggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttctgaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaaggaacctaggaagcaagcaggaagtctggcctcgctctcggatgcaccccccttaaaaagtggactcagctccctggcgggagccccttctttaaaagactctgagagtaagtgcccaaagatgtggacttcaatactcgggatattttttctctaattaaatactatgtgattattgttgattttttttcccaggaaaatcactaaaataacctatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaatgacttgagttggatttgctttcaattaatttttaaaaatttggtgataccacagtaagtatcataaaatgttaaataaaaaattattctgcagatcattttcaagaacagtgacctgacatgtcatcgtaaatgcagcagagctaaagagcactggttacacatggaatagtctagctctggcaccagttactttcccacctctccccacacacagtgataggaatttaaaaagcatagccctgaacatgtaggatgggcagaggtcctttggaaaccgtatcatagtaaatgttgtatttaattagcgtagtgtttcagagcacgtgtacctcttttgagaaagtttcctaaagtagattcactaagaatttgcagtatgcgttttgcataattgtccagtatttccgaatctttttgtattgcttgatatactgtgggacttcctagggcacataagagagccggcctgttgcttctcttaaaccagccatgtatttataatgtccgcatcccttcccatttgcttctttcccgtggttactgccacctttaagaaaggaatccaggacatcatgaacatgtcattctgacattgattagagaatgatcatttagagaggacgttgagaacaaaggactaaaaaaccagtgaggatgtcactttagtaagtgaaatagcagttgcactgaagaaaaatttagaaattcaaaggaaaaataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgttgatcgttttaaagtgattatttttagggtaaggctgtaaaagaagtgactccgtctgcctacgctgagcaccttcctgctgctgctcattcagcaggtgtttgaatggcttttacgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtagatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcaatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacacatggaagcattggaagagcttcacaggcaggttagggagaaagaaaggtgtgtccccatgtgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatctcagtggctaactgccaccagagactttactcctgacctctgcaccgtgatggccgccctgtcccctttgtgttctgtttttttcacttttgtggtgtttcactctgttgccaaaccttttagcttttttctctgactgctctattctcttaccaaagcgagggttttccctcctgtttctgagtggggagctgccgagaattgtcatcctcaggagggaatgtcgttgctggggctgcagagttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtgataagtgcttggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcagcactcagaaagttctggatttcattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaactacaaagaaccttcttaagcatgggggagattataaagaaccttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcagtgtccacctctgctctcctcactggccttcacacataggaacactacaatgggtccttggaggctgacattttagtagctgccactcctggttttacttagcgcttgcaaaccagccacatatgtagtttgtttaatcagatttccacttctccttcttggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcctcccaagtagctggattacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcatgccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaaatttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggccaagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattaattttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttgagacagagtctcactctgttgcccacgctggagtgcagtggtgcgatctgggctcactgcaacctccttctcccgggttcaagccattctcctgcctcagcttcccatgtagctgggcttataggtgcgtgccactacgcctggctaatttttgtatttttggtagagacagggttttgtcgtgttggccaggctggtctcgaactcctgacctcgtgatccacccacctgggcctcccaaagtgctgggattacagacgagaaccaccatgccctgtcgattcctttcttatacacagaaagataatatgtaatgtagaagtaatatttgttgtggatatgattcgaaattttaaattagatgcctgagaattttatttaattgacaggttatctttccaattggaagtctgtatttttttttataatttattatacagtttttgagaaagagcatgatgtagtagatgaaattgtaaaaatctgggtttgtttctttcttgctattgtgaccaaagtcactgctttgaacctttgtctcctcatctgttacattgacttgactgctgctgcccttgctacattattttaagggtcaagcaagacaatatgtatgaaattaattatagttaatattatattttacttaaaggattaaaagaaatatctgaatgtttaaagaatagtaatctctttaaatgtttattttcagagttcttatttttttttccccttctgaaattagtaccagccatcgctcagagaaaagtgagataagtattggtgaagagatagaagaagacctttctgtggaaatagatgacatcaataccagtgataaggtatggtgttctgcatttcccatagagtgctttttttttttaacctatttgtcgatttactgtaaagcttcaaaattcatactaattagtagaaaaacagttgaaaattatgaaaagtcatgacagagacctggctcgagtttataaagaatgtctttgatgaatgtgtaagattggttttggttgtcacttcctttggtatgcaagtctcgctgctgaaatgcctgaggattattcctggggcactgggattgctgtggattaagagggatcagggtgggtcaggcttagtgagaattgaccacctggtgccataggtggaagtcagtatagggtactgtgatcacaggaggaagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacatggtgggattctccaagcgctgtgattgtcacacagggagaaggcctttgagagaggtagcgtttacaatgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggattttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctaatactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacatgtcagtgctgccctgattccagagcttcactggagggtgctgtgtgaagagacagaatgttgggaggagcagggttgttagaaggtgactttgaaccagaaatgacagaggatgaactaggagcagaggccctggggagggtagtctctgcacgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtacgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacctaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggccgtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattcatagagtgatacttcctgtgaacagaatcatacattgggactatgctcaggtaaagaagtttaatacagtttttcactaatttgtttcttagattaaattggaataatggctaagatgtgttttattttaaattttcacttgaaatatttgagaataatcataaaacattgggctctaaagattgtactaacttagtagacatgattttaggcaaatcgcttctcaacacagctttaaatatgagttggtttatgaagtataaagtaatactttacagcaacagtttttttaatttttagttttttatttcttatttccataggttttgggggaacaggtggtgtttggttgcatgaatgagttctttagtggtgatttgtgagattttggtgcacccatcaccctagcagtacacaccgggcccaatttgagccttttatccctcaccctcctctcattctttctctggagtccccaaagtccattgtatcattcttatgccattgcatcctcataacttagctcctgcttattaatgggaagatgtgatgtttggttttccattcctgagttacttcacttagaataatggtctccagttccatccaggttgctgcaaattccattattttgttactttttttttttgagtcggagtctcgctctgtcacccaagctggagtgcagtggtgcaatttcggctcactccaacctctgcctcctgggttcaagcgattctcccgcctcagcctcccaagtagctgggactacaggcacccgctatattgtctggctaatttttgtatttttgtagagacagggtttcaccatgttggccaggctggtcttgaactcctgacctcaggtgatccgcctgcctcagcttcccaaagggttgggattgcaggcatgagccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcaccgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttattcagtaccaaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaa

SEQ ID NO: 17050 - DNA, 103988 bp, Human
tgagccaccttgcccggcccgcaatgttttttctttctttccttctttctttctttattttattttttttttgagacggagtctcgctctattgcccaggctggagtggtgcagtggcgcgatctcggctcactgcaagctccgcctcccgggttcacgccattctcctgccttagtcttccaagtagctaggactacaggcgcctgccaccacgcccggctaattttttgtatttttagtagagacggggttgcaccgtgttagccaggatggcctcgatctcctgacctcgtgatccacccacctcggcctcccaaagtgctgggattacaggcgtgagccaccccacccggtctttttttttttcttttttgccggcccgcaatgttttcttaaactttttatttttagctatcctgttgaggttcttccagatgaattttagcctctgacccaggggtatgatttgataggcgtggagttctggttacttcttaaatgaagagtttccccaggatatctgaacaattctcttgggtggaagactcaaggatcatgaaaacgaaaaccaaattctagtcggctcctaaagtccttttgcctcctgcggttaccatcaaagagctatggtcaaaattccaagggataattcagggtctgattccactatatatccccagaccgcctatacataaatccatattattggagatttacgcttaatcctataatcttttacctaacagctgtccagtagaattttctggatgtccaataaggtagccgcgtgtagctcttgaacacttgaaatgtggctagtcccctagaggaacgggattaatttaaatttacatagctacaactacttatcggtcactgcggtaattgttaagactggttttgcctgtaacttgcatatgttttattggacatcagtttcaatatttcatttgcattgctaaaagtcaaaatccttttgactttgccagttactcagtgagaggacagttggagccagtttctgttctaggcttacagttttaaggacagataaaggttagtttttaacctcgagatgaacagactgttaagtttctacggacttgcccatggggttccacagtgagcctgggccggggaggcaggtactgtgtcagggggaagaaaaaaggggcttctagctgggcaggtgacacacagggcataggaagaggtcagttcttgtggccgaggaggtccggcccgggggtcccaggagcagagatctcccttctcttcgatgtggaaagtgaggagggagcagagccttgctcagaaacggagctcccccaatcccccaccgccctagctactggactggaactaggatggacacgaatgtccttctcattgtactaactgcactcaacaagcgggaaagatgaagcgagggggtttaaatgtgtgcgtttgttgaatgacccacaaaaactgaaggagcgcggccggactgatcacactccttgagacaaagcgggtgggagacccagaggtgaggagggtggtcgcctgtgggcgaggactgggaggccaggggttctcggcgaggcggtcccaggaggcggcgcggagccgctgcgaggccgcagggccgggtcgcaagatggccgggccggcctcccgcgcgggtcgcgcgggccacgcgggcgggtttcagatgttccgggcccgggtaggggctggcaggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaaggtgcctggcgggccgggccttcctctgggacccgcgggaaacggccttcggctgggcggcggctcggggcggagggaggctggggccgggctgcgcccaccctaggagggctcggaggggtgtagacagagccgggcggcagcctccgagagcagccacccggacccggcgttttctgctgcacctggtcaggtgcctggccgtcagtgccaagttccctcccgaagggttcagggtgcagtggggacttcttctcccaccgccccgaagggcccggatccctgtctttttttctctttaagaaacgactcgggggaagccatcgggggtggtgtgagcagggagtcgactcttccaagtaagatatttaagattagatctttcttgacgtccgccccccacccttttttaggacgtataccatgtgccttttgacccgctttctctagatcattgcaagtcactgctattactggaataaacttagtatgaacaagtcagataaatccattatatgatgtttaaaataagtttacggagctcttgacagggtaatggtattttattttccctttggttataaagacttggagaatgacgttttctgattcatatgtgtacctgcgttagatttctgttgttgttataagaacaaaatgtaaagggctctttgctctctaaatcttgtagagttttaggttatagttgtttctccctttaaactaagaagatggattacacataaccactaatttatgtgctgcttttattcagccgtaagtcttaggcacaacccttctctctgagattaacaatcggtttgaaagcgctattttgtaagaagggaatagacttagaccagctgtgttagtggcctctggatgcaggggttagcgtgacagtggggaaaattattaagatacttttcttctttttcattttggtattagaaggagaaaggcaactaatactagtgacgggaatacatttttaaaaggtgaaacgccttattgcatgttcagggagggggaagaattttagtgtataacttaggtttcccccctctctccccaaatcagcctcataaatgttaattatctgtactacataattataatgggatttttgagatttatctgcttagcatttgtatgctatcgttagaggtttaactgaattgttcatctaactgacattatcccctgaacagctaaattattgtgaccatttaaatgtgtcttcatattattagtgtatagcctataagaagtatatagccctctcttaagattcagagtgtacttaacataaccttttttgaggaatcaaggtcattatgtacattaatttctgtactgtgctgttaatatggccggtgcgttctgctgtataaagttgttagcagtttcgtcctgtactaaaatgacttcgcaatgctataccagttcagtgttttgtttgcttttagtttctctctccagtactgttttctgtcaaaatatgcccttaactgctttctaatctgctacgtcttagctgaagtaggcagggaaaccagataagccagaactgtgggtcaagtcagaataaataggatcttagtgaagcttagtgcagccctcaggaatctcacaatcaaatcaccattgtgccatgtaatttccaccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggaaggcccatataggcagatcactgaggtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaagcaggggctggtttattgctacgcatgcttattattaaataaacactgtcatcatatcctgcaggatgcaaatttgttctttaccaaaattaattaccgaatattgtgtacttttaagactgctcttaaataaatgaaatagaaataatttcaggtccttagaatgtatggatttctctcctatataaaaacttcggcataagagcttgaccacagcatttgtggcttcatgatgacttatggtgcttttttcagggttttccagagtttgaaatagttgaagaaaatgaggtgtcacgtgtgcatagctaaggtccattgtaacgggtactaaaccctggtctgatgctatcttgtttagtcacagctgtctgcatttattcacagcttgaaagctttttcagaggtgataccacaccccagctatttttgtttctgtcatttcctgttaactttaaagtgtacctaattgttctatttgagcaaattttggagaagagtgggtatgtgggagaggtttgtattttaggtgtcctttaaatagcagctttcttaaattgaaggatgtggctgggcgtggtggctcacacctgtaatgccagctacttgggaggctgaggcaggagaatcgcttgaacccaggaggcagaggctatagtgagccaagattgtgccactgtactgtagcctgggcgacaagagtgaaactcagtctcaagccaaaaaaaaaaaaaaaactcatctgtaaaatagggttaataataccttccctgtcaagcctgggtcatgcaagtgacataaagcatgtgaaaaggtcaagttaaggtagtactttgagacatgataataggttggtaatagatcgcttactacagaagtagttagtagagatatcattaacatttgaaaatatcagaaagtatgtgaaattataagctacaaaactgttcctagtcaggtgaatacctattctacagcataatggatatgtgggtgaaatctcgtcggtaacaatgtgaagagatcagcacagttctgtctggtactccctaggcagcagatttcttctctatctgttgaaggtgtttattttatgtttaaaccttcttatgattttactcattcattaaatgtttattgagtgccatctgcaatgtaccctagtaggttgctcattcatttcttctttgctttaaaagtagcatttctgtgagcctttagagcagtttatatgcactggggcaccataactggtatctaagccagagaactaggcacccaaatgattaaattgtgatattctgtctgctttatttttttttctagtttccacgttccttttcctgtttaaggacatgttttttctttgacagtgatttttataaaagcagtttatttccctggaatgaatcttttcagaagcaacaaggaaatttcagtaggaattacatgacaaatatagagaatccattgtcttattttgttactttatggccagatggggtttaacagaaaagtcagatttctttttagtaaggtgctgatacatttctccctttctcttagaattcaaatatattgtgtattcacagagtactgtaccatttttaccacacatggcaggctactgtttctttaatatcgtggcactgggaatattgtgcttatggctttcttaaaatattttaatattagtgtggacaaaaattgctatttctacaaatataccctaaacccgatttcaatctctggtacctatacttcatttctttccacaactctcccccgactctcccttttttatatccataatggatttaccgagggtttaaaattttttctcttaaatataagcttaatcctgctacttatacaatttgaaaatcagaaagggaagaaaagaaagacttcatattccttcccagcagaaataactgcttttaatacctttgtgtgtttccatctgcaggtatattttgaattcaaaggaaaatggatcacacatattaaagcttttgttatgcaaatatttcatattattttaacataaatattgtaattttacctaaatatttccataatggtttcaatcagcatggaaatggttttagagtgcttatattaatattttggttctttatattttcagtggggacacattagtcacttgatacaataccaacccagaagaaacattttcaagtataaattttcaatgtgaatacgttttaaagttgatatctcctggatttgtcaacagtatttgtttaatttatgcttcatttaccattgtgattaacaagctgccaaacttttgaaacattcaaaatcagtgctaatcgagattcatacatctgagtagaaatctggaacctctgaaagggcatcttaatttaaacacttaatttttttctttttgagcaaggataaagtattctttcttacctatacgttattggttgtgatcaaagctttatttatggtctgacatttgataattaagctttctctcttttattgcattttaaaataggattaaaaattttttttgccttacgtaatttttagtgtaccataacttttactggagtgtatatgggaaaatgtacaaattataaatgtacagcttagtgagtttttacaaatttagcacccacatacccatgtaaccactcaaccaaaataaatagattaccagaatcccagaaacaagcatgagttcacgttcagtccactggtttccatccctaaatgggcaacagtggggaaaatatgacacttgtaaccattattctggcgtctaacgtcatatttgtaaagtaacatactaatcacatcttactgtaaagtgaaaaaaacaagggactctgagagaaaaatgctaaggactcattacttaaagtgaaataattaattaaagaccttttcctaagcagtatttgatactaggaattgaatgtctttctattaaggtaacatttttggaaaaagctaatttttaggccaggcgtggtggctcacgcctataatcccagtactttgggaagccgaggtgggtggatcacctgaggtccggccaacgtggcgaaacccagtccctattaaaaatacaaaaattaactaggcatggtggtgcacacctgtagtcccagctacttaggaggctgaggtaggagaatcgtttgaatctgggaggcagaagttgcagtgaactgagattgcgccactgcactctagtctgggtgacagagcaagactctgtctcaaaaaaaaaaaaaaaaaaaaaaaaaaagctgatttttagacatgtctctattagagacaaaattattcatttaattccgggatttgtagtcattttggaactttgctgctacttaattgctaaatgactaatgggaataaagggatgtcttagaatcattaccatcctttggtgcaatcattactagactataatgcccgtttatagttttttttggtgggggacagggtctcgctctgttgcccaggctggagtacagtggcgcgatcatggctcgctgcagcttcagcttcctgggctcaggtgatccacctcagcctcccgagtagttggaaccacaggcatagcatacgccaccgtgtccaactaattttttttttttttttttttttgtgacagagtctcgctctgtcgtccaggctggagtgcagtggcgcaatctcggctcactgcaagctctgcctcccgggttcatgccattctcctgcctcagcctcctgagtagctgggactacaggcacctgccaccatgcccggctaatttttttttgtatttttagtagagacggggtttcactgtgttagccaggatggtctcggtctcctgacctcgtgatccgcccgtctcggcctcccaaagtgctgggattacaggcgtgagccaccgagcctggcctaattttggtattttttatagaggtggagtttcgccctgttgttgaggctggtcttgaactcctgggctcaagcgatcctcttgcctttgtctcccaaagtgctgggattacggtgtgagccactgcgccctgccttttatagtcttaatgttaaaatttagcagcattttacatttcaaaactgaggcctaaaactttcaacctaacctaagtggtatctttcttagttacccttatattctatctggttatccagatgaatgtagagagaacttttagttccccatattcaattttgttttgttggcactttagattatcctgaagtcttttagtttcttgagtcttcgtttgttgtttgaagagggtttaacttggtaaccaggatctttaaattgggcacagaaagatatactggatggctggacaagataatgtatttctttgatgatcattactagatttactaattgctaacagttcatgaaggtttttttgcagtgtctagacaatgtcagcccaagagactgaaattctaaatgaacaaacactgagaaatatttgaagaattcattcagtaattacctatgtaacattcttgctaaaggtgtttaatttaagctgagcttagttatagtagacaatcagacaaatccagtttgtgggactttctacaagacagttggcctgaactctaaaaatttcaaagtggtgaaaacgaaacgaaacaaaaagggcaggaagactgttctagatgaaagaagttgaaagagaaatgacagtcaagtacagtgtcaagcctggattaagaaaacaaaaaaccatagaggacattttggggataactgggaaaatttgaatatggtgtatatattagacggtattataccttttttttgtttttttttttttttgagatggagtttcgctcttgttgcccaggctggaatgcaatagcgtgatctcggctcaccgcaacctctgcctgccgggttcaagcgattctcctgcctcagcctcccgagtagctgggattacaggcatgcaccaccgcactgggctaattttatatttttagtagagacgaggtttctccgtattggtcaggctggtctcgagctcccgacctcaggtgatctgcccacctcggcctcccaaagtgctgggattacaggtgtgagccaccgtgcctggcctatatcattgttaaatgtcttgaatgtgactatatggtattatggttatataggaaaatgatcttatttttaggcaatacctgatgaagtattagtatgttgaaatgtcgtgatttttgcaatttgcttttaaattgttcaaaaaaaaatcatttgtagagaaaaaagcgaaagtggcaaaacatttactatggtgaatctaggtaagagcatatgggtgttcattttatgattctttcactttttaaatagatttcagtttttcaaaatgtaaagttggggacagccaggcatggtggctctcgcctatagtcccagctgcttgggaggctgaagcgggaggattgcttgaggccaggagttccaaggcttcagtgaactatgattgcactactgtgttccagcttgggtgacacagtgagcacccatctctatttaaaaaagaaaaaaaagttagggagaaaaaaagtacaatgaagaaatggcttggctgggcgcagtggctcatgcctgtaatcccagtactttgggaggccaaggcggctggatcacttgagctcaggaattcgagactagcctggcaacatggtgaaaccccgtgtctacaaaaaatataaaaaattagccaggtgtggtggcctgcacctgtggacccagctacttgggaggctgaggtgggaggatcacctgagccaggaggtggaggttgcaggttgcagtgggccaagatagcgccacactccagcctgggtgactgagaccccatctcaaaaaaaaaaaaaaaaaaaaaaaaaggaaatgcctcaaaacagctacagctaggtttaggaaaggctgtcatcatatttgaggattccatagtgtcttaatgggggaaagctgaaaagaagaaaatgagccttaaagaatattatagctgatgtgaagtggaggcagcttgtttagcagaaaaagtagtggtttcagctgcatgatgggggttagaaaaacatacagaagtcagtatggagaaagaaaaggtacttaactaagaagtagagagaagatgggcaaactagaagggccagagaactgaaatacataaaatgaagaaaaagaagagggatagttgaaaactggtggagcagttgacatcaatttcattaatgggacagcaagactattttgatgactgttatttttttcttttcttttttttttttttttctgagacagagtctcgctgtcgcccgggctggaatgcagtggcgcaatctcggctcactgcaacctctgtctcccgggttcaagtgattatcctgcctcagcctcctgagtggctgggattacaggtgtgcgccaccacacccagctaatttttttttgtatttttagtagagaaggggtttcaccatgttggtcaggctggtcttgaactcctgaccttgtgatctgcccaccttggtctcccaaagtgctgggattacaggcgtgagccaccgcgcccggctgtgatgaccatgttttaaaaacccaaaacaaatagacttataaacctattctgaaatcatagaaaatccaaatattacccagacagttgatgtggaaagtggaatagctatgtttttaattttattgaagagattgaagtgaaaaaaggggtggtagtgggataaagtaaatattaacactaatgagtagaggagaaaaaaaggattttctaagtgtatttttcatccctgttaattgcaccactcacccatttagtcactgattcagatgaccagcctgggaatcaggccagactctttcttctccattttactgcatgtccagtcccaccagactaaatgctgtgaacctttggtttgtacatatcctctacttcatcctattctcacaccttttgcttgtgccattgcaggagcctcttgctgagactatgtagtctgtccacgctgtcatcgtgatctgtgaacaatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatttatttatttatttatttatttatttatttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgctgggattacaggcgtgagccaccgcacccggcccatttatttatttttgagacagagtctcactctgtctcccaggctggagtgcagtggcgccatcttggctcactgcaacctccgcctcccaggttcaagtgattctcctgccccagcctcccgagtagctgggattacaggtgcatgccaccacgcccagctagtttttgtatttttagtagtgatggggtttcaccatgttggccaggctggtctcaaacttctgacctcaggtgatctgccctcctcggcctcccaaagtgctgggattacaggcgtgagccactgtgtccggcccccagcctcctttaatactacaggttgagtgttcctaatccaaaatctgacattctccaaaatctgaagctttttgagtgccagatgacaccacaagtggacactttctttcctgacctcatgtgatgggttgtaatcaaaacctggggacataacccaaagttttttcagtgtccccaagggaaaaagaccctcccagcccccttcggttgtgatatatcttttccatgcacagcatgatggtgatgtccaggcaaccacagattgaccacgtaggtggctaagggtagtgacacatttgctttctaattcagtgtacgcaaatttattttgtgcacaaaattattaaaaatatttataaaattatcttcacattctgtgtatatgaaacataaatgaattttgtgtttggacttgggttccattcccaacacatctcattatgtatatgcaaatattcccaaatctgaaacaatctgaaattgaaatgcttctggtcctaagcactttgaataagaagtcatacttgtcgtcctagaatgttttatatctgtgaatgggctctttgcttctgtgcataatggttttttttttttttaacagttttagagataaggcctcactctgttgtctaggctggagtgcagtaatgcgatcaatgctcactgtggcctcaaacaaactcctggcctcaattgatcgtcctgcctcatccctctgagtagctgggactacaggcgtgtgctgccatgtctggctaaatgttttatttttattacttttttgtagtgacagggtcttgctatgttgcccagcctggtctcaaactcctggcctcaagtgttcctcccacctcccagagagctgggattacaggcatgagccactgtgcctggccctgcgtagaatcttgtccctcagcttgaccagctcctgtttgtttttcaagatttagccaaggggacttctgagaagctttttcttctctgctaagaagctgtggagagtaatggtttgagaacatgggcttcagtcagacatacctggattcaaatttctgtttgttttttttttcaaggagatggagtcttgctctgttagccggctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccatcgctatcatcatcatcatcataagaattactgtctcctatgagctcccataaacaatctcattgctttgcaaatcgctttaaatattttcttgtcctttcttcacaataaactcctctctttaagggcaaccactgtatccttaatgctgaatgcagtgcttaacacacgcttaggtgcttagtaaatatttaagtatgtgcaagcataagaagcttattttatggatgacagtgtaagaaagagtacagactctgctgattaccagccgtgtggcctttgagctttgttatttattttccttgccacaggtgtaaaatgggagatagtgcctacctcagaatttaaagattacatctcatattgtatgtaaagtgcttagcataatgcccatagtgggtggttaataaatgttagctattatttaaaaaataaatcaatcttggatcttggcgagatttgacagtagatctattttactttaagtgacatgtgaaatgaagatttaagagtactgtattttatatagtcacgcttacatagttgcttaataattcggagttctgacaaatgcatccttaggcgatttcatcattatgcaaacattgtatagtgtacagttatcccttggtatatgtgagagcttagttccaggacccccacatataccaaaatccctgaatattcaagtccagaagttggccctgtggaacctgagaattcaaaaagttggccctctgtatttgcaggatggggttttgcagcctgtgtttggttgaaaacatttgcatataagtgaaccagtgcagttcaaacccatgttgtttgagttaaccatacttatacaaacctagatgttatatatatctacaaacgtagatgttacacacctaggctgtatggtatatagcctattgctcctaatctacaaacctgtgcagcatgttactctatttaatactgtaggcaactgtaacacaacagtaagtctttgggtatctaaacatatctaaacctagaaaaggtacagtaaaagtacagtattaaagataaaaaatggtccacctgtggagggcacttaacatgaatagggcttgcaggactggaaattgctctgggtgagtcagggagtatgtggtgagtgaatgtgaaggcctagggcattactgtagaacaccgcaggctttacaaacactgcacacttaggctatgctaaatttataaaatatttttcttcaatagtaaattagccttagcttactgtaacttttactttataaacttaaaaatttttaaactttttaactcttgtactcatacttagcttaaaacacaaacacatatagctgtacatattttctttcatatccttattcttataagcttttacgatttcaaacatttcttatttttaaaacttttttgttaaaaatgaacacacaccacatacattagctgaggcctccagagagtcaggatgatcaatgtcactgtcttctacctccacctcctgtcccactggaaggtcttcaggggaattaacaggcatggagcagtcacctcctatgacaacaatgccttctcatggaatacctcctgaaggacctgtctggggctgttttacagttaccttttttttgttgtttttgttttttgaataagtagaaggagtatactctaaagtaatgattaaaagggtggtatagtgaatgtataagccagtaacatatttgttatcgttatatgactggcagtgcagtaggtttgtttacaccggcagtaccacaaatgtgagtagtagtgccttatgccgtgatgttaagacaggtgaaaacatcactaggtgatagaaacttttcagctccattataatcttacaggatctctgtcatatatatatagtcttgtagactgaaatattgctatgtggcacatgactgttttctaactttagtcttagatattgaaaggatttaaggctgggcgcggtggctcacgcctgtaatcccagcactttgggaggccgaggcgggtggatcatgagttcaggagatcgagaccacggtgaaaccccatctctactaaaaatacaaaaaattagccgggcgcggtggtggacacctgtagtcccagctactcgggaggctaaggcaggagaatggcatgaacccgggaggcagagcttgcagtgagccgagattgcgccactgcactccagcctgggcgacagagtgagactccatctcaaaaaaaaaaaaaaaaaaagaaagaaaggacttaaacctaaaatgcttaagaagaaaaatgatgaaattttccttttctatagtatagatagaattttggaagtgatgtattcataaatatttgatgagttcctattacatggagcacatttctggttatgcttagaagggttaaatactacttgaaaagtactcatgcggtgtagcatataatagcctctcaaaaatgtcacagaaatttagaactatatagtgacctatgactaatcccactgcaaaaggagcaggtgactaaattgtagacaatacctggtgtgaaatgtttgttcccttgatctataaattgataatcctttaatgtttaatctgactgtgactagtggcctgaagaggtaagacttttgtgtttttttatgtgtgtgcctacgtatgtttttttcttgtgacctaaggctttgtggaagtttaaaatagagtgattttaatgaatggctggagtaataaagatagttggtgggcttctccatggaagcaagttggttatttttaactactttgcactgctttatggaaaacatatgccactatagaagttattgtttctgttgactgtgactggtggtggttattacttagttggttctaggagggccagtttttagctaatactttgaaagtgagttctgtgactattattacttagttggttctaggagggccagtttttagctaatactttgaaagtgagttctgtgactattattacttagttggttctaggagggccagtttttagctaatactttgaaagtgagttctgtgactatcaaagaccagaggaataatctcaaagaagctgatcagatcatggaactaaagtcacttgttctggtgaggaacagttgaaagggcacataatacttttggtaataatatttaatgtaacttatttagcagtgcgtgttcatgattggcaaggcaggtgagtagattaggaaatgagtctgaaaaagtagggcaggactgctggcttaaaataggagtgaaagcagtgaacagacatagctatttaggcaaatcctagtgtcccatgaggataagactaccacaataatctaaaaataatagcttataggccaataacctttaaggtttatgtttcatactcaccgcaggtcaacccatgtggctgtttctcatttatgcagatctacatcagattttacttgtgtttacctgaaaatacatattgtttatgtagtcaatgtatattgtagtagcatacagaatctgatcttgaaaaggttgcagaatttcttgagtgtactttaggaacttagtttttcaaaatttatttaatttttattttgataattatagattcacaggaggttgtaaataaagaaatgtaaagggaggtcccaaacacctctcccctaactcccttccctctctttgcccgtgtcagtatcccacaccaccacacacagtagtataccaaaaccaggaaattgacattggtacagtccatagagcttgttcagatttcaccagttatacatgcattcctgtctgtgtatgtgtgtttagctttacacaatttcacatataggtagcataactaccagcacaataagggtactcaacagtaccgtaaccacaagatttagttacttcccctgtatagctacaccagtcccccttctccacgggaaactcagttttatagtttggctattgtttttaatcatgtgcaaacctggtttgattaaggtttttgcttctgatttggaagcattgttaaataatttttaatgaaatacaggtaatctgaaagcagctgacacatggtaaaaagctagatttgggaacactgaaagacttcttggatgcataggcttagaatgattctcagctgtgatttatttcctccctccctccctccctccctccctccctcccttcctcccttcctcccttcctccctcccttccttcccctccctccctccctccctccttccctccctccttccttccctccttccccctccatcccttcccctctctcaatattctgtaatattgaaatatttcgttaaaaatatacagcatattacatatatatctgaaattttctcctttcttccttttagtataccttctatttattttggtaccaagaatagagtgctgctgtaacaaacacctaaaagtgtggaagtggctttggaacttctgaaagacccagcccaagtcccatcttcatttatttatttatttatttttaagaattttttttccaaggctggatctcggctcactgcaacctccgcctcctaggttcaagtgattctcctgcctcagcctctggagtagctgggactacaggtgcacaccaccatgcccgactaatttttgtggtttttagtagagatagggagggtttcacgatgttggccaggctgctcttgaactccaggcctcaagcgatccatctgcttcatcctcccaaagttctggaattacaggcatgagccactgcacccagcccaagtctcaactttctcatacacttaattgatttctgtagctatcgttgatttccccctttataatcttccgtacttacagtctgaaccatacaatgtactgcttaactattctgtgtttatatcttgttttatgcgaattctactcaactagagcatatgattcttcaaggtagaataaatgtgttaaacttgtatatttcggccgggcgcagtggcttacgcctgtaatcccagcactttgggaggccaaggcgggcggatcacctgaggtcaggagttcgagatcagcctgggcaacacggtgaaaccccgtctctactaaaaatacaaaattagccaggcgtggtggcacatgcctgtaatcccagctactcaggaggctgaggcaggagaaccgcttgaacctgggaggcagaggatgcagtgagccgagatcgtgccattgcactccagcctgggcaacaagagtaaatctccgtcgcaccaaaaaacaaaaaaaacaaaaaaaacacacaaaaacaacttgtatatttcacacattacccatacaatgtgagcatgtagtaggtaccagataaacatttagttatttaactagaatataattactgctctagtattttttccctagcactttcaaacgttactcaaagaatccttctagctctttgatacaaattttagaacttcactattaacaaatatcagctgggctcggtggctcacgcctgtaatcctagcactttgggaggccgaggcaggcggattgcttgaggtcaggaatttgagatcagcctgaccaacatggtgaaaccttgtctctactaagaatacaaaaattagctggccgtggtggttctcaactgtaatcctagctacttgggaggctgagacaggagaattgcttgaacctgagaggcagaggttgcagtgagctgagatcatgccactgcattccagcctgggcaacagagcgagacaccgtctcaaaaaaaataaaaataaaaataaaaataaataaataaaataaagtaaaataaaaatatatatatatcactactagctaggattttaggaaggctacctatagaaacttagatatatttagttatggaatgttttgtttttcagttggtaatgtacactctttcagtgtttcaaaggaggatactggataattcgatttgaattgtaaatctccccaactggtgttggagaaaccagaggagttgatgattttatacacagtctttcctacctcttattattgagaaaagagtgttaattgtggtcaatgaatttcttcaaagtttgctgcttttaaatcaaattaaggaagtcagcaactataagtagaatgatatgaataaaatgtttcattgttatgaagaagtgttagtagcacgtggcattatgtgtttcacatattgaagttgacaccagaaatatacatttgtaattttttttttttttctgagacagagtctagcactgctgcccaggctggagtatagtggtgcagtcatagctcactgcagcctggaactcctgggcccaagtgatcgttccgcctccacctacacctcccaagtagctggaattacaggcacatgccactgtgcccagaccattttagtgatttgttattttttaaatctctattctctttttaatacagagctgcaaatttcttacttttctttagtgcaatccatgtgtgaaatatgtgttataatttgtaactaacaatatttgaagtcctgaagtttttgaatgatcttgtatgtaagattagagtagattcatggttcccactaataaccacttcattattatcactttgttatgtgtgtgtgtgtgtgtgtgtttaaagagataaacttataggtggtttatctagaattgtgtaaaatactttcattttcatgagagagtatcttgcatgtgagtattatttgtcacatgttatgcctacattgttggttggacttaaactttagtgacctctcagagattattttcattctagttcatgtcatattactttgatatatgtattaagaagaagtacaagagattatttaatgctattgtctgaatgtttgtgaccccccagaatttgtatgttgaaatcctaatccccaatgtaatggtattaggaggtatggtcttggggaggtgaagtttttataaatttctaaaagaaagtataggaaaaatctttgtgactttggggtagactattttcttagataggtcatagaaggcatgaaccataaacgctgacaattggacttttgaaaaattgttcttctaaagatgtttaagaaaatgaagaggcaagccacagaatgggagaaaatatctatactgcattagtggagtttactactaaattaagaaaacattagaagattgtctatatagtataactgattataaaataatgtatttacatatttaaaatattaagatatatactgacatcttaacagtagttgtctttggctggtgagattctaagagttttgtttttgtggtggttattgttttttgttttgtgctcttttaaaaaattgttttgcctcaagtgtatagtatctttgatttataaaaatctttaaataaagataggatagtttgaaagattagcagaatgtttacaatcaatacttgatactacatggataatactttcctattctatttttgtaaattctgtgcttgaaaatttcaaagaattttttgtgtgtgagtgtgtgttttgaggtggagtctcgctatgttgcccaggctggtctcaaactcctgtcctcaagtgattttcccatcttggccccctgtagcattgagattacaagcatgagccaccattcccaggccaaaactttcgaaactttaaaaaatagcatgaaaacctttattttagtccaggtgcaatggctcacatctgtaaacctggcactttgggaggctgaggtgggagaactgcttgaagccaggagtttgagaccagcctgggcaacatgatgacacctgtctctacagaaaatttaaaaattagtcaggtgtcatggtgcatatctgaagtcccagctactctggaagctgaggtgagaggattgcttgaggagttcgaggctaccgtgaggcatgatcaagcagctgcacaccatccagcctgagtgacagagtgagagaccctgtgtctaaaaatgaaaaaagaaaatctttactttatttatttattttttgagatagagtcttgctcagttgcccaggctggagtgcagtggtgtgatctcggctcactgcaacctccacctcccaggttcaagtgattctcctgccttagcctcccgagtagctggaactacaggtgtctaccaccatgcccggctaatttttgtgtttttaatagaaacaggatttcaccatattggccaggctggtcacgaactcctgaccttgttatccgcccaccttggcctcccaaagtgctaggattacaggcgtgagccaccgcacccagctgaaaatctttactttatttacagcactttgtgagccatatttagcaaacatagttccacatatgaagtttgtttttaatgataaggggtttttaaacttgatttttagtataaatacacagtataataaaagtttgtttacattagatatgaagctaattaccacccctaactgctggctggttttctagaattgtagaagcaggtggtgaattttcctgtctgctgatatccaaaacactctgattcctgggtaagttccagcagtattggatgttggtaatattactgttggtcgattaatttatgatagtattatatacatctctaaagtctaattctatgtattttttaagtaaatagtagaataacatggcataacattttaaaaggtatgtggtaaaaagtcttcctattcctaactgtcagccaccagtttcctgccatgggactgttaaatctcaccaccaaagaccaccaagaaaacatctgtagtcaaaaataagttacactgatttagcttgctgcaggaaggaataacatacatcagaagagctgtgggacctctcaaaaggatagagttaggaaagaggacatacaggattttaggagctgttagtcacagagtaatgttaggataaaggtagtagtctgggcagggattggctagaatatgtaatttgagtgagttgctggaacagccagtagttttgcctctaggacacataagtccctgaggatttactgttagatcagtttgtggtactagaacatacgggtatgagtgagctgatattaataaaggtttgaggctgggcacagtggctcacacctttaatcccagtgcattgggagtctaggatgggaggatcgcatgaggccaggagtttgagactagcctgtttaacttagtgagacctcagtctttaaaaaaatttttttaaaattaaaattaactgagtgtggtggcacacacctgtagtcttaggtacttgggaggctgagggggaggatcacttgaactcaagagttggagactgcagtgagctatgatcatgccactgcaccccagcctgggtgacagagggagaccctctctcttaaaaagaaaaaaaataaggtttgagcttagatggcctgtgatgcacagtacattgcggtttggtttggttcagtttatctgttttgcaagtactaagtgcttttctgtgcatctgcaagcaatttgtagtgtaatttcagttttgtttcactttttaatctctgtttctgatcattcgtccgctaaactggaacatttaccatttaggggaggtgatcaatcaagatttcaaactgtcgtttgatgggttgtgaatgtttataaagctttgatggtagacattttggcctctacaggcaccaggccattttgttcttttttttcttttttctttttttttttttgagacggagtcttgctctgttgcccaggctggagtgcggtggcacgatctcggctcactgcaagctccgcctcctgagttcacaccattctcctgcctcagcctcctgagtagctgggactacaggcacccgccaccatgccaggctaatttttgtatttttagtagggacggggtttcaccatgttagccaggatggcctcgatgttctttttcttagatgataatttgttgaatcagctggtgtgacagtggctgcacagcagcatttaagactctaaagatcacacacttggcatctgcaacacactgaaactcagacagttattattaaagtttaaaataatgtcccatatatcccataatctatttggattttcctttgggcaaccaaatatattttttttcctttaatttggatatgggtcattcacctttgcaactgtcccatatttggtttatattttgccaaggataagcatcttgatagtgctaacagtaaggaaaagttatctgttagcagcctaaaatcttacaacagtggagagagaagaaaatgccaagagaataaaggacaaaatcatgcaagtctgtagtcatcagtggcttctggcatctgggaggttgtgttctgattatcttggacataaatagtctattcattttatcttctgcttctggaccataacagttctggaaatcttggctcacccactgtttgtccatggcaatgatgtcggcagtatgcatcattaatttattctctgtagtgtcagtaatgggtgcatgatacaaacatttacaaaagttcttttgataagtcttccacaaggctcaattcctatctttagcttatagccaggaactttagatgaatgtaaggaagaagcggaaaccacctgtggatcatgggactataggctttagttgatttattatattaaccagcattatcagaatggaagggagtggaatcttctattgcagaaagtacataatgaattttatgagtagtcactgattatcctagaagtaagaatatctcacaaacagggaggacattgacagtctctaggactttctttcatttatcctataaagtgtattatgagtttcaccattccaagtttactgaaacctagaaataaaatccttttttagatagctattgtggcagtctttgtactcgaatgtatgttttcttttttttttttttgagacgaagtttctctcttgtttcccaggctggagtgcaatggcatgatctcggctcactgcaacctccgcctcctggattcaagcaattctcctgcctcagccttccaagtagctgggattacaggtgtccaccaccaaaccccgctaattttttgtatttttaagagagatggggtttcaccatgttggtcaggctggtctcgaactcctgacctcaggtgatctgcctacctcggcctcctaatattttctttaagccgaaagatacttaaatgttgaagtatatttattttaaccacattttattatacatgattaaattgggaaggcttaactttccttatgatttgtgaggtttttttttccctttaacccaaatttaataaagcaaagagttctcacaaaagttttaagttaattaaaattcagagtatgccaaacaaagctaataatttttataatcctttaaaaaatttttaataaagtaaaggactaaagctttgttttacctagtggccatttattataaacccaaagatgtagtaggtgtaaaagacatcttaacaatttcttattatttacttattttttagagacagggtctcgctcagctgtctaggctggagtgcagtggctggatcatagctcactgcagcctcaatctcctgggctcaagtgattttcctgcctcagcctcctgagcagctgggactataggtgtgcaccaccacactcaactaatttttgtgtttttttggtagagacagagtttcgccatgttgcgcaggctggtctcgaactcctgagctcaagcaatccacccacctcagcctcccagagtgatgagattctttttataggtgtgagtcatcatacctggactactttttgctttttgactgatgattccaagagccttttcagtgtttagcacatagacgtagatagttgtagtctttacttaagtttgaatgaagtgagttatgcgtgggctgagttcactcaaagcttgcctcagctgggattattgaccatatacccactttactggagaatgagtatgccaagagaccgaggcagaatctgcaaaatcacttctgctgcaatgtatttgttaaagcaggtcactaaggccagttcagattctacgggagagacattagactctccctttttttttttttttttgtcacctaggctggaatgcagtggtgctatcttggctcactgcagcctcgacttcctgggctcaagtgatcctcccacctcagccgcccaagtagctgggactccaggcttgtgacaccacattcggctaatttttgttgtgtttttagtagagacggggtttcaccatgttgcccaggctggactcaaactcctgagctcaagcattctgcctggctcagcctgccaaagtgctaggattacaggcatgagccactgggcctggccttagactctacttcttgataggatagggtcaggtcactgctatgctttaaatatgatccccagaaagcatatgttggctgcctgggtgatgggtatactagaagcccaaactttaccattatgcagtatatccatgtaaaaaaggtacacatataccccttgaatctgaaatttaaaaataaaataagtatgtattagaaaatttatcccaaatgcagtagtgtcgggaggtggggcctaatgagaggtgtttaggtcatgaagccacctctaatgaatgcattaatgttgattataaaagggcttaaggctgcaagttctatctcttgctctctcttatccctctttgcccttccactatgggatgatgcagcaagaagacccatgccagatgcctggcccctcaatcttgaacttcttagcctccagaactatgaatgagtaaatttctattcattataaattatccagtctataatattttgtcatagcaacacaaaacagaccaagacagtgagattacagaagagtatgtagagtgagaaatattattgtagccatttttttttagtttttgctttttttaaaaaattattctttaagttctagggtacatgtgctcaacatgcaggtttgctacataggtatacatgtgccatgttggtttgctgcacccaccaactcatcatttacattaggtatttctcctaatgctctccctcccccagccccccatcctccgaccagccccagtgtgtgatgttccccaccctgtgtccatgtgatctcattgttcaattcccacccaagagtgagaacatgtggtgtttggttttctgtccttgtgatagtttgctgagaatgatggtttccagcttcatccatgtccctgcaaaggacatgaactcatcctttttatggctgcatagtattccatggtctatatgtgccacgttttctttatccagtctatcattgatggacatttgggttggttccaagtctttgctattgtgagcagtgctgcaataaacatacgtgcacatgtgtctttatagtagaatgatttataatcctttgagtatatgcctagtaatgggattgctgggtcaaatggtatttctagttctagatccttgaggaatcaccacactgtcttccacagtggttgaactgatttacacacccaccaacggtgtatttctccacatcctctccagcatctgttgtttcctgactttttaatgatcaccattctaactggtgtgagatggtatcttattgtggttttgatttgcatttctctgatgaccagtgatgatgagcatttttgcatatgtctgttggctgcataaatgtcttcttttgagaagtgtctgttcatatcctttgcccactttctgatggggttgtttttttcttgtaaatttgtttaagttctttgtagattctggatattagccctttgtcagatgggtagattgcaaaaattttttctgtttttgctttttgagatggagtctcactctgttgtccaggctgacgactgtagctgactgcagcctcaacctattgggttccagagatccttctgtgtcagcctcctgagtagctgggagtacaggcagatgccaccacacctggataatttaaaaaaaaaattttgtagagatgggggtctcaccatgctgcccaggctggtttcgaactcttggcttcaagcagtctccccaacttggattcccaaagtgctgggattacaggagtgagtcaccatgcctggctggttgcagccagttttggaaaataaaatgtgctacagacattgtaagggcaaaatatttaacaataactgagatttctaaaaattgcagattggctaaatgttaataaattatgatctaagtaaattatatctacctaggagaaaataaaaaaaaatttatggtattttaaggtatttatttatgtacttatgcattgagatatttgccatcaaaatttttactagtgcgtataagtacctaacacatagtagcaattcaataaaattatttgaatgaattaattgaggatacttttcgatcatagtttttatggtgagagttttcattttgttctgtcttatttttatgtgtattttagttagatgttcgcttagtctattcaagatgtgttttttgtttgtttgtttgttttgagacagagcattgctctgtcgcccaggttggagtttcagtggtgcgatctcagctcactgcaacctccacttcctgggttcaagtgattctcctgcttcagcctcctgaggcaagcacgcgccaccacacccggctaattttttatttttagtagagatagggtttcaccatgttggtcaggctggttttgaactcgaccttatgatccacctgcctccgcctcccaatgttctgggattacaggtgtgagccaccgcccccggcctgttcaagatgttataacaaaatgccttagactgggtaatttgtgaacaacagaaatttatttcttacagtcctagaggctgggaagtccaagagtcagcttgccagcagattgtgtgtctggtgagggcctcttccttataagtggcaccttctatgtgtcctcacgtggcagaagggacaaacaagctcctttggacctcttttgtaatggcacaaatgccattcatgagggcagagtccttacgacctaataatttcccagatattccacgtcttaataccaccatgttggggattaggttttacctatgaatttttggaacattcaaatcatagcagctgttaagaaatgttgaatcagaagtttctagtcattcttttttttgtttttttgaggcagagtcttgctctgtcgcccaggctggagtgcagtggtgcaatctcggctcactgcaacctctgcctcccgggttcaagtgactaccctgtctcagcctcccgagtagctgggattacaggcgcccgctaccacgcccagctaacttttgtatttttggtagaggcaagagtgtcaccatgttggccaggctggtctcaaactcctgacctcaggtgatctgcctaccttggcctcccgaagtgctgtgattacaggcgtgagccactgcacctggccagaagttgctagtcattctaaactggaagcttgacataatattttgaatcaagcattttaaaaatgtctgcttttcataaatagtttatttttacatatttatccctttcatttaggaaagaagattcatgagttttttttttaatcagctggcaaattagagaaaatatttatacagcttctaataggcatctcaaattattttgaaacattgggaatatatcttttgtaatgttttgcttgtaataattgaatagattttctcatttggtaataacttggaaaatacaaagtggcccatttaaaatggactctgatttaaaggtactgttggaggcattggtgacgggccatttttccttttaaatagagaaagtatgacaatctattttcaagaaactgccatagcaatatttttagtctcatatgctcgcacagaattttgtcactccccaccagtaggtggaatctatttccactcttcttgaacctgggcaggcttgtgactgttcaaccaattgaatatggtggaaataatgtgatgggatttctgaggccatgatataaataggatacaactgatccagcaatcgcactactgagtatctacccaaaggaaaataaatcaacatgtttattgcagtactattcacaacagcaaagatacagaatcagcgttgagtatctattagtggatgaatggataaagaaaatatggtatatatacacaatggaatattgttcaaccataaaaaaacaaaacaaaataatgtcacttacagcaacatggatggaactgaaggtcattatcttaagttaaataagctaggcacaaaaagacaaatatcatatattctcacttatatgtgggagctaaaaatttgaacacatggaggtagagaatggaaaatagataagagagactgggaagggtgagtgggggaaaggggaaggatgaagagaagtgagttaaagggtacaaacatacattaagataggagtagattcaatgtttgatagcagagcaggatgactatacctaacaaaaatgtattgtacctggtgatgaacatcctgaagaccctggcttaatactatgcataatatacatgtaacataattcctcatgtaatctgtaaatttgcacaaataaaaagagggaaaaaaaaaagctacagcttcttcctggctctctctttgtcttgggatgcttgttgttggaactaagtcatacgaagaggccacatgtgggtattctcttcaaaaacctgagctaagctgcagccaacagccagtattaaccacagtatgagtgagaaagctttcaggtaattccagccccaggttgtcgagtatcctgctgaggccccagaagttgcggagcagagacaagccagccccactgtgccctgtctgaatttatggtccacagaacctgtgatagataataagtgattattgccttaagccactaagttttggggtaatttgttacatggcagtagataattcatataatttctagaaacttatagggaaataaagatttgctcaaagacatatatatatatatatatgtgatatataaatgatccatgtatatatatatgatatgggtgatatatataaaataaatatgggtgatatatatatatacacacacacacacacacacacacacatacatatatatatgttctctgctgtatcatttatttatgttttcttttttttagaggcagaatctcactctgtcacccaggctagagtacagtggctcagtcataggtcactgcagccttgaactcctgggctcaagcgttcctcctgccatagcctcccaaagcactgggattataggtgtgagccacgatgcctggccctgcagtataatttacaattttttgaaatagtctagctatccaacaataagaaaatgtttaaataaattatcataagcacactattttcctaagtaaaatttctacattttctatattcaaaaacaaagtttaaagaattggtatatagtcaattatgtcataatgataaacctaattgaattatatatttacataaataaagatcattaagaacaaaaaaggctttacatctgataaaggacatgtacccagaacatacaagaactttcgtcagtcaataagaaaagatactaaatgttttaaatggacaaaagaattgaacaagcacatccccaaagaagatattcaaatggcccttaagcaagtagaaaggtcctcaacatcactactcatcagggaaatgcaaagtagagaacaaagagataccggtagacgttcactgtactggaataaaatttagcagatgagcaatattgagtgttgacaaggatatgaagtaactggaacccttacaccttgatggtgtgagggtaaatggtatcactttgtgaactgttgggtaaaaccaatgttgaccccataaactttcagtcccattcttgggtatatacctaagagaaaagagtgcttatgtccaccaaagcacacatagaattatattcatagcaactgtattcataatggctcaaattggaaagctgctctagtcatacattgtctgcccttacctttattaacgcagtagtgcttagcatgtagctacctgtgtttagtttaatatgtattattaatgaaaatttatttaggggatttcacccccaattttttaactttatggtttcaaatttcttaaaacctttctctttacatcagtttggttttggaagactaaaagaaagagcttgttgcacagatggcccaaagcacaaattattaaaatgctaacttttatctacatccagctccaaatattcccttactccttgatcattcttttttttttttttttttgagactgagtctgtgtcacctaggctggagtgatagatgtatatatggtcccctattctaaggtaatacagtcatgcatccgagaaatgtgtcatgagatgactttgtcattgtgagaacaccatggaatgtacttacagaaacctggatggtgtaactgctatacacctagatggtgtaactactactatgcatagtctatatgatatagcctattacttctaggccacaaacctgtacagcaggttactgtactggatactgtaggcagttataacacagtgctaagtatttgagtatctgaacatatctaaacatagagaaggtacaataaaaacacagtataaaaggcaaaaactggtacacctgtatagggcacttaaccatgaatggggcttacaggactggaagttgctctgggtgagtcggaggtgaatgatgagtgaatgtgagggcctaggacattattgtacactactggagactttataaactttataaacactgaacacttaggctacactaaatttaaaacaaatttttcttggctgggcatggtggctcactcctgtaatcccagcactttgggatgctgaggtcggcagatcacttgagtccaggagttcaagaccagtctggggagcgtggcaaaaccccatctctacaaaaaatacaaaaattagccaggcatggtggcgcacacctgtagtcccagctgaggactgggaggctgaggtgagaggatcatttgagccaggaggttgaaggtgcagtgagccatggtagtgccattgcactcccatctgggcaataaagcgagatcctatctcaaaaacaaattttttttctttaataatatattaaacttagcttactgttaagtttttactttataaatgtttcagtttttaaaaacttttggacttttttgtaataacacctagcttaaaagacaagtacattgtatagctatagaaaataatttttctttatatctttataggctttttctatttaaaaagtttaaatttttttttaacttttagaatattttggtaaaaatgaacacacacacacacacacacacacacacacacacacacacacactgagcctaggtctacacagggtcaggatcatgaatatccctggcttgcccccctacatctttatccactggcacaccttcaggagcagtaacaggcatggagctgttatctcctaggataacaataccttcttctggaagtcctcctgaaggacctgcctgaggctcttgaggagatgtcactcttttcagaaatttgcccatggtgttttgcttggtttatttctatttttcattgtagatttgtttgtaagcagttaatgcagcatgaacattcctgtgtattaatgaaaacctttctgtttttgggggtccatgttttcacacttcctaaggagtttgttgaggtgtgcaaaagcttctcccaaacccttcactgtgagttttgttgggggttctttttctttctccagcaaacttccttctctcttgctgcttcttcagctttgcattcctattccagttcccactcattagtcaattcctgcgatgttattgtggctataacgttactagatgacaggagtttttcagctccatttaactacagtccattgttgaccaaaacatcattttgtggcacacaactgtatttagctattttagtggttgggtagctgctatcgttttttcagtgaaatttgagtagttaaaatgagtcaagtagtagctgaaagcatgacgaaacttataataggactttctttacttgtaaatgatacaatatggtatggctagattaagtcttttaaaaatactcatagatttcaacttggttccataaagctggaagtggaaacattggacatatatcagaaattcaattgaacgcctccttttaaatttatggtttacagacttgtggctcttagatcccaggggatctaaagtagactgtgttataaagtaggcacataacaagacaacagccaatttaaaaatattaaatgaacttgctaattctccatgatattatatatataaactttgtacctaatgtaaactgaaggtagttattagcatttccaggttagaaaacataactggacttcccttatccactttttttttttttgaaacggagtcttgctctgtcgcccaggctgaagtgcagtgtcacaatctcggctcactgcaacctccatctcccagattcaagcaattcttctgcctcagcctcccaggtagctgggattacaggtgtgtgccatcacacccggctaatttttgtatttttagtaaagacagggtttcaccatgttggccaggctggttttgaactcccgacctcaggtgatccacctaccttggcctcccaaggtgctgggattacaagcgtgagccacaccacacccggccccttatccattcttttatgctctgttactacagcaaattattctcagacatagctccatcttggtagtagtgttcttgttattatcagtaacaaagtacattaagctactgccttttgttttattctgttttgttttgttttattttgagacagtgtcttgctctgttgcccaggctggagttcagtggcgcgatctcagctcactgcaacctctgcctcccacgttcaagcgattcttctgcctcagcttcccgagtagctgggattatgggcacttgtcactacacctggctaatttttgtatttttagtagaggtggagttttgccatgttgcccaggctggtcttgaactcctgacctcaagtgatctgcctgcctcagcctcccaaagtgctgggattacaggcgtgagccatggtgcccggccgagacttctaaaacataggtgtcattaggacagttctataggagaaataaatgccattttagtattatgactacttttctttcattttctttaaccatagtttcatttttaacacctgttctatagatagaaaaacaaagatactcatgtcatctagtgtcttgtctcatttataacttgttccctgaatcagcttcaagtctttcatgtttatgtgtaaaacatagggctgggcgcagtggctcactcctgtaatcccagcactttgggaggccgaggcaggtggatcacctgaggtcaggagttcgagagcaggctggccaacatggtgaaaccctgtgtctactaaaaatgcaaaaattagccaggtgtggtggcatgcttctgtaatcccagctactcagaaggctgagacagaagaatcgcttgaactcaggaggcggaggttgcagtgagctgagatcgtgtcactgcattccagcctgggttgacagagcaagcctccatctcaaaaaaacaaacaacaaaaaccattataatttatgcacacacaaatatttaaaatgactgtcacctttttatacttagaattgatcatttatgatacatagtatcttagaattttttccccacgtactggtgctgtggatgtgaaatcatggtgatttattaggtttaatttgtcatgtaaaagaattgtgttctgtttgttctctatacatttaaatattttaaattattattattatttttttgtagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacaggtataaaaagtctttgcatgatacttttttacagtatagatttgcatgagcagttttgagaaataattacaaataaccagctaaaaagtggtgtggtaatttttctagaaattatgagacagtcaggattggttaggatatttgttgttaattgaagaaatacaattttaagtgtctcatatttccagtagaactatttagtatgagtagattgactacagttttacagcagtcctgtcaaaagctggagtgatttaagttagaagttaaactgtgatcccttttggtgtaatgcccttcgtcttctaaggtataatttctcacatcactttatgctttttttcctagtatgtggtgatattcatggacaattctttgacctaatgaagttatttgaagttggaggatcacctagtaacacacgctacctctttctgggtgactatgtggacagaggctatttcagtatagaggtaaaaattaaactggatatgttgggactattatattgtctttcaaaaaagatgatttccattcttcagtagaagaaattaaaatgagaactctggcagaatttataaactttgttactttcaaaattaaagtagtagaaatgttttaattgatagaacagttattccttttttaaaaccagtcgaaaatctgacaaataggctatatattaatattaacccaattttacaaatagttaaatgttcaccaacttttcctcttgaagatagtatacaggattgtataaaaatgacataaattgctgttcaccctaaatggggtttagattagctgaccttaattataagaccataagctgctgagctacaattaacacttagattaactgccagtgctaaataaacactaagctttttgtaggaataatgtctggtactggtacacatagtaagcacttaataaatgttcactgaaggggaaaaatgagttgtagttaattaaaacttatactttccttttatatattttgaaaatggaaagataggaacatgtttagaattaaatagaagctttaatgtgtaaaagataaaactactttagaactttatgcaaggacttgagtacagtggaaccacagcacattcctagttaatgttcattgattcaactctacatgctggcaaataaaagagaaaaaaacttttgaaatagcgtgggtaataggatttgtaatgtgaccaagaataagcatgagctgagaaattgagtctgctttctgtcttgctgtctatagtcctgcctgccctcattgtgtgagaatctcactgtactaagtgtgtttctggtggttaaaggtttattgtcttgcagcctcactcctaaatgcaagtcagctctctcacctgatgcccaagcaaaggagcagcagttgctctattgctgtagaaaaaataagcaaaaaaatggatttttagttttctgttagataggcaatctaaattcatgaatcagaaaagttcaatgttggccaggcacggtggctcacgcctgtaatcccagcactttgggaggccgaggcaggcagattacgaagtcaggagatcaagaccatccttggtaacatggtgaaacgccgtctctactaaaaatacaaaaaattagccgggtgtgtaggcaggcacctgtagtcccagctacttgggaggctgaggcaggagaatggcgtgaacctgggagacggagcttgcagtgagctgagatcacgcctctgcactccagcctgggcgacagagcgagactctgtctcaaaaaaaaaaaaaaaaaagttcaatgttagttgccagtgcacaaaattcatttagtgtcaaatgtgaggacaaaagttaaaggtataaactgacaaaatagtaaagcccatttttccttctgctccgtaaatgtccaaggtctctaaataggtactgggaataggcggagattatccttgcagactgtatcattgaggagcttccctgttgccactcatatcatgcatgtttcagtagacataagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttatttatttatttatttatttattttttgagacagagtttcgcttttgttgcccaggctagagtgcaatggcacgatctcggcccaccgcaacgtccgcctcccaggttcaaatgattcttctgcctcagcctcccaagtagttgggattacaggcacctgccaccacgtctggctaattttttgtatttttagtagagacggggtttcaccatcttggccaggctggtcttgaactgctgacctcgtggtccacccaccttggcctcccaaagtgctaggattacaggtgtgagccactgcgcctggcaataaaacaacttttttttttgagatggagtcttgctctgttgccctggctggagtgcagtggcacgatcttggctcagtgcaacctatgcctcctgggttttaagcagttctctgcctctgcctcctgagtagctgggattacaggtgcttgccaccacacccggctaatttctgtatttttagtagagatggggtttcaccatcttggccaggctggtcttggactcctgaactcgttatccacccaccttggccttccaaagtgttgggattacaggcatgagccaccgcgcccagcctaaaacaactttttagtgataaattattatgccaaattatcttctgattaactcgtataacttaaaatagctttaaaatagttttaattcattaatacattcaataaagcacatagaaaatatcaacaatgattttgtgcacagacatcatgttcagaatattttgtgttatgcatttttttcctcactcatcaataaagtttcttgagtgccaactttatgggcaggctgtgagaataaaataaagaataaaatttatgctctgtaggagcttccagtctaatagaaaagatgcacttacgaatagacttttgttataatataaaatgtgcttcttgaattaacagcgtttttcatattaggacttagcacagtgcctaacacatagtaggcacatagttaatatttgttgaatgaatgaatgttaataaatcatagtttgtatttagctttattctgttaattagatgtttgctaacttaaagggttttttctgcaataacttcagagataaatgaatcaaaactttaaggtgacaatgacattttataccagtgttaaaaccaaagtatgagatctatcgagtattcattggaagtcacttatttataaaccactaagattataaacctctataggctatagcttactctaacatgttgcaagtatacacttgaaaaataattttttaataaatattcttgatagccatgagtgtgatgtttttgtttaatagatgaaaataaggtcatggaattcttattaaaattttttgttataaataatttatttttaatagaaaagttgggaaatgcagaatctagaaaacaaaaactttctacaaatcagagataatcactgttaatgttttattatactttcttgcagccttttttcttcttttacatttgtatatattttgttttcaagaaaattgagagcattttgtacgctccttttctgatcttctttttccactcaagattgtatggaaagcatttttctgtattgttttctccagaagtgtagtgtcaaagtcaaataaaatagagacaaatctctgaaattaaaacattttatctgagaagaaaaaagaccagcctggcgaacatggtgaaacctcgtctgtactaaaaatacaaaaattagccaggtgtggtggtgggcgcctgtaatctcagctacttgggaggctgaggcgggagaatggcttgagcctgggaggtggaggttgcagtgagcccagatcgccccactgcactccagcctgggtgacttagcaagactctgtctcaaaaaaaaaaaaaaaaagaaaagaaaagaaaaaatgcaatttggggcatacacacagactgagcgggctttggtatgtctgaagaaaagagaaggttaggttttatgagaaagaaaaatgttatgtattgctgtttgagaaagttcattgacactagtaaggttctggagggctgacaagttttacttaatctcatgtaatcaatttatattctgcttgatctccgttaatagtttcatgagtccgtcagtttctttattagagttgtggaaatttttatttagcctattgcacttaatgttatcagcaacctatatttaagagtacttgttgaagtcttttccatgaatctgattgtgcatgtttttagagacaaaacagtaactgtggatgacaaaagcttagaacagccatggttaaaaatctgatgaaagtttacgattgataaggaattttgttatttctattatagatagcattttaggatacaataatcagaattaagactgagttatgagttatacaatttttatgagttatacaatttttgaaacatttatgttaacaacatacccctaaatgcaactaaaataagatctagtatcacttaccatttaacagtttcttatataatttactaaatgagcctgatcatttcatatctctgtaagatgagagatatagatcttttgaggctttccaggggctgaactggaaaatcccaaagttaatttaatttaattttatttttttgagacggagtctcgctctgtcacccaggctggagtgcagtggtgcaatctcagctcactgcatcctccgcctcccaggttcaagtgattctcctgcctcagcctcccaagtagctgggattacagccccccaccaccatgctcagttaatatttgtgtttttaatagagatggagtttcaccatattggccaggctggtctccaactcctgatctcaggtgatccacctgcctcagcctcccaaagtgccaggattacaggtgtgagccactgcagccagccccaaagttaattttaggtcaaaagtacttaattgaggctggtcacagtggcttaagcctgtaatcccactgctttgggaggcctagatgggaggctaacatgtgtccaggagttcaagaccagcctgagcaagaccttgtttctataaaaataaaaaacaaaaaaagacttaattgaggatttgattttggggacgtttgtcaaagatgtcaaaaggctcagaacatctgatcaaaacagaatcacacaggtcactataaaataatggtcatttggctgtgcgcagtggctcatgcctgtaatcccacacttggggaggccgaggcaggtggatcacctgaggtcaggtgtttgagtccagcttggccaacatggtgaaaccccgtctgtactaaaaatacaaaaagttagccgggcgtggtggtgggtgcctgtaattccagctacttgggaggctgaggcaggagaatcacttgaacctgggaggcagaggttgcagtgagccaagatcgcgccactgcactgcagcctgggcaacaagagcgaaactctgtctcaagaaaaataaataataataataataataataataatgataatattcattcagccagtgataaaagatttccaaagtaatacagaaagttacatggatgtaaaaacgttagtttccttaaagtttagttttcctaagttataagatacctaatgagggcaacacagaaattatcttgatgaaatgtggaagttttgtgttctttttttttttttaatgttttaaattctggtatacatgtacagaacatgcaggtttgttacataggtatacatgtgccatggtggtttgctgcatccatcaacctgtcatctacattaggtacttctcctaatgctatccctcccctagccccccacctaccaataggccccagtgtatgatgttcccctccctgtgttctcattgttcaactcccacttatgagtgagaacatgtggtgtttggttttctgttcctgtgttagtttgttgagagtgatggtttccagcttcatccatgtccctgcaaagacatgaactcatccttttttttggctccatagtattccatggtgtatatgtgccacattttctctatccagtctatcactgatggacatttgggttggttccaagtctttactattgtgaatagtgctgcagtagacatacgtgtgcatgtgtctttatagtagaatgatttataatcctttgagtatatacgcgataatgggattgctgggtcagatggtatttctggttctaatccttgaggaatcaccccactgtcttccacagtggttgaactaatttacactcccaccaacagtgtaaaagcattcctatttctccacatcctctccagcatctgttgtttcctgactttttaatgatcgccattctaactggcatgagagggtatctcattgtggttttgatttgcatttctctaatgaccagtgatgatgagctttttttcatatatttgttggccgcataaatgtcttcttttgagaagtgtctgttcatatcctttgcccactttttgatggggttgtttgtttttttcttgtaaatttgtttaagttcattatagattctggatattagccctttgtcagatggatagattgcaaaaattttctcccattctgtaggttacctgttcactctgatgataggttcttttgcagtgcagaagctctttagcttaattagattccatttgtcaatattggcttttgttgccattgcttttggtgttttagtcttgaagtctttgcccatgcctatgtcctgaatgaagcatataaaagttttgttttttaaacaggctaccaaaaaggtgaagaaaaaccttctgtagtatgattgtttcttcttatgtgatgttcacttacataacctggaaatcaaaccggatgaaaagagtacttgaattaatcagacagaggaagaatgtgcccaagattatgaatgtttcaattcagctacgtcaagaaaagccaagatacagtagaggaaaacatagcttttttaggcttttaagataaacctcttagtgtcagatcataacagtcgagttagaataggagaaaaaaagttataggagcagatgaaaaagttggagagagtcaccttctagccaagcaaaaagatacgctttttcaagtggagaaagaacagaagggaataatatatgacttgcaatcatgtacagtgaaggacagcagaatttgaacttctgaggtatacatttgagaagtttcaaaaagaaacagatttcagaattaagtatcaaaacctcttgcagttttactaagagaatgtcaatactttaagaaaagccctgttctacaataggagaccaaattttatagttttgtattagtgtctttttactatcaaagctcaatctttgggaagaccacatgtcattttatttttttatttttcaatttttatttatttatttattttgacacggagtctcgctgtgttgcccaggctggagtgcagtggcgcaatctcgactcactgcaggctccgcctccagggttcacgccattctcctgcctcagcctcctgagtagctgggactacaggcatgtgccgctacgcccggctaattttttgtatttttagtagagactgtgtttcacagtgttagccaggatggtcacgatctcctgaccttgtgatctgcctgcctgggcctcccaaagtgctgggattataggtgtgagccactgcgcccagtcccatatgtcattttattttaattatagccagcttgatcacatacaaaattccatttataaattccgttttcacaaaccctattacaatttcactcagaccattaatgacatgcttggactttctgctttgtcctgtatttcctttcttaaataaccattttattttaggatgaaaatttgccacataagattctttgtcatacaaaattattctatttctcaataaaggacacattttaatgcctatcttgtaattaaaaaaaatttttttaagagacagagtcttgctctgtcacccagactggagtgcagtggtgcaatcatagctcactataaccctgaactcctgggctcaagcagtcctcctgcctcagccaccccaattagctaggactacaggtgtgtgctaccacacttggctaatttttttttttttaatttttttagagttgggtctcactgtgttgttcaggctggccttgaacttctggcctcaggataccctccaacctcagcctcccaaagtgctaggattacaggcatgtgctaccacagccagcttgtatcaacaattttaaaaacaattaatttatcaaagatttacttaagtcacaagaactgaaaaaacatttgggttaattactacatattttatatgagcacttgtttacttaaactaatcagaataaatttttttagggatttctggctgactatatgagattttattatgtagacacagcatacaacatagtatatatatataatataagcatatctacacagatatacatacttataaataaattcttatggcttttgttttagagttttggtcatgaaatagtaaaacactcaccaatttataaaaaacagtaggatccagattatctttctgacaaaatggaataaggccaaacttaatgttcttttttaaaacaggcaatattataagggttgtgaactaaattttgagtaaagtagtttgagtcagttaccaataaactggattcgacacagaatagttaattgtggaaatatgactgaattatcttctaacaaggtctgttcagtattttattggtctcaattctttatccttgaagataaaagtgttgccattccttttactgtgggcaggctatctttacatgggaatttcatttttgcaaaggaaagagcatgaaggtcaaaatgattttctttaatatctgctggttttaagtgttttacttaaatggtcagtatgccagaatagttgaagagttttgaagaaagagtttagaaaaagataagaggaggcagagcgggaggggaaagctctagagaggaaagtgattcagctagctttgaggcagtgttttgtagtgagtcattctttgagtcctgaatccttttttttagcctcaaaatatcaatgagatacgcatatcttatttggagtatattattttctaactgtggtcttttagtttaaggaacaacagactgtttgaatgatccttacgatgtttgaacatgttaccggctggaatcccagaaaatatcttggcatgcctttgaattttgagagcccattttattgtgggtgctctggtttaatcccaaatacacaaaaaccaattaaatataagcactgaatttgcaaaggccaaataaacgcaagcacagatgggaaaataaagtacccacttaccaagaaggacgataagaagccttctccaactgaaagaaaaaagagagatcccaaggcctcaacccaaagggaaaaatcccttccctgagaccccacagccagggtctacaaggaggaaaagagtcttccttaataggagatccctcagccagatcagacgggaaggggaaagacaccatcccatccaaatcccagataaaacagaactcaaccaaaatcgggagttcagtccaagaatgactcactaagggaaaaagaggcaacttgcagaagccgttagaggagggggtgactttcagaggtccccagtgtggctaccttgtactatagttccaatggctgctgatcttctctgagatgagtcagccttagactcatacttgaccaagtatgtcaaagtcaaatgaaacacagagatgaatctctgaaattaagatgttttatttgtgaagaaagaattgcaatttagagcatgcatgcagacagaatggtatgtccgaagaacaaagagaaggttagaggttttatgaaaaagcgaaatgttatgtgttgctctttgagaaagttcattggcactagtaaggttctggagagcttgccagttttgattggtgagtgatggcagtgggtaaaattagccttagaatttcagcagatcatttcagtagccattagataaaactggtttccagtaatagcaggcagtttcggcagacatgcttgcagagaattacatttttgggtcaatgttatatgtcctgagtgcttcccccccgccctcttgactctgttttagttgggtatgacaggaataacccagttcatatgatcaactttcacagtagttaatgatataaataccttaatttatttcaccattcctctactgttggaaaaataggtttatagcaggtcatgctattgcatacattttccctctgtcttccttacaaacaatatctctattttattcagatagatgggattggggttgcagggagaagctttgatctcagggaaggaaggcccttatcccagccccagggaatgaattctgggtggtctgaactactcaagccaatcaatttcctgtcactaatgattggtctaggggtaaacactggattttcttttaaccagtaatatataaagggaactctgctgggtttttgtttgtttgtttgcttttggaaacactctttcttgatgaaaagactattgcaaggttgaagcttttggacccccattctaccatttcacttcatatgtggatgtgtgtactgtagcagccatgctgtgactatgaggaggtgacatgactaaggaggaaaagcagacctgtgaatcgctgatcacagaggtacagagggcttggtttcttggtgaagatgttgaactagtacaccaaacctggacatctcatctccagacttgatgtgttttttgttttgtttttttttttttttgggacggagtctcactctgttgcccaggctggagtacagtggcaccatctcggctcactgcagcctctgcctcccaggtttaagtgatcctcctgcctcaccctcccgagtagctgggattacaggcacccaccaccacgcctggctaatttttgtatttttagtagagatggggtttcaccatgttggccaggctagtctcaaactcctgacctcaggagatctgcctgcctcagccacccaaagtgctgggattacaggcatgagccaccgcgcccagcccagactttgtgttttatgaggtatttaaatatcttacacaacagcaaattggatttgatatcacttgtatttaaatggtacaaagttgtcttccaattatttccactctgcacattgctaaagttaacatctttttgaatatatctgtgatggcatttcagatacttagatcagattctcacacatgaagtaactgatcaaagagtagaacatttttaagacttctgccgctgataaaacaaaatagtaaagttttatttatctttgagacttttggtgttccctcttcatttgtacctattacaaaatgctggctgggcgccctggctcacaccggtaatcctagcactttgggaggccaaggagggtgggtcacctgaggtcaggagttcgagaccagcctggatgacatggtaaaaccctgtctctactaaaaatacaacaaattaaccaggcgtggtggcgtgtgcttgtagtcccagccactcaggaggctgaggcaggagaattgtgtgaaccctggtggcagaggttgcagtgagcctagattatgccactgcattctggcctaggtgactgagtgagactctgtctaaagagaaaaaaaaaataaaaacaaagtgcttcctcttcctctgtgagagaagaagctaaattttagtttctttaattgattttgtgagaaaagaaaagattaaagggaacattttcagcaaagatatactgtattaaaagcacagaagctgccaaagagaaaaatgttatcagatgagcaggtgatataaatgttattagatgaccaattgatgaacaggtattgacacatagaaatgattctggaggcagagtaaaaattctgttcacacagaagtaaaaagtaattgagtggttgaacagatctcttgataatcatgaccttgtaattgaattatacaagacaattgtacagttgcatcctgatgtataaaataaggaaataaaacttgaaattagaggccaagaagcacatcaccaaatgacattatactatgggtggattgtgcctttatatatctcgttacctcaaaaaggtgagttagaaggcacaaatgtatacccagataaatcaaaagatatattgtgttcttggttgggaaaggtaggtatagaaaagagaagtgcattctaaatttgtatattgatttaatataatttttccttggaatattttgtgaaaattgttatcttggtaatgaaatttaacccctcaaaagaataaagccacacaaggttatttatatgtgtctacatgtttaagctttatgattattttgcaatgcctgtttcaaaatgtgtatatgctttaatgcaacaattccatttttcagaacctatgctttagatgcactcataattacgtacaatgatgtttgaattgtttgtcacaatgattgaaagtttcttttggcatttgataaacaggcttcagggatacaaaataccctgcaatgtgtaggagacacctaaacaacaaagaatgaatgattctcagattgtcaacagtgcctgtgttagattctggggatctaacagggagatgcacaagcaaagtcctttactgtattttctagtgagagggacagcatcatgtatttgtttaccatccatgagaaccaaatcagaggaaggagctaaagcgggacaggagcagctaacttagatggagtgatcagggcaggttcttttgaagaggcaattgttgaacagaatgacctgtgggaacaagctgtgcatagatcaggggaactacattccaggcagaggcacaaccagtgtaaaagcttacaggcagaagcaagtctagggcagtccatgtatagtagtgaggctatcgaggctagacagaataatgagtaagggagagatggaagaggtgcagagagtggggcagatagatgatgtcaggcctagtaaaccatgtcagtgcatttgggttttattctgaatgtgctaggaagttattggaggaattttttttttttgagcaggggagtgacgtattcacatttatgttttaaaacaattactttggctgttagaaggtcagttgacttttggagcccaaaagcaggtgcagggagaccagtgaggatttaatctagtaatataggtaagagatgtcagtaattagattaggcatactgagaaacatttggattcaggatttcaaagtctttcctttttgaggaggtgggaaagtctcagttgaattgatcgagctcctcaggtcatggcacatttctcatcagtctttgcaaagtccctcttttttgttttattctttttgtgcttatctgtgatctctgagttccttactccctctccccagtatacacatgcttctactgtatttaatatatgattcagaatacatctaatgtatatatgaatgaatgattctcagattgtcaacagtgcctgtgttagattctagggatctaacatggagatgcacaagcaaagtcctttactgtattttctagtgagaggtacagcatatatatatataacaaatatatattatatataatagtgtatataatatataatatataataagtatatattacatataatatacaataagtatatattatatataagtatatattatatataagtatatattatatattatatataagtatatattatatattatatatataataagtatatattatatataagtatatattttatattatatatatagtaagtatatattatatacatacataacaaataaatatatatatattcaaataatttgagatggagtcttgctctgtttcccaggctggagtgcaatggcacgatctcagctcactgcaacctctgcctcccaggttcaagcaattctcctgcctcagcctctccagtaactgggattagaggcgcatgctaccacgcccagcaatttttttttgtatttttagtagagacgaggtttcaccatgttagccagggtggtctggatctcctgacctcgtgatctacccaccttggcctcccaaagtgctgggattataggcgtgagctgccgtgctgagccaatacatctaatatattaattttttaatgtatagagcttttacagataaaatattttaattttacataaatgatatggtgctgtccagtggtcttgaaatgttaacatacaccattattacctggaaagcttgtgcaaacagaggttgcaggaccctgaccctgtttctgactcatcaggcgtggggtggaacctggcaatctgtattctgtcgggttcccaggtgatgctgtttaccacactttgagatgaatgtgaccatactttgagaaccactgttgtagtgctatttatactgttgacttttttcacttaccactttttttatatttatatatattttattatactttaagttctagtgtacatgtgcacaacgtgcaggtttgttacatatgtatacatgtgccatgttggtgtgctgcacccattaactcgtcatttacattaggtatatctcctaatgctatgcctcccccctccccccaccccacaacaggccccagagtgtgatgttccccttcctgtgtccaagtgttctcattgttcaattcccacctatgagtgagaacatgcggtggttggtttttttgtccttgcgatagtttgctgagaatgatggtttccagcttcatccatgtccctacaaaggacatgaactcattattttttatggctatgtagtattccatggtgtatatgtgccacattttcttaatccagtctatcattgatggacatttggattggttccaagtctttgctattgcgaatagtgccgcaataaacatatgtgtgcatgtgtctttatagcagcatgacttataatcctttgggtatatatccagtaatgggataagatatatccaggttactactatacgtgcctctagttgattgctttctgcctgctgtatagaatttcacagtatttatgtatgacactttagttttctcttttgcttggtggacacctagtttacctccagtttctttctaacatgaacactgctatgatgaacaccctcatataaatctaccatgatttaatgtctctaggttttatgaacaaaatcggattgccaggagaaagggtgtatgcattcatacttgaactgagcattggttgccagatggctcttcagaatggctgtgcaagtctctattcctaccagcagcactgaagaattcctatttcctcacatccctccttccagaatatgattttatctcatattataatacttgccaatataatgggtataaagtagtattctactgttttaattaatgtttctctaattactgatgaaattaagcatctcatatgccagccattcagctcttgcactcactcttaggagtttcttatgtgacctttcagagataggttaaacatatacaagcatatttgcaaatctaatgagaaaatagtgtacttgtcactatacattgccctttaagtgctgctttatctgagtcccacagatttggacatgtattgctttcattatcattcagtattttatattttaagaattctctttaaccctaaaataatgaagtagtatgttttttctttccagtcatatgggatttttttagagctagtattttgttactgattattgatttgatgtaatttgattaaagaaaatgattggaataatactcattctttgaaatttattgagactccttgtggtatagtacagagtagatttttgtgattttcccatatattcttggaaagaacgtatattctctacttgttgagctattctttataactttgactatttttgtctgcttgaactatcagttactttcagcattgtgtcaaaatttccaactaccattacagtgtcatgcatcatttaataaggagggtacgttctgagaaatgggtgccgattttgctgttgtgaaatcatcatagagtgtacttacataaacctaggtggtatagcctgctacacacctaggctatatggtatagcctgttgctcccaggctacaaacctgtacagcatgttattgtgctgaatactgtaggcagttgtaacacaagggtaagtattgtgtgtctaaacatatctagatgtagaaaagatacagtaaaaaaaaaaagagaaaaaatggaatacctgtataaagtacttatcatgaatggattgtacaggactggaagttgctctgggtgaatcagtgaatgatgagtgaatgtgaaggcctaagacattgctgtatactaccagatgctttataaacactgtacacttgtgctatactaaatttattaaaaagtatttttccttcttcaataataaattagccttagcttattgtaactttttactttataagatttttaattttgagctgccatcttgcgtccccatgtgtgtgcacctaatctcagctggtggtccacccgagacccccaagcaccaaccctagccccccacgttggccccttatctgctctgagaagatgaaacaaacagttatgagccaggaaagacttgccaaactgcaggcacaagtgcgcattggtgggaaagaaatggttcacagaaagaagaaggcggttcatagaacagccacagcagatgataaaaaacttcagttctccttaaagaagttagaggtaaacaatgtctctggtattgaagaggtgaatatgtttacaaaccaaggaacagtgatccactttaacagcagagatgccagcaaactctttcaccattacaggccatgctgagacaaagcagctgatggaaatgctacccagcatcttaaaccagcttggtgcacactgtctgactagtttaaggagactggctgaagctctgcccaaacagtctgtgaatggaaaagcaccacttgctactggagaggatgacgatgaagttccagctcttgtggagaattttgatgaggcttccaagatggagaattttgatgaggcttccaagaatgaggcaaactgaattgagtcaacttctgaagataaaacttgaagaagttattgggagctgctattttatattatgactgctttttaagaaatttttgtttatggatctgataaaatctagatctctaatatttttaagcccaagctccttggacactgcagctcttttcagtttttgcttatatacaattcattctttgcagctaattaagctgaagaatcctgggaatcaagtttgaaacaaaggttaataaagttctttgcctagtataccaaaaaaaaaaaaagatttttaatttttttaactttttgactcttttgtaataccacttagcttacaagtggtattatgagtgaatgtgaaggcctaagacttatgcagctgtacaaaaatattttttccttatattcttattctataagctttattaaaacctttttttacttttaaaattttttggtaagaatgaagacacacacacacacatgcacgtgcgcacgcatctaggcctacagagggtcaggatcatcaatatcactgcctttcacctccacatcttgtcccactggaaggccttcaggggcagtaacagtcatggagctgtcatgtcgtataacagtgccttctgctagaatccctcctgaaggacctgcctggggatgttttacaatgagcctttttcttttgtaaatagaaggaacaaacttgaaagtaattattaaaagtatggtatagtaaatacataaaccagtaccatttattattatcaggtattatgtactgtacataattgtatgtgctatacttttatatgactggcagtgcagtaggtttttttacatcagcatcaccacaaacatgtaagtaatgcctgcatgtagacattatgatggctacatcactagggtgtaggaatttttcagttcattttaattttatgggaccattgtcctgtatgtggtgtgttgttgactatagcagcattatgtggtgcatgactatattgatttatctgtttctcaacataggcctctgtattagttctttttcatgctgctgataaagacatacccaaaattgggaacaaaaagaggtttaattggacttaacagatccgcatggctggggaggcctcagaatcatggcaggagacaaaaggcaaaaggtacttcttacatggcggtggcaagaatgaggaagaagcaaaagtggaaacccctgataaacccatcagatctcatgagactttttcactattacaagaatagcacaggaaagaccggcccccatgattcagttactgtcccctgggtgtgggaattctggtagctacaattcaagttgagatttggctggggacactgccaaaccatatcagcctctcagtttttgcttgtgttttgaggctgtgaaatatatacagaatatttcataagtggtgtatacaattgattatcatcattcatgcgttctgtatttgtggatatgcctatgtctccttgctaaaattgatttgtaaactcaaaatcaatacagtgcttttgtggtcactggtagacatgtggagagtgatctactactttgagtctcccaatgcacatgttgccacctcagaccaaataaggccacactctcccttcttgttttagctctcatgctttaaacaagtattcttttcatagtctatttagtgcctgaatgcctgctataggtaaccaatctcttcagtttctggtttatctttcctgcattttttatgtacaaagtagatacatacatatgaatttcatatatcttctttattatatagagggtggcatactacagctactcttgtactttttattttttttaagagacaagagtctcactccgtcacccaggttggagtgcagtggcacgatcatgatcatagctcactacagcctcaaactcctcgcctcaagggatcctcctgcctcagcctcctgaatagctgggactacaggcacgtgaccaccacatctggctaatttttaaatgttttgtagagatggggtcttgctgtattgcccaggttggtcttaaactcctggtctcaagcgatcctcctgccttggcctcctaaagcactgggattgcatttgtgagccattgtgcccagccatactttgcttttttcatctaaaaatatatcttggaaatcactctaaatcagtttatagagatctttctcatccttgtgctttattgtgtgagtgcatcatagcttagcgtctctcctgtgtatggtcatttaggttgttcctaatattttactattacacacatgctacagccttgtgcatatttattttcgtattgttggaagtgtatcttcagggtagattcctagaagtgggtcaaaagttaaatgaatgtgtagttttgtcagtttggccaaattgtttttttactatgcaaattatattattattattattattattgttattatttttgggatggagtttctctccaggctggagtgcaatggcgctatctcggcttacttcaacctctacctcccaggttcaagcgattcttctgcctcagcctcctgagtagctgggattacaggcacctgccaccaggcctagcaaatgtttgtatttttagtagagaagaggttttaccatgttggccaggctggtctcaagctcctgacttcaggtgatctgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttattgtgctttgtgtgagatgtggatctaactttatgtttttttttttaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaattttagtgtcaacttgtctaactccataaaatagcttgtttgtatttttcttggaatttcatgacttataagttaaattagggagaactgtaatcttttttttttttttttttttttttttttttgagacagagtctcgctctgtcacccaggctggagtgcagcggtatgatcttggctcactgcaacctctgcctcccaggttccagtgattcttttgcctcagcctcccaggcagctgggattgcaggcacttgccactacgcccagctaatttttgtatttttagtgagacggggtttcaccatattggccaggctggtctcgaactcctgaccttaggtgatccacctgcctcggcctccccaagtgctagtattacaggtgtaagccattgtgcccggctgagaactgtaatcttttcatgttgatttattctatctaagaacaagggatgtctttccattatttcatgtctacttttatgtcttatagggacatttaaattttttccttgtatggattttgcacatttcttgttaaatttattcctgtgtctttaggcctctttgttgctgttacaaatggggatttctccaccgtgatgttctgttgattttttctgtataaaaggtctatttttgtttgtttgttttgagacagagtttcgctcttgttgcccagactggagtgcagtggcatgatcttggcttatggcaacctccgcttcccgggttcaagcgattctcatgcctcagcctcccgagtagctggggttacaggcatgtgccaccacacccagctaattttgtatttttagtagacgcggggtttctccattttggtcagggtagtctcgaactcccgacctccggtgatctgcccgccttggcctcccaaagtgctgagattacaggtatgagccactgcacctggccctattttttttttttttaaagatggagtctccctatgttgcccaggttagccttgaactcctaggctcaagtgagccccctgccttagcctcctgagtagctggaaccatatgtgtgccgctgtgccccagggctattgattttgtatgttaattttatatcctgctagtttactgaattattttattatttgagttagttttatcattgattttggggggttatatctgcaaatagagatagttttattttttctttacccattcttaaccctctaattgaggtgtaatcccattggctgatacccttacaccagttttgaacagtagcagagatagtaaatattcttgccttgttcctggtcttagtgaaaatgccgttagtgttttggaattaagtaaaatacaggttttacgactaatatatatgtgtgagtggctgagagagttctagatatttagatagaacatgggaacagagattagagagagatttctatgaaggcttgtcaaattctagggcaataagtatatcacattcaaaaggtttcatttttcaatttgggagtaacaatgagatatgccattacagcaagtcatttgaattatataaattgtgtttatgcattataatggtcacaaagaaaattttatgcttgaatttgtcttgtagtgtgtgctgtatttatggagtttaaagattaatcatcccaaaacattgtttctgcttcggggaaatcatgaatgcaggcatcttacagactatttcaccttcaaacaggaatgtaagtataatcactcctctagaacctttttagttaccctttaacctgtccgaagtaaatcaaacagaaagaaaaaagaaactaatagaatttaaatgcttcctgtcctgttgttatttttttcacctgcaaagaactaagattctatcttctaaaacatttattttgaaaataacttttgggttcccccttgtttataaaataaataattcgggatatttggaaagcacagagaagtctaaagaagataaaagtgtccataatcaggttgcagtgagccaagatcacgccactctactccagcctgggcgacaaagcaagattccatctcaaaaaataaaataaaataaaagtgtccataatcatgccacttagaggtaatcactgttatcacactatttgaaatatggtcttccattcttttttattattatgaaatagttcaggtatacatatatctgtatatattttacaaataaaattgggctcatatgtactgtttaatacatttctgtttcacctaatgtagtagcattttttccatatcattaagtatttttgacaacatggtttgtaagtgttattttagtttttttaaagtattccatcttacgaacacacaatcatatatgtagccaatttagtaacaatcataggatatttaggttgtttctaactgtgactactgctgtaatagtaaaaataagtttaatataaaagtagaattattggccgggtgcggtggctcacgcctgcaatcccagcactttgggaggccaaggcaggtggaacacaaggtcaggagttcaagaccagcctggccaacatgatgaaacccctgtctctactcaaaatacaaaaattagccgggtgtggtcgtgcgtgcctgtaatcccagctactcaggacgctgaggcaggagaatggcttgaacccgggagatggaggttgtggtgagatcctgccactgtactccagcctgggcaacagagcgagactccgactcaaaaaaaaaagaaatagaattattttgaaagtcaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcaagactccgtctcaaaaaaaaaaagaaaaaaaaaagaaagtcaaaacattactagctgattttaaaaaacagataacatggtgggaggctgaggctagacgatcccttcagcccaggagttctacaccagccttggcaatacagcgagactccatctcaaaaaaacaaactcgtagatttccttgactagcatctagtactcataattggctgctcactaacaaacagtatgatgctgactatgttggggatgtttgggagatcctgccccagggcatttgcatttttagttcttcttttcccagatctctatctgcgtataagacatacattctatttcattcatgtcatttattccgagattttctcctctagttgcttttctaaatcataatctcatcattttaccctcataccctgtttcttttcatagtgtttatcaacacctgagatttatgtgtatttatttgttgactgtctttctctgccaccagaatgtaagctccatgctagcaggggtgtgttttgttcactgttgttttccccaacacccacaacagtattagttgctcatagaagttgcttagtaaatattggttgagttcatttgaatgaatgagcatctgtgatttgtatgtttagaacacactcttgaaaaagaatttctgggttagggggcaggcacattttaaagacttttggcatactctaaagtagtcttccagaaaatatgtatattgggttatacgccaaaaaaattttttatttttgtgatgaaagtactgaaataaaagcaaaattttacctgttttgacttctaaaattttagcatattctctataaaataaggaagctaaactaaatatcttgggtcccatctggctctaaaatctaccccttttaacgaatcctgaatatataaatatactttagtgttcatatggttgatattttgatcatggatttcattttgtatccagatttttctgcagattattatcttagaaaaatatattataaaatatttaaacttttattccaaaaataattttcaaagttaaaaaaacttttacatttgttttcagagactcaaagtttattaatctgccacagatccctttactgataggtagattgctatttatagtgtttcatatgctcatatgaattcttgctaccagtatcttcttacattggagatagtagttgtaatgaaaacatccctcctagtagagcctcaaagaaaaggtctttgttattaaaagaaattttagaggataatcacttcttaaaaagtccctctgtcaaaagtcagctgcaagagggcaagatacaaatccttccagcccttggtgacttactggaataaacactttaaatcagcagctaattaccaggaagttttaaatctactgttggtggatgtttaaattggtgtaagttgagcatggtggctcatgcctgtaatcccagtacttttggaggctcaggtgagtggatcacttgagcccaagagttcaagaccagcctggtcaacatgttgaaatcccatctctacaaaataaaacacaaaaaattagctgtgcatagaggcacttacctatagtcccagctactcaggaggctgattgaggtgggaggatcacctgagctcaggagtttgtggctatagtgagttgtgatcaccactacactccagcctgggagacatagtgagaccctgtctcaacaacaacaacaacaacaacaaagatgtgaggtatttgaagagcaattttgtaatatatttataaattttaagtgcatgtccccttgatctagcaatttcatttgtaggaatttattatgcagattgtgttactttttaaatgctgcataaaaaattatcacaaatttagtggctaaaaagaacacatttattatctcatagttattgtaggtcagaagtccaggccacagtgtggctagattctctgtataggatctcactgaaatcaaggtgttgccagggtttcagttctcatctggggcttagggtctttatccaaggtcacttgttggcagtccttgtaactgtaggattaaggtccctgttgtcctgttagttgttgaccagggatgactcttagcttccagatactgcttgcagttcggtaacatgtcgccaccagtggtagttcccaatatgaatgtttgcttttttccaggccagcctgaatgcatctctctgaccttctcttctgtgatcagctagctggaaaaaaaccctcactcagtttttaaaaggctcaccttaggtcaggcatggtggctcatgcctgtaatttcagcactttgggatgccaaaggggagaggatcacttgaggccaggagttcaagaccagcctgggcaacatagtgagacctcctctctgccaaaaagaaaattaaaaaactagaattcagtcagcctgcatggtggtacaagcctgtagtcccggccagttaagaagctgagactgaaggatagattgagcctgggtgtttgagattacagtgggctatgattgtgccactgcactctagcctgggtgacagagtgagaccctgtccctaaaaataaataaataagtaaataaatgttcacctgattagatcaggccctcccaagataatctttcttttgccatataatgggacaaaataatgggagtctcatcatacttacagttttcatccactgaaagaggagtggattatacatacaaagatgtaggtcaatgcaggtcattttagaattcgtctaccacacagatatactcacaaaaagatagtaaaatatggatgcttaaggatgttcactgcagtgttaattgtaacaacaacaacaacaacaaaaaggtaatctaaatgtcaacaagacagtgatgaaataagtgataatatgcttttgaacaatggaatgctaggcagctattgaaagaccaaggtggccgggtgcagtggctcatgctcataatcctacactttgggaggccgagatgggggcattgcttgagcccaggagttcgagactaacatgggcaacacagtagtaagactctctctctacaaaaaatttaaaaattagctgagtgtggtggcatgtgcctatagttgcagctacttgggaggctgaggcaggaggattgcatgagcccaggaattcaaggctgcagtcagctatgatcaccacactccagcctgggtgacagagcaagactctgtctccaaaaacaaaagacaggcagaccaaggtagacccataatatgtactgatatggagagatgctaagatattttataaggcatttgcagagcatgtaaatggtcatctcctttgtaaattaaaaatatataatgtacagaagaaatcattaacagtgggaggttgggttaggaggacttagagggtttttttgttttgtttttgttttgtttttgtttttttagatgcagtgttgacatgttgcccaggctaatctcaaactcatgcaatcctccagccttagcctcctaaatagctgggactataagtgcatgccatcgcgcatggcttacttttaattttatatcctctctagtattgtttgaattattttttaccaccactatgtactacttttataattattattatttttcaaattggtaatttaaaaattacccagttggggcccaagcatttgaaaagctttgtaagcacccaaggtagttcagctgtgtgctgctggttaagaacgacggctctggagtctttaggaagcttctactatctgtcgtttgggaaccacttcaccaaatacaaaaatgggaaatattttattttatattatttttctaaaccaaattttagggtattccttaacaccttcatttcttacctgggaaaattaaataatgtgtataagttaacaaatgccctggaatgtaatactcgataaaagctaattttatgaattaggagtagatacgtagtgaagaaagctgcctatggctgcctttgttttgaattaagtttcagagggttttttaggtgacatttttcttaattattcttttgtcttatcagattttttttatttttaatttttatgggtatatagtaggtgtatctatttatggaatacatgagatattttgatacagggatgcaatgtgtaataataacatcagggatttttttgacagactatttttagaagatggaacaataggtcctggaaacattttaagtatctccttttgcccagaatttcttaccttaggtttttatttgcttttcacatgatttaactgtagttaaacctgatggctttctttttctcctatctaccaagatattccttcttttttattataatgctgcatctgaaatgtaaataaatcttggaacaagcacacagattcaagtataagtttaaaattttattcttgtataaggagagagcatgtgtgttgctctgcatgggtgtttttactgataagctgatctctcttcagtggccactgtggcttttagaactagcatcttatcattaataagggaggcttagtttcagattgtgcagctgtaatcttgttcatgtttttaagagggaggtgggtgaaggcttttcttgtatcaatcttaaattgctttataatgcagagattttttaaaaaatattcctttctttatggaaaagtaataatgtttttttttaaattgatgtataatagttgtacgtatttttgaggtacatgtgatatttttactatatgtatacaatgtataattattatcaagtcagggtaactgcagtatccatcgcctcaaacatttattttttctttgtctaacagttaaacaaaatttatttttttaagagacagggtctcattctgttgtccaggcttgagtacaattgtgtaatcatagctcactgcaactttgaactcctgggcttaagtgattctcttgcctcagcttcccgagtagctgggactgtaggtgtgtgccaccatgcctggctaatttttaaattttttgtagagactgagtctcgcctatgttgccaaggctgaacttgaactccccaaaggatccttccgccttagcctcccagagtgctgagattacagatgtgagctgccatgcctagcccctaacagttaatttttgacatatcatttgtttttgcaaaaatatttcttcattgttatgtacttagaaagcaagaaacatagtgcctgcctccctccctccttccctccctccctccctccctcccttctttccttccttccgtcttgctctgttccctaggttggaacacactggtaaaatcattgcttactacagcctcaacctcccaggctcaagtggtccctacacctcagcctcctgagtagctgggactacaggcacgagctctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgcttcgtcacccaggctggagtgcagtggcacaatctcggctcactgcaacctccgcctcccaagttcaagtgattctcctgcttcagcctcctgagtagctgggattacaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcattgcagcattttttagagtagcaaaagattgatctaattagattgtggtatatccataaagcgaaatactaggtaaatgttaaaaaaattacaaagctctcctgtaggggaggcaaaattttacctttactctcagggtttttcagctgggcctgagaattaaattgacatgagataaattaataggagaagagcatataaatttatttaatataagttctacatgacataggagccgctataaggaaatgaagatccagagactcagagttgaacacttacatgctgaatcggacaaaaagtagtaagttgtgaaaaagtaactaaatgatgtgaggaggctagaagataagagttatttgaattcagtctcaactattaatccttggtgataacaatgttattttccttctagtacagggagggcatcttttcttttttttttttaacttttattttaggttcaggggtacatgtgcaggtttgttatataggcaaacttgtgtcataggggtttgctatacagattattttgtcacccaggcactaagcctagtacccagtagttattttttctgatcctctccctcctcctaccctccatttttaagtaagtctcagtgtctgttgttctgggagggcatctttcaaatgggaatttcatctcctgcttttaaaaagcagcatgagccaggcactgtggcacgtgcctgtaatcacagctacttgggaggctgaagtgggaagatcgcttgagcccaagagtttgagaccatcctgggcatgtaacaagaccccatttcaaaaaaaaagaagaaacagcatgaaggccagagtgatcttcttgtacgtgtggtttttcaagtgcctttaactcaaagttgtcagtgtgccagagtggtgtattttggggtggcatattcttaactccactcttcatctgaagatgtggcatgatagccaaaatacgttcttaagtacgaaaagcaagtaaagaacagtacatatatgctatcatttatgtaaaaaccaaaaggatgttttggaaagagaagaaacatatatgtctgcatgtgtatgcatagaacatctttgtaaagacacccaggaaactggtaatattggttacctgcagagagagggcaggaggcacattatacccttttgtggcttctaaaatttgagctatgttggggccaggcacagtggctcacgcctgtaatcccagcactttgggaggccgaggcgggcagatcacaaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgatcccgggaggcggagcttgcagtgagccgagattgtgccactgcactccagtctctcaaataaataaattaattaattaattaattaaattaaataaataaaaaataaaaaatttgagctatgtctcacgcctgtaatcccagcacattgggaggctgaggtgggaggatctcttgaggccaggagttctaggttgcagtaagctatgataatgccactgcattccagcctgggtgacagaatgagaccctgtctcaaacaataataataaaaaataaataaagcaaataaaaattgaaacaaatatatcatcagtgactagaccagattgtgatttcttgcaagtagtgctgactctcaaaattgctttcagataattttgttgaaaattttgttttgttaatgttgtattattgatactagttagaacttgtatcagtgtcatcctgtggctgtaatgcattttcccttcactatagaaataactgttttatgggatatatcctaaaatttgtcttgaaaataaagcaattgaatcagctaatttaacctctgggaattatgtatttggctatttagattctcctattcaaaatcttatttaaaaataatgattaggaggaatattagagggtcattaagagcatgaacaggtttaagtctcagttctgccagttacttgcttgcagctttgggcaggtaagcctaatttcctcagtttttaaatgaagacagtaataatacctacttcacagggtttctgtgagtattaaatactttcatcagttaacacagtatgtactaagtgccagcattattctgcatattttacataaatgaattcatttaatcctcacagcaaccctgaatctactgtttagggtgttattattattatgaccatagataaggaaaccaaggcacagagagttaaaatttttatccaaggtcccatagctagtatgtggagggggctgcagttcttcaaatcaggcaacaagttccagactccattctcttcaccaccatgccatgccaaatgcttaactcactgacagacacatcatgagccttcaatacatttaaataataaaggtaatataggccaggtacaagtgcagtacctcatgcctgtaatcccagcactttgggaggctggggcaggaggattgcttgaggccaggaattgaagaccaacctgggcagcatatcgagaccctgtctctacaagtaatttttaaaaattagctgggtgtggtggtgtgcgcttgtagtcccagctacttagaagattagacaggaggaccacttgatcctaggagcttgaggttacagtgagctatgattgcactactgcactccagcctaggcaacagtaagatcctgtctctaaaaaaatttttttaaaaggtggtataataataaatgttattatataaagattacatattcatcataaaaaagaaagaacagctaaactaagaaaaatatagataccattgtcagtctaacccctcagaaaattaaatactggtaattatatatgcaattcatatactttgaaaaaataaacatggtgatatttcatagcctattttattcacatattaatataacatgaacttctttttgcttaatttttgacctcctgttttaatttacaaaatgacaatacacttccttacttgtccagacttggcattcttttttggaagtaggctaaggaattattttgagtcattcttgggattgaaaggcatttatcaatgtaagatgttatggagcataaattaataagtaattgaaattcctacctctattcaagtgtggaactcccatggaggaattccttactgacactggcaacagagggaactctggttcctaggattttcaggagaaaaagtcaatcactgaccacaaattaaagagttttctgtttgttttttacttccaacagactttatggccaatgctggatctactttgaaatgggcaaaatttaaaacaaagcagagtataaggatgtaactgtaaggagaggcaatgatgcataagacatggttcttgtgaactttgagctcctaataaagttagcatatgttgtggaatagattatgctgactgctacaacagcaatacaaaatgttctgaaaacctcaaagaaacccacaggctcccttaatgaactcaaaccctaatcacccagtattggcgttaaagagaaatcttcacactcagggatggaaggccttacaacctcaagcgtggtctactggtttacactttccttagggatctctctcttaatcattcctgccacccatatagtactgcagtctggcccaaatctggacccatcattcttcactttattccccaaaaccttgccaggaccaggctctgatccttaaatatgtctttctaaaggcttagagatcacaaaaaggaaataaacacagaaataattaccaactagatagtctgactcactcgatacagctttggtctcttggtcctgtaggccacctcatcttcccagaatcctggaagaggagaaggagctcacggttctgcagggttgcctgactatatttctcgtcttctctacccacacacatccctgagcacagcttgactttttgaaaccaaggccaaggaagaagaaaatgttcctttttctctttaaacacccattttccagtttcccacctattatttcatgacttttcctttccagagatttgtagagactcctccttccacccactgatgtatttccttattctgtagccccaagttgacagccacatcaaaatataatttattaagccaaacatttattttttattgtttagagacagaggctcactctgttgctcaggctggagtgcagtgacactatcgtagttcactgcagcctcaaactcctgggctcaatctatcctcccacctcagcctcccaagtagcttggacagcaggtgtgtgccaccacagccagctaattttgtttttcaattttctgtaaaaacgaggccttggccaggcgcagtggctcacgcctgtaatcccagcactttgggaggccaaggcaggcggattgcggggtcaggagtttgagaccagcctggccaacatggtgaaaccccgtccctactaaaaatacaaaaattagccgggcgtggtggcgtgtgcctgtagtcccagctacttgggaggctgaggcagaagaattgcaagaacccggaaggcagagctgcagtgagctaagatcccgctactgcactccagcctgggggacagagcaagactccgtctcaaaaaaaaaaaaaaaaaaagaggcctcactgtgttgcccaggctggtctcaaactcctggcctcaagcaatcccccgacctcagccttccaaaacattgggattacaggcgtgagccaccacaccagtttaagccaaatgtttttagagaaaatagaatcaagacataatttgtttacagaccttaaaaattatgagcaaaaacattattgacattttattgatgtctcttaagactccagtttccacttatatatcttcaacacccctaagagatctttaagacccaataaaatattcagactcacaagactaccatggaccctagttgtcatccatatacttaaaaggatataggtcaggaagggcagcactgggcattccttttcagtggagtggtcctcacaggagtgcataccgcagtccagcagctttccatctctcttgccccctcccatcttctcaccagctcaggtacaaggaaatatccacagtgggaagattagggagccatcctggtatagaagcctcgtgcatcaaaaatgtcaatgtgtgttgtaaaactaccttcagaggagcccaaagctatagcttcccaccaggtaactgggtaatttttaccacaagccatgttgcctaataacacagtggacagtcaccttatcacatttccaagcaacagagctggaaagttaatccaaggtcacacttgtctttaagaggagagaggtattgttaacctattatccacaacttttcaaaagtatctttacaaagataattgtgctttcaaatcatctaaaataaatggctctaaagtagcttcatattctcctggcctatatcctttttcaaatgtgatacgttttagttcttccattgactggttttccttttttgttaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaagtaagtaatcttttattattctcacagggaatatttttaaaatgtgttgggtttttttgttgttgttgtttgctttgagacagagtctctctctttcacccgggctgaagtacagtggtgctatctcagctcactgcaacctccgcctccctggttcagcctcccgagtagctggatacaggtgcacaccaccacacctggctaatttttgtatttttagtagagacggggtttcaccatgttggccaggctggtcttgaactcctgacctcaactgatctgcccactttggcctcccaaagtgctgggattacaggtgtgagccaccgcacgcctggcctaaaatttgtttcttattgcagtcaaccaatatatctttagctgaaatctttaaaatatagataatgaaaagtaagaaaatggaagttacctctgatttcatcactataactactgttaacattttgatatgtacctaccacaaattataatttttaatgagctctatgtttttaccaactagaaagctaacattcttgtagtatagtcctgaaactttgaattatatcgcagtgcaaaaggaaggaaaccagggttctaatcacagtcctgccattaactgtgtaaccttaaccaagttattgaacctcttagtcacatttcttctctatgaaatgaggaagttggaagggatggtctgaggacactgccagctccgaaatgcattggctttgacattttagatgataacggtttcattgttttacttgccttccttggtgattattatttccaagattctgtatcttcattatggaaaaagatgaccaatttttattgtacatggttgtcttatcttctctacctttgaattcttctacctgtctctctgtcttttttaatcaaagtgatagatactcatcctctcttacaggtactgagactaaaaatttttctgtttataaaactattttctctgaagaaagtctcctcagggtaagagggtgtacctatatgtactggctttcctcttgccttactgtcttttaagtaaccagcatttctcttttacatagtaaaatatgaattttataattctgaatcaattgtatcaataaaaagctctttcacgcagtagaaattctcttcttggcattcagctattctattacttgttttctcttggtttttatgctttcaactaaagcagcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctgtcatggtaacattggctcacctagacaaataaaattaattttatatagtcatagtctttctaaaatagtatatctctatagtggttgatttcacatttgaattaaattagcactgctttacgattaggatgtaagagggtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaaccccatctctactaaaaatacaaaattagccgggtgtggtggcacatgcctgtaatcccagctactagggagggtgaggcaggagaatcgcttgaacctgggaggcggagtttgcggtgagccgagatcgtgccattgcactccagcctgggcaataagaacgaaactccgtctcaaaaaaaaaaaaaatttatttcagaaaaataataaaaattatgtatctaaaattgttaagtgttccttttcttgcaggaaagtcctttaggggcacactggcttctctcctaatacattcttgtgggtgaaaggggtttttctttgacacatactagtttccaagaagccttttgctctcctgatttttttcttttggcttttgtgtgtcttctagttagacaggtttacggaacctcccgcctttggacctgtgtgtgacctgctttggtctgatccctcagaggattatggcaatgagaagaccttggagcactatacccacaacactgtccgagggtgctcttatttctacaggtaagctagtccttgaggtcgaaaattatgaaaggaaactgtaattcattttatcagatgatttttcagcattttatatttcaaatctatgtagtataagcactcctgtttaatttttcgattaataggaggcaagaaacttgtttgtttgttggctttttatattttcttaggtatatatcctaagaagtgtaatacaccaaacatgattggacatcctgcagtgctctgatatttttgtctgactctaagtgatctagactatttgttcctaaacattatctatacacttttttaaaaaaaattaaagctttcttggctctttccccagagattctaatacactaggtctgagaggaatcctattgtattttcaaaagctctccaaattttgtaaccactagtatagactaagatataaaaagaacaggacattgtgaactaagcccagtacatttcctggaagttggctgttgttttaaatttcacaggagctttcattatgattagacactcaaaaataggaagacaggcagggcgtggtggctcacgcctataatcccagctctttggggtgcctaggcgggcggatcacttaaggccaggagttcgagaccagcctggccaacatggcaaaaccccatctctgctaaaaataaaaaaattagccagatgtggtggcaacacgcctgtaatcccagctaattgggagacttcaggcaagagaatcacttgaacctgggaggtgtaggttgcagtgagccaagattgtgccactacacaccaacctgtgcaacagagcaagactctgtctccaaaaaaaaaaaaaaaaaaaaaaaggaagacataagagaagttggaaatctaaattatttttaatcccagtattttattgtggcaaataatacatatgtttatttccctaaaaatctctgttaattggctaagataatgtgttcattagaatacacacatgcacacacacatgaaactttgatttcgccattacttttagcattcttctaaacaacctttttttctttaaaaaaatattttttaaaatttttgtgggtacatagtaggtatatatatttatgggttatatgagatattttgatatagtcatacaatgtataataatcacatcaaggtaaatgagttatccatcacctcaagcatttatcctttgtgttacaaacaatccaattattactcttttatttattttattttttgttgttttttttttcacctttttttttttttttccttttttgagacggagtcttgctcggtcacccaggctggtgtgatctcagctcaccgcatcctccacttcccaggttcaagcaattctcctgcctcagcctcctgagtactgggattacaggcacctaccaccatgcctggctaatttttgtgttttttagagatggggtttcaccatgttggccaggctagtttggaactcctaacctcaagtgatccacccacctcagcctcccaaagtgctgggattacaggcatgagccactgtggccggcctcttctagttattttaaaatttacaattaaattattattcactatagtcaccctgttgtttaaatctcacagtatcaaatactaggtcttattcattctttctgactgtttttttcgacccattaactatcccatttcccctcttactacccttcccagcctctggtaaccatcattctactctcatctccatgagttcagttgttttaatttttagctcctacaaataagtgagaacgtgtgaagtttgtcttcctgtgcctggcttatttcagttaacataatgacctccagttccattcatgttgttgcaaatgacaggatctcattcttttcaatggctgaataatattccactgtgtatatgtaccacattttctttgtcctttcatctgttaatagacacttaggttgcttccaaatcttggctattgtgaacagtgctgcaataaacatgaaagtgcagatgtctcttcaatatactgatttcctttcttttatatacatacatagtagtgagattgctgaattacatggtagttctgtttttagtttttttgaggaactccaaactgttctccatagtagtgtactaaacattcccaccaataggatatgagggttcccttttctcgacatcctcaccagcatttgtcattgcctgtcttttggataaaagtcattttaactgggtgagatgatatctcattgaagttttgatttgcatttctctgatgatcggtgatattgaataccttttcatatacctgtttgccattttatgtctccttttaagaaatgtctattcagatattttgctcatttttaaattggattattggatttttcctattgaattgtttgagctccttacatattctggttattaatctcttgtcagatggatagtaaaaagtctttttttctttcttcttcatttattttattttatttatattttattttattttgagacaaggtctctctttgttacccgggctggagtgcagtggcaccataacagctcactacagcctcaaccttctggactcaagcagtcctcttgcctcagcctcctgagtagctggaactatgggcatgtgccaccatgcccagctgctttttttattttctgtagaaacaaggtcttggctgttttgcccaggctggtcttgaagtcctagactcaagtgaccctccctacttggcctcccaaagtgctgggattacagggatgagccccacccagccaacaaccatttttcattcctccatgccaacttttccagtgactaatgtgatgaaatcatttaacttttatttctttttacattgcttaaaataaagagcataatacatattcattgttgtcagaatagaaattggtacaatttctgtggacatcaacttggcaatatctttcaaaggtatttgtacatggcctttgatccagaaattctacttctaaaacttaatcctgtagatatataattgattctcattacttgtggatttcatatttgtgaattcccccacttactaagatgtatttgtaacacccaaatcagtacttacagaggtttcataatcattcatgggaatgtagtgtgcaatgcaacaaaaaatttgagtcacctcactcacatgttcctagctgaggttgaacaaaatgatgccctaccttctttttgcagccctcatattgtaaacaggcattcttttgagttttatttagtgaaagatgttttatgtttttgtgcttttcatgagtgatttcactgtttagaatggccaccaagtgtagtgctgaagtgctgctgtctagggtccctaagcacaaaaaggctgtggtatgtcttacagagaaaatatgcgagtgttagatataagctttgtttaggcatgagttatggtggttttggccatgagttcaatgttaatgaatcaacagtgtaaatgacctaaagtattattacacagaaacacatctgaaacaaggttatatattaattggtgggtgaaaatgttatgaccggagcctcacaggaacttcaccctgtatttcccttagcagtagtgtttcattatttgctaattctgtttttgcagcaacattatagaatgtagctactgggaataatgagataaaaaatttgactcacccagcacacatgttcccagctgaggctgaacaaagtgatactctgccttcttttatcccagggataaatcccatttagccacagtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctgttgtttttctattctctatttgattcatttctgccctaaactttcctttcttctgcttactttgggcttatttgattctcctttttctagtttcttgaagtgtaaaataaggttgtttaattcagatcttttttgttttttaaatcggcatttattactataaactttcctgtaggtactgcttttgctgcatcccatacattttgatatgtatatttttgttttcatttatcttgaggtttttttttttttagataggatgttttgctctgtcacccaggctcaatgcagtggcacaatgatacctcactgcaaccttgaactcctgggctcaagcagtcctcctgcctcagcctcctgagtagctgggactacaggatgtaccgccatgcccagctaattgtttttaaaatttttagaggagatgaggtcttgctgtgttgcttaggctggtctcgaactcctgacctatctagagataattttaaaattcctttttgatttcctctttgacacaatagttgttcaaaagtgtggtgtgtagtttctatgtatttgtgaattttcctgttttcttaagttattgatttctagtttcattccattatggtgggaaaagatacttaggacgatttacatcttcttaagtttgttgatacttctttgtgattatatagcctaaagaatattctgtgtacacttgggaagaattctattcttctgttatttggcaaaaagttttgtatatgcgtattaggtccattgggttcatagtgttgttcagttctgttgtttgcttattgatttctgactggatgatttatccattacagagaatgatgtattgaagttacttgctattattattattattttgagatggagtctcgctctgtcgcccaggctggagtatagtggcgcgacctcggctcactgcaacctccgcttcctgggttcaagcaattctcctgcctcagcctcccaagtagctgggattacaggcatgcaccatcacgcccagctaatttttgtatttttagtagagacggagtttcaccatgttggccaggctggtttcgaactcctgacctcaggtgatccacccacctcagcctcccaaagtgctgggattacaggtgtgagccactgtgcccgtcctacttgctattattttattactgtcaatgtttgccttcagatctgttgttgctttatatatttaggtgctttgatgttgggcacatatatatttataattgttacatctttctgttgtattgacccttttatcattatataatgacttttgttccctcttgtgatgatttctgacttaaagtttattttgtctgataaaagtttagccactcatgttctcttccggttacttacttgcatggaatacctttctctacccttttactttcagcttatgtgtgtctttaaatctaaagtgagtcttttgtagacagcatgtagttgggtcttgttttcatccattcactcatactatatcttttgatttgagagttaaagtaatgattgataggtaaggacttactattaccattttgttggttgctttctgttttgtggttctactattcctctctttttctctttgtgatttgatttttatttttgtagtggggtattttggttctttttatcttttgtgtatctactgtgcttttttgttcatcgggtttgcatcaaacattttatagttatagcactctgtcttacgctgagaagaaattactttcaatgacgtatagaaactctacactttagtccccattcacacacctaatgtaattaatttcaggttttactttatttttgagacagggtcttgctctgtcacctaggctggagtgcagtggtgcgatcttggctcactgcagcctctgcctcccgggttcaagtgattctcctacctcagcctcctgagtagctgggactacaggcacacaccaccacacctggctaattttttatatttttagtagagatggggtttcaccatgttggccaggctggtctctaactcctggcctcaagtgatctgccttcctcagcttcccagagtgctgggattacaggcacgagccactgtggccagctgcatcttttagtttctacttgaacttcctttagttgctctcataaggctggtgtagtcatgacaaactccagtttttgtttgtctggaaaagtctttatctctccttcattcttaaagggcaattttgatgagtaaagtattcctggttggcaggtttttttttctttcttttagtactttgaatatattatctcccgctttcctggcctgcaaggtttcagctgagaaattcactgatagtcttatagaagcttccttgtatattatatgacaagtaggttttctcttgctgctttcagattttttctttttgagttttaacaacttaattataatgagtcttggtgtttaacttatttggagacctttgggcttcatgaattgaaatgtcccttttcctccctagatttgttaaactgttagcctttagtttttaaaaataagaagctttctgcccctttttcttctccttaactcccatatgcctgtattattttcacttgatgttgtcccataagtcctgtatactttccacattcttttttattcttttttctttttgtccctctaatgctatcatttcaaatgacctgtcttttaagtttcccagttcttttcttctgcctgagtctgctgttgaagctgtctcttgagcttttcagttgagtcattgtattcttcagctccaggatttctatttgcttcttttttatggtttctgtttctttattaaacatctctctttattcatttatttgctttcctgattttgtttagttgtagttcattgagcttctttaagatgattattttggattctttgtcatgcaattcatacatctctatttatttagggccagttactagaggtttattagtttcctttggtggtgtcatttttgcctggttctttataattcatatagccttgcaatggagtctatgcatttgaaggagcaggggccttccagtttttatggactcgttcgccaagtaaataccttctcctattgagtccctgggttgatgggattgcctgtggtattgtgattaagcagggctgaagctagattatggggctacattagggttcacagtcagtgggcgtaccactaggggcatggacaagtatgtcccatggatggggagagctgtctctggaactcaatagggtgggacccaagctgggtcccaggctggtttgggtttatgtttgggtccaatcagcagcccttttaccagaggaatggacaggcatgatttccacaaggcccctgttaaggcaggacttcctcttggccacagtagagcagggctggagccaggtcagagtgctgctttgagtctgcagttgggtctggttggtggatctgttactaggggcatcaacagacatggttccttcccaggatggatgaggctggtggtaggactgcagacaagtgggactggagccgggtttacaagggacaggctgattctgggtctgtagctgaaaggtcagtgggcctgccttctccaagcagcccttcctagtcttgggctccaccaaggtttcataaccacctacctcaatcctaaggttcttacaatggcacttatggccatggatggcttccaaactattgtttctgtaggaggaccagggctggggacattctcttttgctatcttgcttacgtcacctacaacctactttaaaagtaaatttgttctaatgagcataatgagaaacaaagattttaaaaataaactaaataattaatgcctaagtaattccaggttaattttgtatactccagttcttcctatcaggtatttgtcattcagagaggtaatagtatgaaaagaatattttaggagtatatgagaatattgtatctttttttagaatatggttggctaaaatatttacatctgctcctaaaatattcctgcataagcttgcagtgagccgagattgcaccactgcactccagcctgggcgacagagcaagactccgtctcaaaaaaaaaaacaaacctatatatatacatatatatgtatatatgtattcctgcataatattatcttggtgtttatattacctgtgaagctgtaagtatattcttttatttctgtaacaatttgacaattgaagaaaagtatgtgttgaatttttagcatctactacacacacacgcacacacacacacacacacacactactgttgtactttgtaatatcaagacactgataaaagttttggtgttgtattgttatggattaagacaaaaaaattaaaagatgagatggaggagctctttctattgtaggattatctattgttttcatgtttgatctgtagtgaagtatattagtgaaatagagaaacagaatgatgagtactaagctattcataaaatttcagtagtgtgtaatacttgtagttttgaaacaaaatcagctaatatcaccttgacttttccccatcttcctattaaaaaaaattgttttaattctggatttatgttttctaattttcttttccagttaccctgcagtttgtgaatttttgcagaacaataatttactatcaattatcagagcccatgaagcccaagatgctgggtaagttacattaaaattgtaccaaatatcgctgcagagtctttgcatttaatatgcagacagatggactttcatctctttttcaggtatcgaatgtacaggaagagccaagccacaggctttccatcacttattacaattttctctgcccccaattacctagatgtctataacaataaaggtaaaggaatccagcaatatttgagtttgaatttatgagtaaacgtgagctctggtttaattgtatgtacgtatgtgtgtttgtgtcattttaaaacataaattttaaataagaaaaaaaggggtcttagttgaaacaaaggccaagaaatttagaatttatgctgctgcttggtctttatctcctaaggattactggcttctttgtgagtataaataatgatcataataggtcagattgatactacagaatcaaagtataagaagaataaattgcttcaggctcatgccagaatagttagcataaattattggttttggtgaatttaatgtgtttataacagtatctcaaagtcaccattggtattttaatctttgtgaattattaaactatttttgtttttcttgagatatggtctaggtagagtgacctagtgtacaaagtcaaaaaaaaaccttcatttttagtttaaaccctgccagaaacgaatactgtgactttgagtgagtcacattatctttctaatcttcagtttcccatatgaaaaaagaagaatggatatatacatgccttttgttccagaaattttacttctaagactttatcctgttaaagtcttttttttaatttaaaacttttatgattaatagtttataagttttctatcgaggcagtggtcctactaaaaacttcatatttctgtaactattttgttgtttataaagtatgactataaattaataggactttgaaaataaacatgccagaacaaacatatccaaatgagtattgtcccttcaaagtagttaccttgggaggctacacacctattccaacaatgctgtccttgttcaaaaacatttttggaactcctcttttggcattgccttcagagtctgcgacacattcttttgattatcctcaatgatgggaaatcttcgtcctttgagggtggatttgatttttggacagccaaaagtcattcggagtcaagactgataaataaggtgagtgatcaagctagatgataccatttggggtcagaaacaaggtatgattataaggtaatgagactggtttttctcgtgttgctgatacagtggctctggaggcacttccaaaagaggagttccaaaaacgttttgagtaatggcagcatctctggattaattatatggtaaggcaacaagttgtgctgaaaagaacacaaagcaaggagtcagtctagtcctgcttcacttttaagtgtgtcacatttaacaagatacttctctgagcctcatctttaaaatatctgtcatatggggttgttgaagataagttggaataaggaaaatggatattaaagtgttgttcaaaatataaattactataataatacagattttactgttattgtacctgatgtgataatatcaaaggaccacactcatctgataaaaaggtctggtgtgtttgtagctggtggtttcttaagtctcattactttatagttataccttgtatatgcagttggggagataagtttcaaagatggccaaaatataattaatatttactctatttaaaagtaaaccatggaatggcacatctcatttaaatccgatttgggtcagtcattttagtgtgtcctccagtgacttgtctattttaaaaagcatgtctttaacttaagttctgtcctagtcttatgttttcatttaacttagcattcttctctgagccttatctgtcctacaatgctctgcttctccctaagttcatttgttatttcctttttcctgatatttccagtatattagcaacttaggttttattcttatttattctcttatcaatggtgtggactgtttgtgttgttaaacgtcttcaaggactcttgtggccctagatctcctatttgtaatgaaggtgtttctttctcactttcttttttaacttcatcaaaaagagtatctattgattgctcaatggatttatcagtgtgccaagctgaaacacgccacctaagtcagcaggcactatacagctcactcactgctagcttgttttttgtctcaatctaacctggttttgttcttgattatttctttagcaaacttttaacatcacagtcctggccaggcacagtggctcatgcctgtaatctcagcactttgggaggccaaggggaggatcacttgaggcctagaattcaagaccagcctgggcagcaaaatgtgaccccatctttacaaagaaaaatttaaaagttagccaggcaaggtggagcatgcctatagtcctagctactcaggaggctgaggcagtaggatcctttgagtccagtagttcgaggctgcagtgagctgtgatcacaccactgcattccagccaggcaatagagcaagaccctgtctaaaaaataaaaaaaaaagtaaaagccacagttcattctacctgagtattctgtcggctttgacataattagtaacttttatctcaaaacagtcttattttcattggttgtttcttaagcattttagaaggaaaaaggcagaaaatgtggcatttgaaacagtccctgggggtactcagttactccccatacaagtgccttcttttctgaaaaagggaactctattattctttttcttcttccttttcttctactgttgctcttctttctctttctctcttttcttttctctctctttctctctctctttcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctcccacctcagcctcccaactagctgggaccacaggtgcatgccgctacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggtgcacgtcgccacgcctggctaattttttttattttagtagagacggggttttaccatgttgcccaggctggtctcaatctcctgagctcaggcaatctgcccacctcggcctcccaaagtgctaggagtgctctttcatattctttagacttcttggtatctacaggtatttcctagttccactagttacacgaaagacctttaatcatgatttttaaagattcttattcttgttttcttctgtccactgggaacacacccaaaagcagttttataagctcttgtttccagtcattcactgttgagactcacctcccacttctttttcctgggtagaaattgagggagttgttgaataatgatatatgacatatttacctaaactaaataaaatacatacacgtgaaaataatggaacatgtacatcatagccagtgttaggctttttaagtgctagaaactatattttaatttattttcttaataatatatggtgtacattttagacattcaataacttaaattttaagaacactagattatcctgtagcaaagaaacaggaatgaggacgtgacctatatctgtcatttctggagaactgttacaccctgttttattttatgaccacagaataattaagagaatagtgcaaacaacattgctggtgataaaggctaaggaattggattttaagactttcaaaatataaagaaaatcagtttggcatcaaagtatgtgtgcgactatctgaatggttaatattaaacatagcatgctggcaatacactgctgtgtattggagaaatcggcaattttaaaatccgctatattgaatacagagatgacttaatctaattttgaacatttaattgtaaattgctccaagtttgccatttgtatcttccagtatgagttgataactgcaatatataaactcccagagagtgtatacaatctttgactctggctaatgactagcaaaacaggctgtgtccatttaatgagtaatttttgccttcaaaggagagttgtaattataaccatttggcctataaaaggaaattatggggaaattttcctcacgtggatcttgaggtttatatagatagttactgtgcagtgactccaaagtttcagtttcttttgtacttttattatatgagctcttcaggtaactttgttccttggaataattcttaagagaatgaactgaataaaaggctttaaaattttccatctgccctttacctagtcaagtcctgactttacaaatggaaagttctcgaattctgtgtagcaggtacacagctgtacaaagcataccacttgccatgccatgttcctctgtgccagattttcttgcttttttcctttttagctgctgtgttgaaatatgaaaacaatgtcatgaatatcaggcagtttaactgttctccacacccctactggcttccaaactttatggatgttttcacatggtctttgccttttgttggggaaaaaggtaagagaactaaagcacatgtctcatcagttgtttggtgactgagcataccttatatttgcatgagcccctccatgattcagaaatgttttctaattttgtttgttctctacatagattttttttttttttttctgagatggagtctcgctctgtcacccaggctggagtgcagtggcacgatctcagctaactacaacctccgcctcccaggttcaagcaattctcctgcctcagccttctgaggagctgggattataggcacgtgccactgcacccggctaatttttgcattttagtagagacagggtttcaccatattggccaggctggtctcaaactcctgaccttaagtgatccgccctcctcagcctcccaaagtgctgggattacaggtgtgagccaccgtgcccagcctctacatagatttgtaaatggcatgtaattggttcttaaattttaatatattatggtttttttattgtaaatatcaatttaaagtagctgacctactatgatcaagatgttaaaataacatagttacttgtcattccctcagatttcttcagtactgaagagatttaaacagaatttattgtccttacaattttatttgtacagctactcaaattagctaagcctgttggacgtaggcctgttggcttaactttgtaaagtgggaaaaaaattttctcacgtgtgtatcagtgtgggaagaagctctgaacagcaatccggtaaaatcaagtaattaggcaatagatcttcaaagactccagacttttactggagcaagtaatctacccaaattctttttaaacctgaaagtttacatttatgctactttttatagctattcttactaacataatgataaataatttttgcttatgcttacttaacatgtgtgtttatttagatatccacattattttagagaaagtacctcattaatcgcgtaaattttggattattttgtcttacttagtcacagagatgctggtaaatgtgctcaacatatgctctgatgacgaactgatttctgatgatgaagcagaaggtaaacttttcctcctttgaactaaaactagaaagaggtttggttttggttttagttgttttagtttattttgaatgattttctttgtcttattaaaaataaagttagttcattgtagaaaaataaaatttgaaaaatacgagaaaccataaataaggaaaaaaagtcacccataatcccatcatcttatagatatccacagttaacatcttaatgtatactgtgttaattgtcttttatctttgcacatagctttcctctgtagtacactatttttgtggagtttctttgtagactagtttctaatggatctgtagttgtccatgttgatcagtgttgtaactaatcccggtggtgttggttattggagtttttcccaagtttttgctgacaaaacccatatagttttgaacatttgtttagataaaaatgtgcacattctcttaaccaatatttattacatgcttgatatataccaagtactgtattgtttaggtccttgctctcaataagcttatttgctagtgtagggaggaaaaacagtaaataaatatgtcagatgaaaggaagtaaagcaatattagaaaatcaggaataacacttcttgattatttccataggatgaatttgtagaaattgaatatctgtgtcaattagtacttaaaattacaattctgatacagatagaaatttctgatacagcctctagaaaggctgtaccactttacattttgcaggatgcatagtcacagtgctgtctccaatactgtttatgatacttgttatagtctggtgttactaagtttttaattaaatttttagtttatatttttatgagactaatggacaattttttcttgtgtttgttggcaatgtttatctctcttttgtgacttgtcaattcatatcttctatcctttttttgagacagagtgttgttctgtcacccaggctggagtgcagtggcgcgatctctgctcactgcaaccttcacctcccgagttcaagcgattctcctgccttagcctcacgagtagctgggattataggcgcgtgccaccatgaccagctaatttttgtatttttagtatagatggggtttcgccatgttgcccaggctagtctggaactcctgagctcaaagtggtctgcctgcctcggtctcccaaagagctgggattaacaagcatgagccaccatgcccagccccattttgatttttttcttattggtgtgtgagggatctttttatacagtaacattttattatatatgtagccaagtactttttttcctagtgtgctgtgggaggtttgattataaaggtaggtcctgacttgtctgacaatgcaagagattctggaaaagtggtggtcatccaagcacaaaccggcctcatcctatccaggctctgtgctaaggtggttcccttaactgtgaggataaaccatctccatcgtggagaaaacacaactccctttgggaatctagaggaaattaccatacactctcatgcttcaggttctgcactcatgcttcaggttccgcactgaagatcaacagcatatgcaagatagcttgcgagtgtttttatttatggtataggagatgactacaaggaaccagttcttcttgaggaaatagtgcagccaagtgaaaaacaaaagaaaaaccgaatatccccctgggcaacatggtgaaaccccatctctactaaaaatgcagaaatcaaccagatgtgatggcgagtgcttctggtcccagctacttgggggcctgaggtgggaggattacttgaacctgggaggcagaggttgcaatgagcggagatcttgccactacactctagcctggccaacagagggagaccctgtctcaaacaaacaaacagaaacacatatatttcctattctttcccaccacaaacataaaaataaataaataaataaataaataaataaaaaggaagaatgggccgggcatagtggctcacgcctgtaatctcagcactttgggaggctgaggcaggtggatcatgaggtcaggagatcgacaccatgctggccaacatggtgaaaccccatctctactaaaaatacaaaaattagctggggtgtggtggcacacacctgtagtcccagctactcgggaggctgaggcaggagaattgcttgaacctgagaggcggaggttgcagtgagccaagatcgcactactgcactccagcctggcgacagagcgagactcatctcaaaaaaaaaaaaaaaaaaaaaaaaaaggaagaacaattatatcccctgaaagagaagctatagaatccattaaacaaaaaaacatactattcctgtgaagagatttgtaaactgttctgtcctccgtttttgttccttgtttttggcatcatttattctgcaaataatatctttgtttaatgttattttcatgatctgtggggttagaaaatattggatgctcatagatgtgaattaatgtaaaaccataaacttttaagaaatggaagaaactactgacaaaataaatttgcaatttaatgttgtatcatgattccaaggatatctcttatgagctggtaaagataatagcctgtttctctcattgcatttcactttgatttttttttctcttttccatgtaaacataaatttctcttctcatatttctgtcttcatctccttgtttcttggtgtttcttctccctgaagatcactacattccaagctatcagaaaggtatccgactaaactgtgctaagagcttaatgcttactctctgtcccaccatagtctattggttagacttaaaattggtagttgaataatttcagaaaggctctccatccgccccttcagttttaatgtatatgttttctctggacctgttgcgtgatctggcagggtgctgagggttggatgtgaggaaggagaggccatgtttctttttctgacttttgactgtagtcacctggtgcatgctggaccttggcttctcatgtgtgggctattttcagaatcttagataagaaaaagccataaagtcttaagttaactttttctgttgttgctttttaaaatagtgcacagttgtaagtagtatcgtgaggcaataactcactaatataagtgaagcttatagaatgaaagcagccctcactaagttcaggagagctagctgggtgttgtgtttacatacagaagacagctgctggaatgatcacttgccatttggcaggccgaaccctgcaccctaaggtggcccacagcattatcaaaagacatctttgctgtagcagctttctttgtgaggtttgtttatgtatgtgtgtgttttattctttgctgtgctctacgtttcacaaccacaaataagttcctacctctcatagatccacccagtctgtcttttttgtggcctctcattttttacttcatctttttatcttctgagtcattttttctcttgctccttagaacttcctgagatttttgtttgtttaaacaaacttaagccttcatttctgttttttaaaaacaattgtttctttaacttaagacacttcatcctgaattttttaaaggcagcctattaacacatccctttaacttacttattctttgtattctctaaggaagcactacagttcgtaaggagatcatcaggaataagatcagagccattgggaagatggcacgggtcttttcaattcttcggtaaggatgtctgtcattacagtgcggattaaaggcattttgagagtaaattagacgtcgaattcagaacagtttttttataattggaatgtagtattgaaactgcaggtctttaggttgagtgcaaattcaatgaacatgtttaagcgactaaaaatgttccagcaaacattgatttgttagtagcttagatgtagtgaatgtagtggtttagtgtggactttccaacccgattgcctgtgttcaaattctggctctacctcttcttacctgtgtgatcttgggtttcatctctgtgccttagtttccttgcctgtaaagtaataataggccctagcgcacaggttgttaggtgtattaaatgggatacaatatgggaaatgttagaacagtgcctggctgttaaacacttctaattgaaaaacaagaactggctgattgtttaaaatgaaaatatttgtggaaaacatccctttctttgagtcagggaaggcgtaggaggtaggagaacctatcttccatctctgctgtctttcttcacttccttcaatatctttaagttgctgaatggagagttctcgggcattaacccagggtttggtctccctttgcaggcaagaaagtgagagtgtgctgactctcaagggcctgactcccacaggcacactccctctgggcgtcctctcaggaggcaagcagactatcgagacaggtgagtatgagagtgctcctccatggaaggtgtgctcccgttacctaacagtcagcacacacttacaaatgggggctttcctcagaaaatgccacgagagcagttggttataccataagcggggaaatgaatcttcacccctacttccctccatacagaaaacctaaatcagaatggcttattataacttcagtgtaaaaagcaaaacagtaaaacaagaagaaagtatggagagtagacactggggtagacagagtccttaagtaggacacaaaaagtactaaccttaaaaagccagttgaatttcattaaaataaagaacttctcttcttaaaaatacatgattaagagaggaaaaaggcaagacacaaaatggaagaaaattttttgcaatacacgtctcacaaagcccttgtatccagaatatataaagaactataaatcaataggaaaaaacaaatttcaaaaatggtcaaaagatttaaacaggcacttcacaaatgaggatatcaaagtggccaataggcctggcacagtggctcacgcctgtaatcccagcactttgggaggccgaggcgggcggatcacctgaggtcaggagttcgagaccagcctggccaacatggtgaaactccgtctctactaaaaatagaaaaattagccaggtgtggtggtgggcacctgtgatcccagctactcggttgcctgagacaggagaattgcttgaatccgggaggcggaggttgcagtgaaccgagatcgcgccactgcactccagcctgggcgacagagtgagactccatctcaaaaaaaaccaaagtgaccaataaacatatgaaaagatcttaatattattatagtttttcatctaggaaatagatattaaaaccacactgagggccgggagcggtggctcacgcctgtaatcccagcactttgggaggctgaggcaggcagatctcttgaggccacgagttcaagaacagcctggccaatacagcaaaaccccacctctactaaaaatacaaaaattagctgagcatggtggcatactcctgtaatcctagctactcaggaggctgaagcactagaatcactggaacccgggaggtggaggttgcagcgagccaagatcacaccactgcactccagcccggatcacagaccaagactgtttcaaaaaaaaaaaaaaaaacaaacaccacagtgaggtaccattacatacccactagaatggctaaaaattaaaagtttgggccagggcatggtgacttacacctgttatcccagcactttgggaggctgaggtgggaggatcacttgaggccaggagtttgaggctgtagtaagttatgattgtgccactgcactccagtctgggcaacagggcgagaccctgtctccaaaaaaaaaaaaaagagtctgacaataccaagtattggtgtgtttgtggagaactagtactaggtatgttgctaaagggcttgtaaattgattcaagcgctttagaaaactactgggcagtaaagctaaacatatgtctaccctgtaacccagcagttccacacctggtgtatatccaagagaaactggatgtgttcaccaaaggttatgcatgggaatgttcactgtagctttattcataatagctcaaagctggaaacaacccagatgtccatcagtagcagactacataaataaattgtattccgaaatataaataaataaactgtattctatttatacaatggaataatactcagcaataaaaaataacacattatggacacatgctacaacatggttgaatctcatagacattacagaaaactgcaaaagccagacataaaagagcacagactgtctgatttatataatatttaagaaccattggactaatcagtgataataaagtcagaatgtcacttcctctggtgggagaatattgtcccagaagggcacagggaacatctagagtgttaggaatgttctgtatcattatcatggtggtagttagacatgcgtatacttatgtaagaatgtgttgagctgtacacttcagatttgtgcacctgctgtgcctcgtgtatattttgtaccttaaagaaaacagtttgagggggttgcagtttctcaatcagagagggagtttgcctctttccctgcagccatattctattccagtgccaaaatcacctcttcaatcagagtaccaattctgaaatttacccaggagctgacttcttaggaaagggctttctggaatcccggaatgaaaaggttgatgttcgtgagaataaacatgcaaggggaagagacaggagatcatattactgggtgactaacactaggtatgaaaattggtattgaagcattaatatcttaaactaaagtttaactgctttttttgctccccttgttttgttgaattgtttctatttagtttttttcccacctcatcgttcatctggccttttttctttttctttttttttcccaagagacagagttgcccaggctagaatgtaatggctaggtactgtcatagctcatggcagcgcccggttgctgggctccagcaatccccctgcctcagctactcgagtggctgggactacaggcatgtgccactgtgcctggccatcctgccatttataggagtcctttttcttttgtagaaatttcattgctattgactaacagggacaaacccattttttttcttttcttggagacagagtcttggtctgttgcccacgctggagtgcagtggcacgatcttgcctcactgcaatctccgcctcccaggttcaagcaattctcctgcctcagcctcccaagtagttggaactacaggcgtacaccgccatgcccggataattttttatattttagtagagatggggtttcaccatgttgcccaggctggtctcgaactcctgaggtcaggcaatatgcccgcctcagcctcccaaagtgctaggattacaggcgtgagccaccgtgcccagcccttttttctttttataagattgaattcctccttctctttcaaatagaatactgagatattagagttcagctatttagaaggaagtctgaacattttctctttggaagtatagtttattttcctagttcctttagtttcacagaaagtatcagtaaactatttccgattgaatatttttctcaaataaatgtgcagttttttgtgagcagaatatgttcccaccattgctttgcttggtaattagtcatctgagatattccgagagcaactctgacaacaaagatagagtaataggcagtaacatgagttaagagaaaaaaaggaatgtcctatagcatccttaggtaaacattatgaaaatttgctgatccacaaaattgttttaattgaaaccaactttgtctaaaccttgagaaagcaaatctgcaaatcagggctgagcaacagaattatatagctatgttatttggaaatttgtttctaattcttggtcaccttttgggctcagccccaaagtatgagttgaatatgagtgttttaatcaagataggaccattgattgatacttccaaagttgatagaaatcttcagtaatgtgtgagaacaaaggtaaagttggagccaactttttagagtttcttattcttattgattcacaggaagtgagtttattttgttattttcacattggagtctcagttccaccagctcattggctaactggagcattaactaaaaaagaccttttattgttcatataacttaacttggagagctttcaaccaacagtatcccatatggccatgtaacatacattcatgtatgtctcaccttgatctaagagggattggcgtgagttacagtatacatgaaacatagtggagtaaaataaatatgcttggaaattgaagcacaaaggtaaataaaaataaagccaatagccacaaatttgactctaagcatcccagtagccaaaatagtggggaaagccaaggacaggacaagattcacaaagaccatcagattaaaacagatcagttataaattggactacatcaaaattaaaaactctgtactgcaaatggtactatcaagaaaatgaaaagacatcccacagaatggttgaaaatgttttcaaatcatatatctcctaagagattggtatctagaaaatatactcttacaactgaataagaagacaacccagttaaaaatgggtaaagaattgaattgacatttttcccatgaagacatacaaatggcacatgaaatgatgtttgacatcattagacattcagaaaatgctaatcaaaaccacaatgggataccacttcacagtcagtaggatggctgtgaaaagacagcagttaataaggagtgttgatgagaatgtggagaaattgggaccttcttaacactgctggtggaaatgtaaaatggtacagctgctttggaaaacattctgacaggtcttcaaatgattaaacatagaattgacttattactcagcaattccagtcatagctacataccccacaaagaaatgaaaatatgtcctcgcaaaaacttgtacacaaatgttcataaatggcattcaacataatagccaaaaagcagaaaaaagcaattgtccataaactggataaacaaaatgtggtaaacgcaatggaatactattcagccataaaaaggaattaaatgcaggtatacatgtcaacatgactgaaccttgaaaacattatgctaagtgaaagaagtcagtcactacagaccacatattatatgatgccactcatttgaaatgtccagaacagaccaatctagagagaaagtagattcgtgttcaaccaggattaaggggaagaggtgagggaaggaaatgggaagtgagtgctaataagtgggggatttctcattggggcaatgaaaatattctaagcacagattgtggtgatggttgcacagctctactatattaaaaccattgacttgtatactttaaacaagtgagttttgtggtatatgaattctatttcagttaagatgttaaaaaggaaaacaaaagttcgggtcatttgatatgactgtttcttataatggcccttactgcaggctgctatctttatacccaatgtgaatagcaattctgggagggccccaaacaaggtaatatcatacacattttaccgtgtagcttttaagctctaattagaccaacactcagtgtagagtttcagcaatgctttgttctcccacttcctaacagttacatcagtgatgtgctgtgagaaggcactgtagctttcttgtcaagggtatttgttctacttaaggagattagagagggtgtgacagtgatttaatacatgcctgcctatggttgacaaatgaaagcacttcataagtagatttcagttatccatttttcacattccattaggtagttaatgtagttctttcagtttctcttctcatattgatatataaagccttgggaatagcagcaaactgttactgctcattattcttcactgccttcttttggcaaattggtactggagtaactgacagggttctcctaataggatctttcttgtggcaccctgtaccttttcatatattagcgtttttactgtctgagaaaggagatgcaaggaagtttacctgttggtactaatttttaagttgcttccttttccattgctaagaaagaagagggctttcttagttactggccaactctcttgaacactgtatggaagccatatggattggaaacattagcctctgctatatttttatagcagatgggtacacacatttgcattaggaattcaatagttctatgcttttgttagctttgtactccactcctggacaagaaataacccttcacatggaacctatttttctctccttccaaatgccagtctgctgttcaaaggccactcttttttttttaaatgaagtaattaatagggcagttggactccaaataagtcacttgagagcagtaagatgtagttgtaaataagctttttgaataggacccagcagtagctcatttaatatcacctgagatattttacaaactaaggattgttgtgatgtcaaactatttgattctacatgttgtttcgatacgtggatatcaagatataaagtagcagttggctacctaaaatgaaaagagcaatgttccatggcacctgaaatgttaaaaatattagaaactctccccaccccatattcctcccaccccaattgagtctctcgcaataatcttctcgcttctctaactagttgactttcattatggatggggataggctaaaaaacgggcccctgggatggctgtgctgccatcagtgctgttggtttactcactctttttctgtcttcgtttttgcatgctactgctcctgccctcttacagccacagtagaagcggtagaggcccgggaaggtatggccatattactctgatagatgtgatccatgtgtctgtgtactggtttttcgaagctttatcaacatttcaaatattttattattgcatcaccagaactataacagtgagaaaaggtatagttgtttctaggcatgttaacgaagcaggtgtttcctttgtgtcctatctttgcattaattttaaataaccttcaccacagctacagttttttttctgggctctatcagctttaatgcaacggcagaagcttaagcaactggtcatgagaggtcaagtggtttacttctgtatcccttccatgtacaagagacatccatttgattctcaagagagccaaataggtcagcctcttcagcgattctaaaagatttcaagagcagaggcagaagtagactggaatttagttcaattcatttctgaggttgccctaaggtaggcaagttaaattaactttgtttctatgaaaaccattggaactgataaacttgtattatacttgtaattgttttattaggtaagatggttcaaaatgcgaatgccttaacttggtgttataaaagttgaatcggaaggaaaatatgtagaagctatttttaagtttttaacttatgtacagctcctggttgtgcaagatagaaagctgtcctaaacgaaaagattagctcttttgttacttttttttgtggtctatgtggcctttgtgcgaaaagcaactaccctgggtttaacttgttcaattattctagtgttgcctttgttctagcattgagtatgtttctggtgcataagacactctttcttaaaggtactggggcccagtaagtacttgttagctttttgttaggtatatgtctaccatgattatgcatatagagcttttatgaaaattactttcacaatttcagctgccctttgggctttaaggaagcagtagctgcagccaagactgattcagtcagacattgcccatgactttcactagacgtgtgctccatagccacctttctgtgtgtttctctaggaggttgctgtgtgctaagaaactttttttaagcctgttgctttgctgcctaattgagctctctccacctgcttcctgtttttctgtagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaactagtcagtcttcattattgttttttggaaggtaatgtctttcatgtaagactaataacgtttcaaatgcaagaagattttttccttttcatttttttccttttctgctgggtgccattgaagaaagtcctcttagatttcagtggctaaaagtgcttcccttttgatgggaaactggatcatagtagaacttcaaagtgaataacccaaatccagtgattttaagggcgaagggaaatgttttctataataacctactttctctggactctcagttcgtttaaatatgttctagtaaacaaaataaaaaataataagggatgttcttagatttacttaaaatgtgttcatctgaccatgggcatgattggtttaaatttccttaggactttggaggagaaagattttcagaaagctttcacaattgccagattattttactttcatttttgaaccccaggtgacttctgtaaaggaagtcactttctaaatatttgataaatgccctcagcagcaccttctacaacaagatgtatatatgcccttctaggctgttggcatcagctctcgcatgtgccttcccatcatccttctgttgttccctgtcagtattactgaaaccagctggggtagtagaaactgacaagagttcaatggtccccttgtgaattgaaggtcttgctaaagaacattggataagtgaggatttcctgtcttctatatcagttactctttaggttgaatggtatttcagccttcattagcatattttggaatgcgaaaagcaagtgttcagatgtagtgtgtgaattatcttcccttagtttgattttcaagtcacaaccaactagtgaaggaaattttggggctacttaggctcccattttaactagcctcatcgcaggagccgtgtcataatagtcattggtcagctctgcagtgaatgtacatgcctgggaacattacatcagagcatggaacgtgcacatttatggcattccttagtgtcatttgtgatgcggcagtctagcactaaagcaagtatttcagacagtaatacttcatattgggagtttccaggaaaccagaaaaacaaagaacaacataattttggtggtgtttttttttttccccaaaaaaccatacttctcattagaagaatgaagacttagcccatctatctctgttttcctatacctttttttctaacagtttctgatttgtttatggcagaaatcaaggcactcttagggaatggaatctgcctgcatagattgctccattaataaaaagataggaaggagataaaggatctctgaatgggttgtgagtaaaacctgtgaaagaaggggggaaaagtctctagtaactgtcttttcctgattgttgttgaactcaaatcgggtattaagcacctagatatccttatgctcctttcttttccaatcccaggattagaaaagatcctgtctttggaaatttcactgatgaaagtcattccatgtgacagactgcagagctgctagtaccttatcccttttctccttttcattaaggctgttacatatatacaatccacaggtagaaaccactcttaggggcctccataagcaggcagtagtagaaatagttactgtaaatccttataagcaaaaaataatattttattacggatgattatttaggaatggcttcactattgtctcaaaaagcagaatgataaagcaagtttccttgacagaaccatcacaaaattatatacagtatttcactggttccctctgagctgtggaggaatcagccagagtagagaggtaggtggtcctggttcaagaaaacctgagtaagttttagagcagcactaactcttagaggaggttaagtttgaaaattcggttgaattctaaagataaagttatcccttccgttctgtagctgttttaatgtaaacaacaacttccaagatggctggaccctgccctgggtttgctcgaag

SEQ ID NO: 17051 - DNA, 113967 bp, Human
  misc_feature (1)...(113967): n = A,T,C or G
gtttattaactaaaatttggctccttttaaatcatgaaattagagtgtttgaagaagcattaaagctcatctagttcaatcctccatctgattatatagtgtcctactaaataccaggttatacataattagtatagtgatagagtactcacagccatatatgtctagagcagctcattccatgaattccttccaaaattcactgaaaagaaaactgtttgttattgcttcaccaagggaataaagaaggctgtggtccaaaaataagatcaccatcatctccactgcataatttataggatttagagtcaggctgtgaggaagacagttcaggaaaagacataactgcaggagtacaactatttcttctgatttttgatacccctctcttccatttccaccaaaacgagaatttatttcaatgacagcaaatgttcatatagggagaatagttgtacagtatagagaagccctaaagtgtgtcatttatctagtgtctaattataagtggcttgggcgaaaccccatagctactaaaaatacaaaattagccaggcatggtggcgtgcacctgtaatcccagctacttgggaggctgaggcaggagaattgcttgaacccaggaggcagaggttgcagtgagccaagatggcgccactgcactccagcctgggcgatagagcgagactccgtctcaaaaaattaaaaatgaaaacatacacagggtcgggcgcggtggctcacgcctgtaatcccagcactttgggaagccgaggtgggcggatcaccagaggtcagaagtttgagacaaacctggccaacatagtgaaaccctgtctctactaaaaatacaaaaaattaactgggcattgcggcgggtgcctgtaatcccagctactcgggaggccaaggcaagagaatctcttgaacctgggaggtggacgttgcagtgagtcaagatggtgccactgcactccagcctgggcgacagagcgagactcagtctcaacacacacacacacagacacacatacacacaatacacatgtgattggggttgtggagaagcattgaccatctgtaagcccctagagggtgggggctataggttatttgcgttttttacaagcaggaccatgtcaggcatataatggatgcccatacatgtttgaatcaatatgtagcctaatacagtgatattggcaagacgggtttagaaacattgttttggttcaagatagagttactgcttcttctacttcttaggtagggctagaaatcgaatggagaattactttctgttcatgtatgggcaagcgattcattgccagccctgtcaaagacacatagagttttttttctcattgcacacaggatttgggtgattaggaaagtggagcgagtctactaataaaccgttgtaatagcacgcaaagcaaaaataaattcagcgtattcgtcccatgccaatttaggagcatatttctcaaattatgtttacgtaggttttccctagagtgagtggttcccaatcttgttttgtcggtatttgccatcagttgtcattaattcattgttattaatgggaagtgctctttgatccgtcggaaccttgctcagtataggccccaaatgttcctttaagcctcggggaaaacgactttggctggtcggtgcccaaagccacacccactaagaggccttaggaaacctggggctttcctggcggcgacctagctgtggcaaccacgcggcgcgtcgggatcccatgggtcgcgcttgttttccccgtgggaggcgcgtccccctcctccgcccggccggccggccgctggaccagctgcctttctggccgggacgccgggcccctttccgcacgcggcgcgccccgagttcatttgcatagggacgcgcgcggcgccggcgagagggagggcgggcgcggccgggaagacggcgcgcgcgcgccctgacagctcggccctgctcgctcactcgctcgtccccggcttccgagcacagcatggcggtcaaggtgactccaactctctgctgctgcttttattgcataagagacattccgagcgccctgcctgcagccccccactgcttcccattttattcattgtctaggtcttagatagcttgtcctggggctccggcttgctgcggggagagctgtgcggggcttggaccggaggaggggatgcccggctgggggaggggaaggaggagggattgtgagttgaaggggcttgtacggtaacacgggtcagtgaaggaagagtaatgtcctgtcctaggtgcatgggattgtgagtccggagttggagggcatcagaaagggtgtgggaggaagtggcaagtaaagctggggatacctagggtatcagtgaattgcggtgggggagggagtaagtattgagtaatttggggcctcaataaggccgagggcagtggttggcttttgcgttgcagattgcagggtatcgaaagtatttgtatttgtggcagctctcatattttaggttggatggggagagggacgcggagataattacatgttgggtttgctttttatggagaaaggctgctaggccaagtgattaatttgggtgatttaactttcctgttgatctactcttgttagcttcttgatttgaaggtgggtggttactactgtgttgctagtagatgtggaataaagtaaaagatcctcattgccttccctttccagtccagaggaagcactgtccgatagctttgctgtatcttaggctattcgcacctgtttttctgccctctagtcacagttatccagtttgacagttcttatcagcaattagggcttttagtttgttttaaactaaatgataaaagataggagcattgattgttagccatgtgacctctaatctgaagagattgtgtggtctctagtgaagcattaactggcttttttttcttttttgcttacaggtgcagacaactaagcgaggggatcctcatgagttaagaaacatatttctacaggtaaattggcttgcatagtgtgcctttcattgcaaaaacaaaaaacgtacatgtccttagtcctattcatgccttaactttgaggaatgttcagttttcatgtattctttcaaacatgaccggacaatatagcttatacttctcttaataaggtttgatttaaggccttcttttaattaagggtcgataaaaggttttcctcaagttactgcttttttttttacatgacttaagatatatattttgaaaaaaaatttccagcttaagcacagagaccaagataaaatttcaaaatgtattggcattcttgtatagttaataggtatgatgactaaaattctcttccttgaaagttgcatgtttacaaagttttcctacttatgagctatcctccatgtaatttgttacagagataagaatattatagctattcttaatttgtgtgtcttacttacattgtatccttaagcctttggggattttaccccaaaatgttacctcttaagattcttgcaatggtctaccttaacttctaagcttttagaatcagtgacttggctgtagacttaaaaagaaaagaaaaaagaaaaaaaaaaggttggcttagttttttgttttgctttcttttcttaaatttcaaaagtttcctatgcaggaaattgtacttaagaagtagatgtaggccgggcgcggtggctcacgcctgtaattccagtattttgggaggccgaggcgggtggaccatgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgttaacccgggaagcggagcttgcagtgagtcgagatcgtgccactgcactccagcctggggacagagagacactgtctcaaaaaaaaaaaaaaagtagatgtaaagggaggcaagctaaggtgtttcaccaaatattgcatttctctctgaaatcttttgagaactttctattctggacctgggttcttatgaagacactttgaccttgggcaggtccctgctgtgtattattttcctctgtgaaatgagaggtgatctccaaggttccttcccattccaaaagtctatgagtctattttaggaacagattctaacatatgctgatgagcctggaatagatgacatttttatttgagatatgtggtttgcttaagctattgttgggtaagacgctgcgtagttgagcatacatatgtgtagtttatgaaaaataatttgtgaaaatgggaatcttaaaggtcataatatctgataagggaagtatttttttccagaacagaagtaattataataacagaaatggtccatttatgacttgaaacctttattccttgcaggcattcttgaaaatagccaaaaatatatcggtattcaccataccatgtgattatagtcaattgttttgtgaagagttcatgtgatatagttaattttatgttctagactaagtagatgcggaagaaatgagttgaaatgctgcatgatgtagtgaaaagaatactgcctaggtatctgagtactgcctaggaatacggagttaattcccagccctgcatttatctggttcttgtacccttaggctaatcatctggccttcctgagtttcagcttctcatgtgggactcagtgggacataaaggaatgggaattgaggtctttctagctttaaaaattctatgggaaaaaaatatactgtgattctgtatggatttgttttttgtttttgagtgggggtagaggtgggttggaggtatgaggagaatggcgaggactgtccctagctctttgacaacttttttttttttttgagatggagtctcgctctgtcgcccaggctggaatgcactggcgtgatcttggctcactgcaacttctgcctccggggttcaagcaattctcttgcctccgagtagctgggattacaggcatgtgccaccacacccggctaattttttgtatttttagtagagacagggtttcaccatgttagccaggatggtcttgatctcctgacctcgtgatctgtgtgcctcagcctcccaaagtgctgggattacaggcgtgagccaccatgcctggccgattctttgacaacttttaaatcttagcttttcatttactgttttgcatatcgtcattatctttttacacattattttgatgatgcctttatttttatgttgaaaatttgtggaattcataactgcttatttagcactaagtatgaaacattgacacaagcattattgatagataagagagtgatagaatgtaaatactcaccttcagaaaggcctaacgcagcaagaaagataacaatataggctgagtgcagtagctcacacctgtaatctcagcactttgggaggctgaggctagaggatcacttgagcccaggagttcaagaccaacctgagcaatatagtgagacctcgtctctgcaaaaaattttaaaaattagccacacctggtggcatccatctgtggtcccagctactcaggtggctgaggtaggaggattgcttgatcctaggaggcagaggttgcagtaagccaagatcataccactgcactccagcctggcaacagagcaagaccttgttacacacacacacacacacacacagacacacacgatacagtattgctagttggatcaatttgaggatagttaccaagtaaaagatttttattcctggcttgaatacttcaaactatagttatttgaagctttgcagtactgtttagaaacagttttatgaaacagttttatagatgcatatagttgattaatattttagctataatagaagacaaaaatacatgctaaccgtgtatttctttagcacttaacatatttacccaacaaatatttacaaaggattatttgctgtgtaccatgcacttttattcaatacaatactgttcagtagcagacaccaagtcgaatatcaagagagacaacagagccaagacctaaatgctgatggacatgtgattggactagctgctctctcaggcccatgccatctctcatggtttgtggttgagggaatcaagaatagtgaaggcaaatgcatagcctgtggtagagcaatcagattggcttcttacatcatagtggctgtgtaataatattgacaatggctaacatttattgatcatttagagtgtgcttgagattggcctagtgctttaaggatattaatgttagttttcataacaactttatgaagcaggtttaatatccttgttacatagatgaggttaaattaatgtcagactatgtggtagagccagattcaaatcaaattccagagcccatacccttaacccttacataatactactggtaggatattgaaatggggtgacttttgaaagacagaggtatatcaggggataatggcagagtgttaagaagttaaaaaaaaatctggttacttaggtgatgaaatttaaaaagtttctttacactgtaactgtctagaatagttagccaaggaatttggatttgaaacagtagggagccactgtgggtttctgagtaggcaaattgaagtggtgaattctggcagctttttgtgtatgttggataaagtatgaagagattggaagtagcttaggtgataagctgagaggctactgaagtaatacttttgagaattaatgacctagagtggttgatggctggggaaatgaaaagcaaggacaataccagcgatgtaagggaagaatctatcgaatttggtattaaatatggaagtaagggaagaagtagaagtgaacctgtcagttttaggataggtgttaattgataaggcatctatttggataatattttttggggggatggggttagtttggttgctaaacaaatgtatctcactaagttaaagttggatttggacagatacaaatttgtgcaggtggtagatgaattccttgtatataaagcaaggcagaggatcaggggctgatttataagtgatatctccaattgaagtaggaaggaggaggaggggaaatagggagaatggtcccatgaaagtttaaagtaggagtttcacaagaaggatataattaaaggttaaaatgtagattattctgttattagtatgatttagtttggggaggattttggggtcacttgagtttagaattatctgagctacttaaagactataaagagatgtaattttaaattttagagtacagttgaaaactctttgtaaaatgtagatctgtggcattaactgtttaagttcacaaatagtcaataaaaattcctactttcaaataagaatattttgttaaacttttgagccatgggtcaaaagtcatttgtaaaacaataaaatggccgggtgtggtggctcacacctgtaatcccagcaatttgggaggctgaggcgggtggatcacttgaggtcaggagtttgagaccagcctgggcaacatggtgaaaccctgtctctataaaaaatataaaaaattagccagatgtggtagcgcacgcctgtaatctcagctactagggaagctgaggcaggagaatcgcttgaacccgggaagcgggggttgcagtgagccgagattgtgccactgcacttcagcctgggcgacagagcgagactcactgtctcaaaaaaaataataattaaaaaaatatatatatatttttatttgaaagtactggtatatcagctgggtgcggcagctcatacctgtaatcccagtgctttgcgaggctgaggtgggaggatcacttgaggccaggagttcaagaccagcctgggcaacaaagcgagattccatggctacaagtatatgtatatagatttagctgggtgcggtggtacatgcctgtggtcctagctgctctggaagctgagatgggaggatcacttgagcccagaagttcgaggttacaatgagttatcattataccactgcactccagcatgggtgacagaacaagactttgtctccaaaaaaaaaaaaaaaaaggaaaaaagaaaagaaagtggcaactgacttatttatgtatctatgtttagtgaaattgtatgagaattggtgtgggagttcataagaagggctttataagagtaaagcattattattttgaatatagggaaataggttcatttttcctgtggtgttcattgcttctcaagttttgatgagctatgtttctattagttaaaaaacatcaacaacaacagtatgcactaagattctgcctttttctgcccacctccactctgccaagttcatgaaattggagtacaacaaatgaattcttatgtgttaggctgtgctgtaattttacaactggtttaagctaagattttaccattaccacccttacaactgtcatttcttgatttatcccttttttcttttaacctctctcacccacacactgtcattgattcaatttagctacatcagcagtgtacagtagcaaaaggagacaatagaagcagtgaagaagaaggtgaggtgggacagcaggaacataagtctgacaaatttctaaatgaagagttaattttgtctgtcccttgtggcaaagtagatttatcaaaaacatttaaatgaattattttttaatctctctctctttttagttaataggcttcttttgtttgctggtgtgttgtatagtaaaggcaatatatgttaagactgcaactatatttgccagatcaaaaatttactgaaatgtagacctcaaatattattttaattttgttcttttttcattatcaccaatgtaacaatgaagatcgtatcccatacaaaattatgaaaatgtgcttttttcctgtcttattttaggttagagaataaagaggagaagatactgttaatgtaaagcaaagggcgattcctccttagggtttttacaataacatttatttttaatagaaagatatgttcttttattcaaatagtttatgtattttatttacttatttttgacagtagcctggagctgagaagggaataaagcagggcttttagcaggagacccttactctttgttgaaatatacattagggctgtgtttccaaaagtgtggaaggtataccacaatattagagtaacaataagattatcaagtattaaagggtgatacagtatttgtggaaacaaagactctgaaaagcaagctggcaatggtttaaaataaaaagaaaatatcatttgaacaaacaatggtattttcttttggattatttatcccagagaaataaaaatatttgtaaaaatataagaatatagggcaagatgtggtggctcatgcctgtaatcccagcactttgggaggccaaggtgggcggatcacaaggtcaggagattgagaccatcctggctaacatggtgaaaccctgtctctacaaaaaatacaaaaaaattagccgggcatggtggcgggtgcctgtagtcccagctactcgggaggctgaggcaggagaatggcgtgaacctgggaggctgaggttgcagtgagccgagatcgcgccactgcactccagcctgggcgacagagcgaaactctgtctcaaaacaaaaaaaaaagaatatatatgtacaaggttaactgcagcactgaatttttcctcaaaaaagaaaaaaaaaaaaaacagcctaggcaacgtggcaaaaccccatctctacaaaaaatacaaaaacctagctgggtgtggtggtggcatgagcctatagtcccagttacttgggaggctgaggtgggaggatcacctaagcctaggaggttgaggctgcagtgagccatgtgcaccactgcactccagcctgagtgacagagtgagactctgtctcaaaaaaaaaaaaaaaaaaagctattatattaaagaggagtggtagaagacttatggaataactatactatgaaagttatgcagatactaaaaagaatgagttaggcctagaccaccaatttagagaaattttgcaatgtactattaagtgagaaagatgcaaataagtatatatagcatgattctgatttgtaaaacaaagtcatttcatgtatgtttacatataatatgtttgtgtatgatttaatgagcactgagaaagttatgaaaggataaatactaggttgttaacttgagggaagaataaagaggaaaataaaaatagtctcaatgtatatgtattaagctttgagcaagtgagtaatttaaaaagtaagaatttagcaattcagagcctgaagctacaagaggatttcccagcataatttggattgaataaacccagtatgagacacacagaaaaggatctatagttttattaaccatgctattataattgagggttttcaccagttcctcagaaatatggaaattgaagatgataacctatttatttatttatttatttatttattgagacagagttttactgtgttacccagactggagtgcagtggcatgatcttggctcactgcaacctccgcctcccgggttcaagcaattctcatgcctcagcttcctgagtagctgggattacaggcacatgcctagctaatttttgtgtttttagtagagacagggtttcaccatcttggtcaggctggtctcgaactcctgacctcaggtgatccacctgcctcagcctcccaaagtgttgggattacaggcatgagccaccatgcccagccttttctaaatactttagaaagtatttaacataaactatatagagttctcattaaaaaaaaaaagaacagtattaggcattaaaggcagactagcaggatagtgagactttgtccttgaatcaagcagaaggattgaaaaataataaaaagataagaaaattagtgttattaaatgccatgtgatgttctactaccaatcaatacactttttttttttttttgagacggagtctctgggctcactgcaagctccgcctcccaggttcacgccattctcctgcctcagcctcccgagtagctgggactacaggcgcccgccaccacgcccagctaattttttgtatttttagtagagacagggtttcaccgtgttagccaggatggtctcagtctcctgactttgtgatccaccctcctcggcctcccaaagtgctgggattataggcgtgagccaccgcacctggccgatcaatacacttttaattgcctactttgtaccaggctaagcactgtactaggttctacctttatagagataagatagagctgtttagtgagggtagggacaatacaaaggacctcagtgaaggtagaacctcacattcttttttttttttggtgggggacagagttttgctcttgttgcccaggctggagtgcaatggcgcagtctcagctcactgcaaccactgcatcccaggttcaagcaattctcctgcctcagcctcctgagtagctgggattacagatgtgcaccaccacacctggctaaattttttttgtatttttagtagagatgggggtatcatcatgttggccaggctggtctcgaactcctgacctcaggtgatgtacctgcctcggcctcccaaagtgctgggattacagatgagagccaccatccgtgcccagcctagaacctaacattctaggggcgaggtggacaattaaaaaagcccacagagcagaccacgaggtcaggagttcgagaccagcctggacaacaaggtgaaaccccgtctctactaaaaatacaaaaattagccaggcgtggtggcgggcgcctgtaatcccagctacttgggaggctgaggtgggagaattgcttgaacccaggaggcagaggttgcagtgagccgagatcgtgtcattgcactccagcctgggcgacagaggaagactcagtctcggggggaaaaaaaaaaaagcccacagattggctgggcacactggctcattcctgtaatcccacctctttgggaggctgaagcaggaggatcacttgaggccactagtttgagaccagcctggccaaaaaagtgagattctgtctctacaaaaaaaaaaaaaaagataaaaaagaaaagaaattagccaggcatggtggcctgtgcttgtagtcctagctactaggaaggctgaggaaggaagatcatgtgagcccaggagtctgaggttacagtgagctagggtcatgctactgcactccagcctgggtgatagagtaagaccctgtctcttaaaacaaaacaaaaaacaaaacaaacaaaaaaaagcttactacagattgtgacacgtccaaggaagtaaacagaataatgagaagggccatcattttttaaatcatttttcaagagagtggtcagtgaagggcccttaggaggcaatattaagagctgagaactaaaagggaatgagggtgaagtggtggagggaattccaaagggctcacacgtacaaagcttagatatagaaaagggtttgatgtgttcaacaaacagaaaggccagtgtgcctgaagcattggtaattaagtatgggggtaaatggcctcccaaagtactgggattacaggcgtgagccactacgcctggccgattctttcaatttaatgtcctcctgtctatagagttcctagaacatcttgagctggatgaaactccttttcatccagagggcagcagagtgtacctggagcctacatgggatttgtagtctaacctgggtttgaatcctcatttgaaaccttttgagctcaggtgtttacttttggagcctgttttctcatctgtctaagaagggataatgacacctagcacatagggatgttctaaagattaaataaaataacatgtaaactatgcagaaccaaataaagcttagttccttgtctctttccttctcttctaagttgagattaggatgttttgtttgtttcttgaataagatctgagtcccttgtcttctccagatgactatgctggacctagtcaagagactaagatgttaatatgtatttatgattatgtacatataatcagttaattacttacattcttgagacatccatctgaagttattgacaaataccgatttctctcaagtctatgaggttctaagatgttgtatagtcacagtctaaggctgggagacccgagagaccatggaagatgtttgcagagttttcttctgaaacttcattcgctcagtctggacgtgtaaaagaataacggtccagccataggctctgaaatcccaagacacagacttgaaaaaatacatattttttttttgtgcgtaactttcttttttaaaatcaccacctccctgttctgtgcagatttctcttacttagtactgtggaaatttctgaaagcatcttccactgaaaccattgctatggccagcgttgggtttctagaactggaagaaacacacattttgaaaatattagtcagtactatttcagtcttcagtgacaggaattttggttaaacatgcgtaggcttagaatgtactggctctagccatgagtggatcaggagcttaactgctgtcaccagggatcatgcacctttcatctcttagttttggtttctgttgtgctagcttcattctcaaacaggctttgccatgtggagcatccccagattaaaatcctacccattcagcagagaaaaggtactgtttctccaatttctaggttaagtctaggaattattgtcctccctaataccccaagaaaacccatgtactagaaggaggcagtgttctcattggccagatctggttcacatgctcacctctggaactgttcagttgagtcagccccatttgaatgacctgtgtaaattgagggtgagggaggtgtgtatgttcaagaaaaattagcatgcagttaccagaaggggggaaggaaagctaggcacattaaaaccaagaactgtttatgtatagcatataagggattggaaaacctggaagcctaggggtgactcagggaggctgggagacagagatggcaagagattctgtgcctccaagtcaacactgctgtatttggtagctttctagaacattccagtgcagctgtcatactatctgcaaaaataccttaagtgaaatgacaaaaaataaccaaaattaggacccctgaagaagaaatgtatcctcacctcattttttcttcagaaaaattttttctctcagtcttctttctagtctttttcttatggtggtcttcctctccccatcttcttttctgtccttaccctacccctcccatcccatggctcattattttcagcagatctgttcaacacagattgctattgattgtcctacaaagagccaggtactgtgcaaggtgctagaggtatgaggatgaataaggtatccctgtttttaaaggactcatagcctagagctgcttaaattacacatccctacattaatacttttttaaaaaaatagaacattctgtataaagctgaaggcttgaagtccttcctgagctctaccccaaaagccaatacttctgaaggcttgaagtccttcctgagctctaccccaaaagccaataattccctgccacctaagaggtaaccactgttcttggtcgtgtttctttctgatctttccccatacatttacacagaaaatatggggttttggccgggcgcgatggcctgtaatcctagcactttgggaggccgaggcggctggatcacctgaggttaggagttcaagaccagcctggcccacatggtgaaaccccatctctactaaaatacaaaaattagccaggcatgatggcggatgcctgtaatctcaactgctcgggaggctgagatgggagaatcgcttgaacctgggagatggtggttgcagtgagctgagatcacaccactccactccagcctgggtggctgagtgagactccgtctcaacaacaacaacaacaacaacaaaaaaagaaaatatggggttttgtggttttaaaaaacataaataataatagctaatgcttactgtgtcactgttatgtatcaggcactattttaagtattttatataaatcatcatatttaatcctcagaacaactctataaggtaggaacgattagtattcccattttacagatgaggaaactaagccccagaaaggttaagtagcttgttcaaggatatacagtaaacggaggagctttgctttatatattttaatacaattcgccttttttacttaatattatttggagatacaggtatgttagtgtgtaaagaattgtttcattatttttctgtagccctttaaataactttgttatgaaaaatttcaaacatatacaaatctagagaaaatagaataatgatggataccatggatgactagagggagaaaggaaggaggggaacagggtggaaaaactattgggaactatgcaaactctctggctgatgggatcatttgtaccccaaacctcagcatcacacagtattcccttgtaacaaacccacacatgtaccctcttaatctaaaatatgaattgaggctcatgcctgtaatcccagcactttcgaaggctgaggtgggtggctcacttgaggtcaggagttcgaggccagcctggccaacatggtaaaaccccgcctctactaaaaatacaaaaattagcgtggtggtgcatgcctgtaatcccagctactagggagactgaggcaggagaatcacttgaacctgggaggtggaggttgcagtgagccaaggtcacgccactgcactccagcctgggtgacagagggagactccatctcaaaaaaataaaatatgatttgaaattattttttaaaaagtttgttgtaattctaactgaattaataaactttaaaattcatacaaaaaaagagaaaatggtataatgaatcaccatatatctgtcattccagtgtcaccaattatcatggctaaccttgcttcatctgtattacagccacagtggcttattttgaagcagttctcagacatcatcttgcagtatccataaatagttcagtatgtagctcctaaagataaacactctgaaaaactaaccaaatcataacaccattatcacacctaaaaaaagtcttatcatcaatttcttttgagtgtcgaagttctctgattgtttcatatatttttaagtagctttgttaaaaagcaggatccaagctagattcatacattgcatttggttgatctgtttcttagatcttttaatactttctgcaccctgctatgttaaaggtccttatttctctttggtaaaaatcttggtatttaatcaaggcttatcaacattaaggcattccatccccctaggagcagcaccttgattgtcaaagcgacatgatttgcccaagcttatacatatatatgcttcttgtatgttcccatggttacttagactaagagactaaagtatttatttaaggaatgatgcaaattaattattcaacttaatctgccttgggaagcattctagttccagttattgggttctttgggtcattattttatttccaaggtttttggttattttgagtggaaaattgttttggtagatcttctttattatggtagcttcaattgatttcattgattaataagggtctttacctccctgctgtgttagaaattgcatcattcagtagctgacagtagggcttactatagtggacagtgaaaatatattaaaacaacaacaaaaataagcacatagtattcatggaagcaatctgagttaggaagacagagcactgaataatatttttttagcaaaatcagtaaaaggttttgtttctagtatatccaaaatatgcaactgaaagtgctaatcaaaattagatttatacaactgcttttccctaatgctcatgtagttgatttgagtaacattggaaaaattttacattactaattaaaatccttgtttttaaaaattaatatggcttaataaagttgttaaaaaatcaaactggccatatgtatttaaaataatttttttcttataaagtattatttatgatagaatgctcttttattctaattgaactaacataataaggcaaattacacattgtactgtttaacagggtttgtgtgtcagatctgctgtggtctttgctccttatgtagagtgcttgtgtagtgaaagggcatgcattcctgactaaatttggcttctgttggaagtaagagccataatagtgaaggacagtaagagaactagcttcatatactcagtacttgccttagtacatattgtcctcttttattgttcaaataattcatttttctatgtgggaaatgctctatgagatatctgtagttactaaacttcatgatattgtcatttgaattactgaaattgaaaggatgttaagatctgaaaatgtcagttcatctcagttggaacaaagtaatggaggaacagtttgttttgactcatattacagccacatgttggttagacagagataaagctgcctagaccagtcaggaccgatctcgtggtaagcccaggaatactggaagccaacccagggaaactctggcttggagagagatgaaaggttagaacaataatttcttcatgtttgggcaaaagcagaagaattcactaagcaaggagggaaatagagatcctatgcttttctgtttctaagcattttacagtaactatttcaagttatattttacaattttgaagtactttggtgttcaaggtgtcatttttgcctcacaataggacagcaatttttctgcaaacccttgttaaagaagagactccaagaatctgcatgttttgcccaaaaattcttgagttaatggcacaggagtttagaacccaagttttctgacccagttttagtgtccgtcgtgccatcatctctgagctacttgacagcaggcactatgtcttgttgatctctgcatccccagtaccaggcaccaggcatagtgcctggtacacagtttcaaaatgaatgcaaaataacctgaaagatttgatctcagcagatttttggcttaaaaagcagtgtttctagatatattgccttagttttgatgtgcatacttcaaaaatccttaatcttgatacaccatataattttttaaaagtaaccagttttctagtcacaacacatcagaatttttctttatagtctctggaatatcttttagagatataaaacatcaaaggatctgtttatgaacttaaactatttaaacaagtaatttgtatcatttagagtgtttgggctttatgctcattcaaatcattgaattttaagttaacctttttttcttagtggaaatttagggttgtgtgtcagtctttgtaatgtgtagttaatataataatataggttgcatacatcctttttttttttttttttcctgggatggagtcttcttctggtcgcccaggctggagtgcagtgagtggcacgatctcggcttactgcaacctccgcctcctgggttcaagtgattctcctgcctccgcctctcgagtagctgggattgaaggcacccaccatcaggcctggctaatttttgtatttttagtagagatggggtttcgctatgttggccaggctggtctcaaactcctgagctcgtgatccacccgcctcggcctcccaaagtgctgggattacaggtgtgagccaccgtgcccagccggttgcatacatcctaaaggtcacttaaggttaaatttggtaaattgcaaaggagttattgctatccagtttattccagtcagttgaagccttggtatgttgatctgttggcttggtaggcaaaacatttttaaatggcatgatcttctcatttggagctagagatagttcagtgtaattatgatacacatctgtatgtgaaaccctgccatcttttatagacaataattttgattaaatgtatgaggattctaatctcatgagatctattttatttcttaagctttagaatgttaaggctttcctgagcacatgctaactatactcaatgtaaatttaaatatttctggaaatgtcaaagctgtatgttcttttacatttcaaatacttgagttgggcttggaaaaagtttaatcaagaaaatggaccagctatttcagatacatttcagatactgtcagctactttatgtcaatgtcttccatgtgtccttgacttcttgccccagagggatatacaactgcttaagagatatctttgaaatggcaaatgataaactctaaagttacttggagtatagacatacttgggtaatttcatctaaagtcattttagttcatcctttgaaaacacaggaacaaaatgaaaattatattatgaaactattaaattgcttgctatactaagtgtgtatgtgtgtgtgggggggcaacctagtgggacccccatctttacaaaaaaataaaaactgaaaaacttagctgagcatggtggcacgtacctgtggtcccagctactcaggaggctgaggtgggaggatcacttgagtccccccccccccaaaaaaaaaaaacccaaacccctgatttaaatatatcaccaatttttgaggtaccagcttttctttgttagcataatacctaaaatattttagcatttttgactgactgtgggtagatagattctagtttcagatctaaactccctctttggttgtgttgttcaggcaacaggcttacagacattgccaagtaattgtctctaatttaatgagttaattagttaactgtctcctgtagaagtcaagtactgacttcttatggatgggagaaaacttatgcttttttcctctaagctatacactctatctttcagttaaaattaagttaaaatagagtaggagagctggagaaaacactggcaaaatacctcagggtaagtggttctttggcatcatttataaccccagatactggcaaagcctgtttcagtacatgtcaactaaagcatttgttttctttgttagccgctgtgtcctttgtggtttgtgctaaggctgctctatttcctgatagttttaaagtcaagaatgttgacatcttggcgattccatatatacagtatactttaaaaatttttaaatgttagattcaaaaggcccatgtgcaggtttcttttttttttttttttttttttgagacagagtcttgcgctcgcccaggctgtggtgcagtggcgcaatcttggctcactgcaagctccgccgcccgggttaacaccattctcttgcctcagcctcccgagtagcggggactacaggcgcccgccaccacacccagctaattttttgtatttttagtagagacggggtttcaccatgttagccaggatggtctcgatctcctgacctcgtgatccacccgtctccgcctcccaaagtgctgagattacaggtgtgagccaccgcgcccggcccccatgtgcaggtttcttacaaaggtatgttgtgtgatgctgaggtttggacttctgttgatcctgtcatccagatagtgaacatggtaccaaacaggaattttttcaccccttgccctttctctctctccccgctctaatagtccccagtatctattgttcctgtctttatgtccatgtgtacctgtaacaggtagagggtcttgactgcaagttgtccaggttcttggcattttgaacagagttggacaaaacgcccagcaaagcaaggaaagaatgaagcaatgaaagaacgaaagcaggaatttattgaaaatgaaagtacactccatagtgtgggagccaatgagcagcggattaagggcctggatacagaaacttctcgcgtccaaatacttcctagaggttccccattggccacttggtgcttacctcatgtaaatgaagtggtggcccgcaattggtctgattggttgcggaaagcaacctatcagaggctgaagtgaagttataaaggtcacactcccgtacaaacatctgattggttgcagaaagcaaccaatcagaggctaagggaaagttacaacgttgtatttctatgcaaaggaagagtctgcctgcagtcggtctgattgcgaacagccaatttcccatctgccgtggagaaaagggggtttgcgaagggagtagcctcaggtccttttgttacttaggtgtggaaagttagggttttcctttcaatttagttctaggaagttggtgtgaaatggcctccagaccctgttctcctgcctcatacccaatatttaattcccacttttaaaagagaacatgtgatatttgattttctgtttctgcattaattctgcttaggataatggcctccagctgcatccacattgttgcaaaggacatgattccagtcttttttatggctgcatagtattctatgaagtagatgccatacagaacgcttgtattgtgtgtttgtgttttttatttagtggttgtagtcctggaggtcaaattcagatattagagaatagacacctctgtggcaaaaagaacaattgttgccaaattttcttaatacaaaatctctgaaatgttttcatgtgctcccccctcttttatcatctgttaatgaaacaaagaagcaacacaagcagttgtgaagagcgagaacaaagatcaccataatcccatttctagtattttcttttttctttttttaaatttgagatggagttctgctcttgtcacccaggctggagtgcattggtgcaatctcggctcactgcaacctctgcctcccgggttcaagaggttctcttgtctcagcatcccgagtagctgggattacaggcacctgccaccacgcccaactaattattattatttttttgagacagaattttactcttgtttcccaggctggagtgtaatggtgcgatctcggctcaccgcaacctccgcctcccgggttcaagcgactctcctgcctcagccttccgagtagctgggattataggcatgcgccaccacacccgtctaattttgtatttttagtagagatggggtttctccatgttggtcaggctggtctcgaactcccggacctcaggtgatccccctacctcagcctcccaaagtgctgggattacaggcttgagccaccgcgcctggccaggattcgagcatttttatgattatatataatgtatacttgtgtgtatgtacctatatattgctaaatttcttttcaaaaggactgaattcgacaaaagcaagatgtataggacggtataaatagtatgctatcatttatataaaaagaaatggtaagaatttcatatatacacacatatatttggatgtatatatattaacattatatatataatttacttgtttatggataaaacatctctagaaggatacataagaaatcgattgcctctggggtgggtaattgagtgattgggaacagaagtaggaggaagactttccactgtatattctttggtaccttctgaattttgaatggtatgaatgtaatactattaaaataataaaaaaccattagcaataggtaaaagtacccactgtcttctttttcatgcccactgtgttggttcaggcctcaagctgtttcacctgtatcttttatttatttatttttttgagatggagtcttgctctgtcgcacaggctggagtgcagtggtgctatcttgggtcactgcaacctccgcctcccaggttcaagcaattctcttgcctcagcctcaccagtagttgggtctacaggtgcgtgccaccacacctagctaattttttgtatttttagtagagatggggtttcaccgtgttagccaggatggcctcgatctcctgacctcgtgatctgcctgcctcagcctcccaaagtgctgggattacaggtgtgagccactgcatccggccctcccctgtatctttgtaatagccacttaccagtctccctgttcgaagttagttcttctctccttcactcaccttttatgttgccatcaaggatagcacagatcaggtatgtctctcctttcttcttaaacttttagtagtatcccacagctcgcagaataaagttcagactcttctgtttagcattcaaagtcttctaccatttggtttcaaactgccttttctactacatgtattagtatacgctctctttattaccatttctctctccaactaagccttctcccagaaaagaaaaaaaaagggggggtattttttgtttcaactttgttcacattagatttttgtgtttttgttttgttttgtttttgtttttagcttgaaatacccattctctccacttgcaattgaaattggatttaacttttaaggtccattccaagtgttgcctttctccctccattccctggccccatcccaccagtcctaagaatgaatcactcctttttggttcccatagtatatttctcataccattgtttgcaacccatattctagttactggtggatggaactggtaacaggaactagtaattgactagtaactaacttgtcagtctccttacattctgtttttagacttccttgtatccatccttctttccagttgcagcggtcttcctcatattgtgcctttcctcactcctgcctattcttaactctagtggttttgtgatcttggtggaacatgtccaattatctcgtacatattaagaatgaggaagaaaagcaattgacaggaattgatggaatctacttactattagtgtaaataccttacagtttgctttttctttatcctatgtttatatacttattgttttgaaacttattgttttctttatcctgtgtttatatatttattgttttgaaatttcaaagattattttgtcttcattgtgtaagtgtgtgaaatatctagaggcctgggaggacaataaacttgtctagggactcacaaagggttagtggtagagccaaggtttaaacccaaaaccccttcaagaatggcttttatagtcatgtatagagaacatgactttattttggggtgatatttcttgaatgcttttggtagcaccaattagttaaaaaaaaagtccatattgggctacgtcttttacttttgttctatagcacaagtcatcaagcaacccctgggctactttttttttttttttttttttttgagacagggtcttgctctgtctcccaagctggagtgcagtggtgcaatcttggctcattgcaacctccgcctcccaggttcaagtgattctcccacctctcaaatgctttgaatgctaaacagaagagtctgaactttattctgcaagccatggaacaatactaaaagttttagaagaaaggagagacataatctgatctgtgctattcctgatggcaacatggaaggtgagtggaggagagaggaactaacttgggacagggaaactaggaagtcgctattacaaagatacaggtgagggcccggcacggtggctcacacctgtaatcccggcactttgggaggccgaggcaggtggatcacgaggtcaggagatcaagaccatcctggcctaacacggtgaaacccgtctctactaaaaatacaaattcaagtgattctcccattcctctcagtctcccaggtagatgtgactaaaggcgcatgccaccatgcttggataatttttgtatttttagtagagatggcatttcaccatgttgttcaggctggcctcgaactcttgacttcaagtgatctggccgccttggcatcccaaagtgttgggattacaggcgtgagccactgcgcccggccactgggttacttcttatgcaggctgatatagcacttgtggtggtagtctctgtggctttttttgtttgttttttgttcttttggacagggtcttgctctgtcactcagactggagtgtggtggcacaatcatggctcactgtagtctcgacctcccaagttccagtgatcctccctcctcagcatcctgcatagctgggagtacaggtgtgcaccaccatgcccagctacttttctaattttttgtagagacctggtctctccatgttgcccaggctggaactcctgagctcaagggatcctcctgccttggcctcccaaagtactgggattacaggtgtgagccactgtgcctggcctaactcttttcttattgaaagaacaggtggctttgtttagtcagatccacaaatggagatgtttgcaacacttgactagaaagcaaaccaacaatcatttgccctgattcttcttccctgtcttgtttcctagaagcaaccacttgtaactcttttagctatttcatttggtatttcccttcacatttctatattgatatttctagacatttttgactttctgtaatagtagctgaggtcttagcttccttgtactacttcctctcacattcctgtcagtatatttataattttatttttttttgaaacagggtcttgctctgttgcccaggctggagtacagtggcatgatcactgctcactgcaacctccacctcctaggctcaagcaatcctcccagctcagcctcctgagtagttaggactataggcacgtgacatcatgcccagctaatttgtgtatttttgtagagatggggttttgccatgttgcccaggctggtcttgaactcctgggctcaagcagttgcccgccttggcctccccaagtgctggaattacaggtgtgagccactgcacctgtcctatttataatttttattaaattaatatttgatgtctatattattatgactataaatactgtttattttgagccaagtcatggattatgatattttctatttttgtacaattaaagtaatttctcatagttaaaaattaccaaacttttgatttgcctagttatttgtgtacctattaccaattcattcatttgccaaatatttactgagtgcctactataagccaggcatcattcttggtgtttgggatatattagtaaacaaattagacaaagattctttcccttgtgacacattctaattgggagatagacaataaacataagaagtagaatataaagtatgttagaaagaggtgctgagggaaaaaaaagcaggactgttgaggagcatgatgcccttaattcatgattctttatatgtgacctggtttttctctctgaaaacttgtagaattttcacttcatttggatgttctgcaatttaacgatgatgggccaggccctagtgtagatgttcgctttaatttttcatgcttgacattttgtgagcccttgtattcttcagttctgatcttactgctttgttggttgactgaagtaacaatcaatctgatgcaactcaaggagaagggctttggttgttcatgtttggtcatcccatagtatataaagcccttaaattaatgagtttctttgatacaggtattattattattttatttaaaaaaattattgatgtaaaaaattactgatgtcaaagaatattttaatttatttcctatttctggctactggaacttggaatgatgagaggtcttgtttgttattcttttctcattcatttcacttctaaggtttggcagattacatgtctccctggtgctcttgtagacaggaagcctctgggagtcactttcaggtcctggctgccctttcacttttcttagtcttttcatatcttttatcttaccaatatatgtatttttaattgagataaaattcacataatgtaaaattcaccattttaacgtatacaattcagtgttttttaaaaaagtatatttaccatgttgtatgatgttaccactatctaattccagaacattttcatcatccccaaagagaaatctgataaccagtaagcagttaactcccattccccctctcctttcagctcctggcaaccaatattctgctttctgattctatggtcttgcctattgtggacatgccacttaatagtatcacataatatatggcctttagtgtctgtcttctttcacttatcataatgttttcaaggttcctacatgttgtgcatgtattagtactataaaatgtttttaaatcaggctctgaatatttgatttttcggtatccagagaaaaattctgcatttattatctttattttgattttaatactggcctttaatttaccttttcacaaaccatttattggatataaaatgatattggataatttttcagtatgcattatttatttatttttttagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggtaagtatcttcatgcattttctgaaaactaatgttctggaatatattgttaaaaatttaaaaaaccagctgggcacagtggctcatgcctgtaatcccagcgctttggaaggctgaggcgggcggatcacctgaggtcgggagtttgagaccagcctgaccaacatggagaaaccctgtctctactaaaaatacaaaattagctgggcatggtggcccatgcctgtaatccccagctactcgggaggctgagggaggagaatcgcttgaatccgggaggtggaggttgtggtgcgccgagatcgagctgctgcacttcagcctgggcaaccagagcgaaactctgtctcaaaaaaaaaaaaaaaaaaattaaaaaacccacaaacttacctacgggtatctagaattttaatattagtaaacatgtaattagtaattaccaagttgctcattagtaattagaaaatatgtttttaaaataaatatattattattatattttggggatacataaatcattatgaaaaatgtattcaggctgggcgcggtggctcacgcctgtgatcccagcactttgggaggccaagtgggtggatcacgaggtcaggagattgagaccatcccggctaacatggtgaaaccccatctctactaaaaaaaatacaaaaattagccagacacggtgacgggcgcctgtagtcccagctacttgggagcctgagataggagaatgtcatgaacccaggaggcagagcttgcagtgcgccgagattgcgccactgcactctagcctgggcaacagagcgaggctccatctcagaaaaatgtatttaaaaaaaattttgttgtttttaaatcaaggtgtagcactgctgcatcaatattaatccaatgttaaaaaacagaggagctgcaaagagctaaggcaataaatactggcatcctatatttaaagcatcttgtagggtagctctgtgacttacgggttagtgtaatggtcttaaaaaagagattaggcgctctccctctccctctccctctccccacggtctccctctccctctctttccatggtctccctctgatgccgagccaaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagcctcggcctcccgaggtgctgggattgcagaccgagtctggttcactcagtgctcaatggtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaatttttttttggaaaaataattgaagctttatgttgaaaaatatgaggatgccaggcaagtattccactttataggtcaaattctgagccaataatttttaaaccacactaactggagatccatgttttgttttgttttggtctacattaaaaaaatattttatatatatgtatataatatatatattttttgagatggagccttgctctgttggccaggctggagtacagtggcatgatctcagctcactgcaacctccacctcctgggttcaagtgattctcctgcctcagtctcccaagtagctgggattacagatatgtgccaccacacctggctgatttttgtatttttaggagagacagggtttcaccatgttggccaggctgatctcgaactcctgacctcaagtgatctgcctgcctcggcctcccaaactgctgggattagaggtgtgagctaccatgcccagcctttaaaaattggtatatactagttgtataattaaactatatattttattcaaagtttataaaaatggtgttatttactgctattatcaaggatacaggcatttctttttttcgaaaaaatatttcacgggaaaagcctcattttatgttgaataatctgagcagaacgagttccaaataaccaagtatatttcttccattcattcaataggtattgagtgcctgctatgcctcaggtactgttcttggtgctggaattattaatatatcagtgaaaaagccacaaaaagataataaaaaagtgaattatggtatgttagaaagctgtaagtactatgatgaaaaataaattaggggagagtttagggagtgatatttattaatttatttctctatttatttggcaaacattaattgaacagccattgtttgtcaggcactgttgggccttacaaatacaaacataaattaaatgaggcttttggccttcaaaagaaggtaatagcttagtgagaaagaaaatgactaaacaaaggaaaaaagtaacacttctgaaatgaggtgctgtcatagctatatgagaggaatagagggaacccaagaaagcatggttaactgttttgggtggtcaggacagcatcacagaagaggtaatgcttgagtgaaatctggcaggatgagtacaagcttgttagtagttggataagtagggacgagaattccaggaaagggaacaggaacggcatgaaacattaaggggcgtgtgtgtgcgtgcgcatgtgctcacattagtgaatggcaatggaggagggttgtgttgcaagtactttgatgtggctgtggcattgctttgttgctgggggagatgtagttggagtggctgaaggcttttgactctgtcttgcaggtatttttagcctggtagtgtatgggtgtgtgaaaagacagaaataacaaggggcatcttgctagagtgtcagtttactcaactcaggggagaaaagcaatcattatttgtattaaaatcatatatggctgtattatggagtgaatgtaatagttgcatgaattagataaagacaattttggcttgttatggcagtttcagtctacatctccaagcctccagggcctaggctctttctcctacctgttgaggtgcttgtgtgacaaactttgagaaactaggcagtaagtagtctaaaaattatttccattaccacagatgtaaacagattttagaaatggtgggttggaatgggacaagactcgcatgcaatagaatcaatttaggtagctattgtaataaagtagaaagattggtgtctaagttctttgagtccaggattagtactgtattcagttttattgtcccatagaaccttgcacagtgtgtgaaatttactatgtgttcaacaaatatttgttttggaaagattttatatcatttataaatggcaggtattgggaaacttgtataccttttaggtctactctctcaaaatatatcaactgataaatcactgtggatcattcactcataggatctttcaataatgattagacaataaagcaaatgaaaattaattatacctatcataagtccttcatcagaattattaaaggtaacatatatatttagctcttttagaaattatcagagtatttattgttagtaatttggtctaagacctgatttcagaatatccatatattttcaaatgtttccttttatgaccatctgctctattctatctcagtagtgtatcttctttgaagcttcatgtggttctcctaggctgagttgcattgttaaagtaggacattttcttttcttttttttttttttgtcggagacggagtctcactctgacacccaggctggagtgcagtggtgtgatctcagctcactgcaaccactgccttccgggttcaagtgattctcctgcctcagcctcccaagtagctaggattataggtgcatgccaccatgcttggctaatttttgtgtttttagtagagatgaggtttcaccatttggccaggcttgttgtctcgaactcctgaccttgtgatctgcccgcctcggtctcccaaagagctgggattgcaggcataagccaccgcacctggcccatttttcttcttataatcatctttttaaaaagatattctctactgggcacagtggctcacacctgtaatctcagcactttgggaggctgaggcgggaggatcgcttgaggccaggagtttgagaccagcttggacaacatggtgaaaccccatctctacacaattaaagaaaaaaattagccagttgtgatggtgtgtgcctatagccttagctacttgggagagtgaggcaggaggattgtttgagcccaagtgtttgtggctgcagtgagctataactgagccactgcactccagcctgaggggcaaaatgtgagattctgtcttaacgaaaaagaaaaaagatattctcttttctcccctctattttctaccccttaacccagggcagtgatgaaatattagaatagcttacttggtacgttgtttcctgccccaaaatgtgttccttggttctatcatagttttctgatgatgagtcctatagatatgttatgtgaaatagcaacatataatattgcttataaccactcaagaccaagtctgaatgagtggagctagtatagacaagttcaagtgatttggttaagtgtgtgagaaaaattggtctaggagtggttgaaacacgctcttttgtgctctgcaatccttcccccatgttttccgggatgttaactgttcctctctcttgttccccatctcctttcccccagtagatagtaaaataagtaggagtgtttggatatgggtgcttgctgtagaaagccatgtaacatacaaaacagcattatatattataaatagcacaatcagttgtctaaaagtaaaagccattagccaagtattatttgtgggattgtggcttaaactttgaagttctggtgtataatgaaaagcaaaatgattttatgcatttaatgcagatctcagagactataattgtgtgatctaatctaaaatatttagactgttgcttacttgaaattgtaacttctagaaccatagtttctatattcagtcctagtcagaattttatctggaggttctgttctcctgtgatgtagaaaactggtgttcttttcttctactttttccccaagtgttttcctttatgttacacaggcatatagaggaaccttttatgcagaaatcttgattgttttacaaattataaaattaacattaatattttgtcattttattagttcctatttactaaattaaaaaggggcttcgtagaaaatttttaaaaaacacaccaaattcagaaaatatatttttcaaagttataaaatgaatacatgttctttctaaaaagtcagacaatggggtaatacggtaaagagtgaaagtacctccttatccccattacaaggaaaactaatagagtgtgaactaatcagtagtttcttcactcaacagttagtagcttgtggtttgcatatattctattaaagtcttgattgggcccttctagcaataaaggaatccatggcaggataaagggaaaaggagccttaaaaatattctggagccaggcatggtggttcacacctatgatcccagcactttgggaggccaaggcaggaggatctcctgaggctaggagttcaaaaccaaccggggtaacatagcaaaaccccgtctatacaaaaacatttaaaaattaaccgagcatcctggtgcttgtctgtagtcccagctactcaggaggctgagacaggaggatcacttgaacccaggagttctaggttacagtgagctctgattgcaccattgctctccagctgggagacagattgagaccttgtttcttaaaataaataaataaataaaattctggaacatgcttgctttatgttagcattgcagactatttcttgctttcagaaaaatattgttgcattataatgcagtaagtatataatgactgtgggcttaaaatagaggagagtatcagagagactgtcaagtggcctatttttctctcattcctcccaacattttattatgaaaattttcaaacattcaagaaagttgaaagaattttatagtgaacacccatatatctaccacctagactaccacagagattatattattattattattttattatttatttttatttttattattattatttttgagacagggtcccactctgttgcccaggctggaatgcagtggtgtgatcatggcttactgcagcctcgacttcctgagctcaaatgatcctccctacgtcagcctcccaaatagttgggaccacaggcgcctgcctcatgcacagctaatttttatttattttggtattttttgtagagatagggtctttctatgttgcttaggctggtcttgaacttttgggcttaagcaatcctccccctttggccttcccaagtgctgggattacaggtgtgagccactgtacctggccagattctactattaacatctgactattcttgctttttcatatatccatccatccctctatccttccatcaatccatcttttttttaatacatttcagagtaaagtgcagccattgatatagttcttaaatattttagcatgcccattatttactagtgttttttgttttgagggttttttgttgttgttgtttgttgtgagacagagtgtgtctctgttactcaggctggagtgcagtggcccgatctcggctcactgcaacctctacctcgcgggttcaagcaattctcatacttcagccacccaaatagctgggattacaggcatgtgccactatgccaggctaattttttttgtatttttagtagagatggggtttcaccatgttggccaggctggtctcaaactcctgacctcaagtgatccactgacctcaagtgatccacccgcctcagcctcccgaagtgctgggattacaggtgtgagtgaccatgcccagcctttgagtgtttttctttaaatgtaggactcgcacatagtaagaaaatgtaaatctcaaaagtgtatttgctgagctttgacaaatgtatgcacctaggtaacctcaagtgactttttttattgtgttaaaatatacataatataacatttaccattttaatcatttttaagtggacagttcagtggctttaagtgcattcacattgttaggcaaccattatcatatccaaggccaggcgcagtggctcatggctgtaatccgagcactttgggaggcctaggtgggcggatcacctgaggttaggagttcaaaatcagccatggctaacatggtggaaccccgtttttactaaaaatacaaaaattagcctggtgtggtggcacgcacctgtaatcccagctactcaggaggctgaagcaggagaattgcttgaatccaggaggtggaggcggaggttgcagtgggccgagatcatgccattgcactccagctggggcaacaagagcaaaactccgtctcaaaaaaaaaaaattgttgtatccatttgcagaacgtttttatcattccatactgaaaccccataccaattacataatgactccccattctctttccttccactccaaccagcccctgataaccagtactccacttattgctactattttagctatctcacataggtggaacaatataatatttgtccttttgtgtctgccttatttcatttagcataatgttttcaaggcacatctatattacagcatatgtcagaatttcattcctttttaaggctgaataatgtactcagttgatttattttttagagatagagtctcactctgtcacccaggctgaaatgcagtggcacaatcacagctcattgcagcctcgaacttgtgggctcaagcgatcctcttgccctggcctcctgagtagctaggactacaggcatgtgtcaccataacaggctgatttttgactaatttttaagttgttggtgcttttgtgtattttcatgatacatctgaatatatatctcgtgatatatctgaatatatctgaaggtaactgagtattgagggatggctgagtattaccccaatagcttcttataatagtggtctacttactaatgccagatactctttctggttttcaactatagctttaaaattgggaaagggttaggagatatacagtaatggaagaacaccaaattgaaggcaggagttaggagtctttaagtagactcactgatttgctgaatgtctttgaggaagatcacttaacgtttgcctttctaagggtccttctggctccaaagttgcatgaatatatgatttgtctttttgaatatgctgacagacaaaatgtagatatttagtaaattccatagactttctattttaaacaaagggctacttaattggaaacctatgtgacaagagtctcaaatccacaaggacagtgtggtctgtagatagataactgatgagccctgtttggttgcttttctgaaggagaaagactgcttgtcttcaaggggctggtgctacttgggaccggaaacctagtgttgttcacacttgcagtttatcaaaataaaccagaaaaactgagtatttatgggaaatcttgtgatttcttaatgtcaactaatgcaactaaaaaacagtactttgcatgccaaagaaaacacatctttggaccaaattcagtctgccagctgatagtttgtgacctttgctagttaaggaagaagtttttggcctcttctcataaatatagaaggttttactactgagcatgaaatttgttttaaagctacgtattctgtatttcagggtaggtgtattttttatgtcttgatgctattttgtagaaaccaatatgttatgcctttttaaagaaaacccataatcagcctatttttatttttaaaattattggtcagtctgtttttttcttcctcaaacagaaattgcatgaaaaatacactatagaaaatccttgtatcaattaacacattttgaaatatatagagtaattaacattggacaatcaaggaaagattagtttcctaggaaaatacttcattgaagaccagtctgcagatctgtatgcatatgagacacatttttataatgctgttacttggacactcattactaatgagcagcaagatggtatggaatctttgtagcaagcttgctatgaaagatctagtatatgctggctttgtaaggtcactgaaggcaatttctgtgtagttttgaccactggttaattttataaccttgagtataataggactcattaagttctagaaacccaacatatgagtttcccccactttttgttaagttttgttttgttttgttttgaaatgggtctcacttgggtctcactctgttacccaggctggagtgcagtggctattcacaggcaccagcattgcatactacagccttgaactcctgggctcaagtgatcctcatgcctcatccttttgagtagctgggactacaggttcatgacattgcacctggctcccaccttttttgttttgatttttccttttaacatttttatttaaaaaaaatttttttttaaacagggtctggctctgttacccaggctggagtacagtggcacaatcttggctcactgcaacctctgcctcctgggcttaaactgtcctcccacttcagcctcccaagtagttggtactacaggtgcacaccaccacacctggctaatttttgtattttttgtagagatggggtttcaccatattgcctaagctgctcttgaactcctgagctcaagtgatctgcctgcctcagcctcccaaagtgctggcattacaggcgtgagctactgtgccctgcctctaaaagttttattttaatttaattatttattgagacagagtctggtctgtcgcccaggctggagtgcggtagcatgatcatggcttattacagcctctacttcctgggctcaagcaatcctcccacctcagcctcctgagttgttgggattacaggtgtgtgccaccatgcccagctaattttttatttttactttttgtagaggtggagtctccctatgttgcccaggttggtcttaaactcctggactcaagcaatcctcctgcctcagcctcccaaagtgctgggattacagatgtgagccactgtgcctggccaaaatttttattagtgatgtttcaaacatgtataacacagagaataatgtaaattctatgaattcatcacctacttttaatcattaccaaaataattatttcgtttatacctccatctcttctccatcctctggattattttgaagcaaactctagatgatgtatttcatttgtaagtgtctcactgtgtatctctaaaagataatgcttaacaacaaccaaaaaaacctcctagaaacattgatttcttaatatcatcaagcatttgtattatattggtatttccatttcccggattatcttgtaaattaaaaaacttttttttttactttgtttaaattggaatccaaataaggatgtatattgtgattcattgttatatctcttaggtcttttaagattgagattccctgtgcttgcctcagcagcacatataataaaattggaatgatacagagattagcatggccccttaaaaaaaagaagaatcctcttcatagcttcattaaaaattatttttctgcagctatggaatgtttcttctgtcatttcctacagtctgcatttatgtggtggtagtgaacatgttcctttgtttgttgtgttttctgtaaattagtgaatagttctagagcagtggttctcaataggggtgattttgctcaccagggtatatttggcaatgtctggagacatttttgctggtcacaacttggggatgctattggcatctagtgggtagaggccagggatgctgctaaacatgctacaaagcacaggaaacccccacaacaaagaattatccaacttaaaatgtcaccagtactgaggttgagaaactgatccagagacttgatcagattcaggtttaattatattttgcctggttctctctcttcatgatgttaggagctattgattattgcccagtttcattgattttctaggggcttacaaaagggtgatattctaattctcctttccttccttatctgaagtacctctataaaaacaaactaccctttatcaattatttggttaccctgagctacagtttatatagtaaaggcagattaaatgcctgatgctttccctttcttcaccagccaatggcgttttatattttattccaggttgatctcctatcaagagtttttggcatttgaatctgttttatgtgctccagattccatgttcatagtggctttccagttgtttgacaagagtggaaatggagaggtgacatttggtaagggaaaaagaagattataagtgataagttaatgatgctggtccagtcttcaattgctgaatctagtaactaatatagattactgcttatttgggatctgacccataattgaatttcctaaaaggatttatgcagataatgatggctttattttttcaaagcattaaactgttgccaaagatgaagaagtgtagtaatgctgttgctttagctcattgagtcactgacactttcacattcctaaaataaatggtgtaagattttcttgttctgggccagcctgggcaaaattccttacaaggtcgattttgaacaacatgaaacaattttctcattctttaagtgatttttagatagggagttcagagcttctcttgtagcatccttggaaaattgctactatgtcattgtaacaccaagaatggaaccgaaggaggatatcaaggcaaaattagttagtgttctctgaacctgaattttagatttcagttttaggaaagaggctagaatattaaaattgccatctgacatgaatgtagaaatttatttaaatcctctagtagacacaaaatctaacacactgttgatgtttcacaggtgtatacactaggatttttatttgtaaccatatattaaagatacttttttacagaaattagtatatgtttagtaaaagtattggctaatttttcttgcaacaattttttcaataaaagccatgtagtagttcaaggaccttgagcactgcccccacctttttaaagattgccactgtttttgttgtggcaaaaaacacaagataaaattactactatcttaatgattttaaatgtacagtttagtagtattaagtatatccacaacgttgtgaaagacatctccagaaatttctcatcttgcaaaattaaacttaagcccccttttatagtgtgaattggcatggatatttgtagaaacacccttgaaaatcaggctttccctgagctatgacattaaacacttattcactattgtgtttgagttataaaatagatgtcctttagttaaacttgaaggaaaaattatcactgcaatggtcaaagtggtgagaaagtacaggtcagtcaatcagaaggatcagtagtgccttggctgtaattttggtggacacattttctagcgtgacattgattgttttcttcttccttctgcccattgactcaactatcttctgtatgagaagactttccaaaaaaatgctatgcagagttttttgttttgtttttttttgagacggagtcttgctctgtcgcccagactggattgtaatggcgtgatcttggctcacggcaacccctgcctcccgggttcaagtgattctcctgcctcagcctcccgaatagctgggattacaggcatgcgccaccatgcccagctaatttttgtattcttagtggagatggggttttaccatgttggccaggctggtctcgaacagttgacctcatgatccgtctgtctcggcctcccaaagtgctgggattacaggcctgagccaccgcgcctggcctgctatgcagagttatttagatttttgcatataaatcttggcatcctcctcctttggagcaagcttcgaccatcttgcctcctgaagaatgttgactttcctcagaaacacctagattctgtagtttaaggcacaaaccctccatcatctcattcagcattaaccatgcactactagcaatgctgcattttccattttcagtaggtatcacacatgctcacatatctcacaaatgtgatgcagaaatgcttggaaaataactggattcagatgtctgagttagtgacagtgccctgtgcttatatcctgtgtgcattaagaattagatctcacaatcaaattctaatttttgtccctctaccttgatatcatggttctttgtgtctcctccatttaattacttttcccagtttcgattattataaaattagtaactcaagccacttcatccaacagactgtcaagaccaacttaacaataagacacatgccattgttgataaatagattaaaatgagtgtaggaagtagctaagtttatatatgccttatttaatgtaaatgaaagcttgtagtcattagatctcaactttagttttttttttttggaggtggagcctcactctgtcacccaggctggagtgcagtggcgtgatcttggctcactgcaacctctgcctcctgggttcaagcgattcttctgcttcagcttcccgagtacctgggattacaggcacctgtcaccacgcctcgctaatttttgtatttttagtagagacggggcttcgcccatgttggtcaggctggccagtctcaaactcctgacctcaggtaatctgcccacctcggcctcccaaagtgctgagattacaggcgtgagccactgcacccagccaactttagctttttataggtcttctgtttttctttcaaactatgatttatgaattagaatttttagaaatatagttaggattaaacacaaaccagttttagtttttacggtaccaggtataaactgaagaacatatgagccctcaagaatcttgctttcattcttttcctccataatctagagacaggaatattattatggaataagaaaaagatgaagccaggtgcagtggcgcatacctgtagtctcaactcccaaaggagtgatttcagctcctcgggaggctgaaatgggaggatctcttgagcccagagtttgaggccagcttgcacaacatagtgatacccagtctctaaaaaatttaaaacattttttaaaagctgtaccctgtttctgttctggattccctggctagctggttggctcttttgatggtgctcacctatttcctaaggactttgaccatttcaccttctgtccctgccttcctagttttaaggatccactttgagacaaattttcttaagtagaatgagagaaatgataaaagaaagtttcctttcatatttttaagagggaaaatattgaaactgttgtagcaaatgccatttaacaagatttctaggcactgcttatttcaagccatattcaagactacagaatttatgcataaggaagtaattaacttggagtttatttttataggattttggatctggggtaaaggtcagttttcatgtttgtaaccacttaataaaatgaattgtgcttatgtatttataggcacatgtttaggtaaaaggaaattttagatccattctaaatagagttaaatccttttcaccaaatggccttctgttttctagtttggagctatttatagttttctcttgtgcacatgagagaaagttggaagacaatattagctgcaatgtgtaaggaagtggagaaaacctgttatgctatcagcatctcttgtagactatgatgataatgttatctgtgtacttgtatatattctcatttatgctttttttagatatgattttatacacatcaaattatatacttaaactgtgtgcatctttgcaagtatttatataagtagtaatattgaacatttacttgagtgtttatataaggttttttgttgttaaagatacctctgctctggggagaggacttagattgaggccttggaaatccatttcagaacgtgaaaactcaggaaagggttctggagtttttttaagagtgaataaaatattagttaattgtttcctctttgatgtttctttaataaaacttctaatgcatgccgtggataattacttaatggtttgtatatctgttactgtcaggtggcatgagccttgtagaggctattgcatgactggtgtgtgctagctacagtgtaagtttgccttggtctcaccattgtccacaagtgtactggagatcctgttcagtactattagattcaggtaacctagataagcagttatactacattgtgttgtcagtagctgccatgcatttaaaatccaaattgaaaaaaaggccgggagcagtgactcatgtctgtaatcccagcagtttgggaggctgaggtgggcagactgcttgagcccaggagttcaagaccagcacgggtgacatggtgaaaccccatctctactaaaaacacaaaaattagccgggtgtggtggcacatgcctgtagtcccagctactcgggaggctgaggtaggaggattacttgagcctgggaggtggaggttgcaatgagttgagattgtgccattacactctagcctgggtaaccggagtgaaaccctgtctcaaatgaaaaaaaggcctattgccttactaaagatttaatcctttttttttttttttttaaggggccaggcgcagtggctcacgcctgtaatcccagcactttgggaggccaaggcaggaggatcacaaggtcaggagtttgagaccagcctggccaacagggtgaaaccctgtctctactaaaaatacaaaaattagccgggcgtggtgggcacctgtaatcccagttacttgggaggctgaggcaggagaatagcttgaaaccagaaggtggaggttgcagtgagctgagattgcgccactgcactccagcctgggtgaaagagtgcaactccgtctccaaaaaaaaaaacaaacaagaaaaaaccacaacaaactgttgtctgttaactaacaaaatgagtatgaaacatgttatatgttctgagttctctattaacatcaacattgtgttccaaatttggtgtttgcctaggaatggacactcttcaaagtaaacttttccaaggacacatcctcaccctctgactgaagaaacctcaaaaagcagagattcctttaaatgtagtactatgtttgaccattaatacatatagcaaataaaaatgtgttccatttgtgcctctgaaataggctgtttttccctgaaggagagaataaattgggatgggttaggcacaaccactgttattattttaaagagccaggagatggaagtgtagttatgaaaaatgtaccctttctcactggaaacaaagctatagacatgcaataatatgaagttctatggtggccaggtgcagtggctcacgcctgtaatcccagcactttgggaggccgaggcgggaggatcacctgaggtcaggagttcaagaccagcctggctgggccgggtgcagtggctcatgcctgtaatcccagcactttgggaggccgaggcgggtggatcacaagatcaggagtttgagaccagcctggccaatatggaccagcctggccaatatggtgaaaccccatctctactaaaaatacaaacaaattagccgggcatggtggtgcatgcctgtaatcccagctacttgggaggctgaggcagaagaattgcttgaacccaggaggtggaggttgcagtgagccaagatcaggccactgcactgcagcctgggcgacagagcaagactccatctcaaaaaaaaaaaaaaaaaaaaaaaacaaagaccagcctggccaacatggtgaaaccctgtctctagcaaaaatacaaaaattagccgggcgtggtggcatgtgcctgtaatctcagctacttgggaggctgaggcaggagaattgcttgaatctgggaggcagaggctatagtgagccaagatcatgccactgcattccagcctgggtgacacagtaagactccatacccccacccccaaaaaaagggaattctatggcggccaggcatggtggctcttgcctataatcccagtactttgggaggccgaggcaggaggatcacttgaggccaagagttcaagaccagcctgggcaacatggtgaaaccctgtctttactaaaaatacaaaaaaattagccagttatggtggtatgcacctgtaatcccagctacttgggaggctgaggtgggataatctcttgaacctgggaggcagaggttgcagtgagccaagatcacgccactgggccgggcacggtggctcacgcctgtaatctcagcactttgggaggccgaggcgggcggatcacgaggtcaggagatcgagaccatcctggctaatacggtgaaaccctgtctctactaaaaatacaaaaaaattagctgggcatggtggcggatgcctgtagtcccagctacttgggaggctcacgaatggcgtgaacccgggaggctgaggtcagtgagctgagattgtgccactgcaccactccagcctgggcaacagagcaaaactccgtctcaaaaaaaaaaaaaaaaaaaagatcacaccactgacttcagcctgcgtgacaaagactttcataaaaagaaatgaaaattctatgataataaatatatagcttaatttggtaagaagtagagcttcacctgagtattcaaattaaatcaggaagattttttgatttttttttttcttggtgttgctttcggatattgcagagaagttttttgttttttgcttttttttttagtactcaaggctattagagtagcttaagagttcaaggtgaaagaaaaggtggagtgttattagtttttatgctgtttgatgatagactgttgaagtgtctagcttcaataataatagtatgtatgtatgtatgtatgtatttatttattaattttgagacacggtcttgctgtgtcgcccagggtggagtgcagtggtgtgatctcggctcactgcaacctccacctcctgggttctagtgatccttctgcctcagcttccctagtagctggactacaggcatgtgccaccacgcccaactaattttttctatttttagtagagacagggttttaccatgttggccaggctggtctcaaacttctaacctcaggtgatccacctgccttggcctcccaaagtgctgggattataggcgtgagccaccacgcccaaccgatagtctttaaatatgaactcatctttcctgagaaatggacctttacatatatttgacagcaggactactctattgactgtgcagtagtcccttctagaggtaggtaaagggctaatagaaatactttctctcagagaaacaggaggtcattcaggaaactaatgaccatctgagaggagaacccagaagtctgggactgagtctacatgccatgttggttgggacttcctctacaagttcctgttgttggtctttttgttgttgttgtttgttttcctttgttttcttttttggcttcccagttgttcctcctctttcctcccaatttttccttcactgaaaaactcttcacttctacaagtctcaccattgtttttgttcagctatgtacaaggatattcaccattcatggtgggagtcctaaaaacctctctgacttcactttaagaactgtgcaggtgaaattcagctactgaggaacttttccccctgacaataagaatgtttggtctcaagcctataagttggttgtagtggctcctgctgggctggaatccttggaataaggatgtcgttgggctgatggtaggtgggctgtgtcacagggctgatggcttgtatacctacaggaggagttctctggccacaccgttggtacagcagctccttccaggctcattcatggaacaggcatggtggcagtcttggagaagagtgccagccccggtcagaggtaattttgtactgcagaaaggtgaacaagaccagtaggaagtgcccataagaaccaggggagggatgagggtggatgagatggggagacacagtatgggtttctggggaaattaaaacctctgttaagacatatttacataatatatatgatttaatgtgtatttcatctagtccaatcatcataagtgactgatacagctaaactgactaatgttacacatctgtgaacatttttacttaatcacagttgtcaccgttaacctgctctcctgacaaatcattgtgctcctctcctttgagcaaagagaacataatgacaggctacttttgtatttagccccagttcccttttcaatggaagtataaaccatccctttcataagcccatgctctgcaggaagtgaaaaagttgtcttttgttttctatatgtcagaaaactaatggattcctggttctcttagctatgccaacctagtataaaatactatatcgtgattttgctgccaataagatgtgactgtcatttccctttcttccaggccagaactatgctacagaaatagcattcttaaacatggcaaaaaaaagatccttgtttgccactggaaagatgggattctctctgggggtgggtggaacttgctatacagtttcagttagatgtatttggtatatttgagactattggtgttccctttcatgtcacgcaggacctgataaagctgggtaacataaaaacaccagctgtttgagttattacctcatacaagcataagctctccagttctggagcttttatataattttatttatcacattctgataaaagtaaagtggcaatttatgaattggacttgaaaacaatagttctactaattatttctgtgtatctgaatcagtctcaggcacttggtagtagaaacaatgataacagaagagaagtagaatacatctccagaagtgccaaagtaggtttgtaatcttattagttctagtaattatagtagtccatgatgtgtcttaaaaaaaccctaaaagtatcagagtaaataaaccacagcatataataatgatcataacaaaaccatatataaagctgtcaagtgaccactttgggagaagtagaaaatgtccaaatactcatggaaaatgacacttctgtatttggggagatcactatgactaatttagaccatcattttaattgtttcagagacattctaagatcttatttagagatggctaagaagtttatgaaataggatatctaaagtttttattacagagatattttccagatgtaaattatacattataaatttagttcataaatatcctttttgtgataatagaaacttttttttcgagacagagccttgctctgtcacccaggctggagtgcagtggcgcaatcttggctcactgcaacctccgcctcccgagttcaagcaattctcctgcctcagcctcctgagtagatgggattacaggcatgtgccaccatgcctggcttatttttgtatttttagtagagacggagtttcactatggggaccaggttggtctctgactcctgacctcgtgatctgcctgccttggcctcccaaagtgctaggattacaggtgtgagccactgtgcccagccaaaaaaatttttatagataattgaattttcttagcttgaacgcttttgcattttggactttattttacatagtttcatatttgagattctgatattttcttattatataaaagggattcaatttcattctaccattatataagaattatctaggtagtaatatatacatttattatcaaataattatattttaactcttgaaataacctttaaaaggttaccatgaaataactattccctttaataattgtaatgttacttaattaaatatagtaatttgttctaatttgctttccatttttaattttttttaacttgaagatgaaacacttctttttgttagaccttaaaagtaagaaattaattaatttgggactagaaacagctaattaattaagttagatcctaaaaatctttaataatctgctacaatatttgtagccctaaatattttctgctatctttattattttaattgttttgtaaactttaacatattttacaacttcgaagtttcacatagatttaaggatcatcttttgtgttggttagaaaccaggatcccacaaattgctattgggttaattctttgctttttaaatttgtatttatgtaaggtgaaaacgcttgacctattgaaaactttgaagtatttgtccctacttagggaagaaatgaatcctgcattccatttcaaagaaaagatgagaatcccatctccccagtgacatccaatgccttcttccaactttgctgattgctgcaatctattcagagctattatattgactctagactggtagaacgtccagttcagaattcttacattcccctatcccagtagtaatgcttttattaagaaaaagtgtatgtatataaaactaaagggaatccattaaaccatttacaatatgagatcagtatcttatttaaagaatttgcagaaattagagaaaacagcatagttggagattataaaactttaaatgtgtatttactaattctctagtataactgatagctatcgatggcaaaactctttcactaataaaattggctgaaatttgaaaataattttgttcttaagacatcagttaaacaggcttcctgctttcttaactttgttcatgattttttttttttggcatgagcttctaaattagtttatccagtctatgcttgttaaagtaccagtcatttgtgaattgacttttatagtaagtatagaactctgtaagaatgtaaataacgttgttagtgcatgaagacaagctgccagagggttttggttgtatgttacacagtgtgactagttcctatctaaaaattagtgtactgtatttagctctttatttaaaagtgaaacactaatttaacttatcttaaaatattttaatagttcagactaataatcatggattttatggggattttgaagctttgtgtcaagaccatatttttaacaatatcagaagcttttaataaggtgcttgctgctgagctaatgatatgcttttgatagtttttcttatacctatcttcaatagacatattcaggctagtgtgaatgtaataatcaagcctcaatcaaaccatacttagtatgacaaatattgcattatactgtaatttaggtattcatgcttctgataaagggtttaattcgactccttgagaaactgggaaaacactattgattttatacgggatgtaaaatagcagccatttatgatgtaagatagaaatcactttctaattaaaattaaataaagagaaattaagaatctcatggccttatatgcaatggtacatattcttaagtgtaaaattatattttttgtatcagttgtgttcctgcgcatggtttctgggcacacaaaaaaattgcagttattttaatagaagcagatgatattgacttttaaaacttctcttaatttttttctgtaggaacattgcagtggtttaaactacttattccagatataattgatttatttttgttttcccttttaagaaaatgtcaaagaaatttttggacagactattattcatcatcatatcccttttaactgggattgtgaatttatccgactgcattttgggcataaccggaagaagcatcttaactacacagaattcacgcagtttctccaggtgagcttagttttcataacaggtatcaatatatactattcttctgtgtccttcgctttgtatttattaagtttattacaaaaatagaagttctccatggtatttcactcctattttttaaatttccccctcgccagagacaacttctttaaactcttaatagctgtttctttcagtgtttacttccatttatttaaatagtaaagcacttctactttttttctacttttaaatactttttaattgtatcctaactatagaagattagaagctagttctttcacgactgggcgcagtggctcacgcctgtaatcccagcactttgggaggccgaggcgggcagatcacgaggtcaggagatccagaccatcctggctaacatggtgaaaccccatctctactaaaattagccgggtgtggtggcgggcgcctgtagtcctagctacttgggaggctgaggcaggagaatggtgtgaacctgggaggcggagcttgcagtgagctgggatcacaccactgcactccagccttggcgacagagtgagactccatctcaaaaaaaaaaaaaaaaaagctagttctttcacctctctcctctccctctttatcacagacttggacttctgtcccctttcccccaatataattatgtcatgattctgcttagatcagtaatcctatgagttattataattttgtaaatactattggtggctgaagttattatatatttttttgagacagagtctggctctgttgctcaggctggagtgcagtggtgtgatcctggctcactgtaacctccacctcttggttcaagcaattctcatgtctcagccactcaactagctgggattacaggagtgtgccaccacacctggctaatttttgtattcttagtagaggtggggttttgccatgttggccaggctggtctgaactcctggcctcaagtgatctgcctgccttgaccacccaaagtgctgggattacaggagtgaaccactgcacctggcctaaagttattgttcttagagtttctagttttcatttgtttagttttctgtgtactaatactaagtcattctcaaaccttggcccaattattaagatctctttttaatgtgtttaaaacacattaggtattctattaatttcatcttcttggagctctccaggagctttcttttttaaaaaaatttgaggtaaaatttacataaaattaatcatttaaaagtgcacaatttaggccaggtgtggtagctcacgcctgtaatcccagcactttgggaggctgaggtgggcagatcacttgagatcaggactttaagaccagcctggccaacatggcgaaaccttgtctccactaaaaatacaaaaattagccaggcgaggtggtgagtgccataatcccagctactggagaggctgaggcaggagaatcacttgaacccaggaggtggaggttgcagtgagctgagattgcatcgctgcactccagcctgggtgacagagcgagactccatctaaaaaattaaaaataaataaaagtgcacaattgagtggcatttagtacgttcacagtgtcttatatctagttccaaaacatttttatcatcccaaaaagaaaccgtgttccattaagcagtcactttctatttctgctttcccctgagctctggcaacttccagcctactttctgtctctatggatttacctattatggatatttaatataaatggaattgtacaatatgaacttttcttttttttgagacagaatttcgctcttgttatccaggctggtgtgcaatggcgtgatctcagctcactgcaacctccacctcctggattcaagcgattctcctgcctcagcctcctgagtagctgggattacaggtgtgcgccactatgcctggctaattttttgtatttttagtagagacagggtttcaccatgttggccaggctagtctcgaactcctgacctcaggtgatccacccacctcagcatcccaaagtgccggcattataggtgtgagccaccacgcctggccaaacaatatgaacttttgcatctgtttttttttttttccacttagcataatgtttttaagaattatccatgtcatagcatgtatcagtgctttattccttttttgtggctgaatactattccattgtataatatagtataaatatgttatattttgtctatccattcatcagctgatggacctttgagttgttcccaccttatggttattgtgaatagtgctgctatgaacatatgtatacaaatatttgtttgaatacctgttttcagttcttttggctatatacataggagtgtaatttctgggtcatatggtaattctgtttaactttttgagaaaccacctgactgttttccacagcagctgcaccattttcctgttgtttcctcacctgcttcagggccagaagccagactgtgtaagctcactgcataggagtcattctgtgatcacccttcacttttaccttggagaatccatttgctgttctgttacgttgaacctcctgtttgctgcattttatctcttcttttattgcggtttacctatttttggtagaatacttcctgcaatggcttcttgaggaaagtggaataaaatttttttgagacttttcatatgtaaaaacctcttgttccggctgagggcagtggctcacacctgtaatcctagcactttgggaggccaaggtggggagatcacttgagtccaggagttcgagaccagcctgggcaacatggcaaaatgccatctttacaaaaaatacaaaaactagccaggtgtggtggcacacgactatagtcccagctactcaggaggtgaggtgggagaatcacttgagcccagggaggtagaagctgcagtaaaccatgatcccaccactgcactccagcgtgggtgaccgagtgagccctgtctcaaaaaacaaacagtctgggtgttttggctcacgcctgtaatcccagcactttggggggccaaggcgggctgatcacttgaggtcaggagttcaagatcagcctggccaacatggtgaaaccctgtctctactaaaagtgcaaaaattagccaggtgtggtggcaggcacctgtaatcccagctacttgggaggctgaggcaggagaatctcttgagcctgggaggcagaagttgcagtaagccaaggacaggccactgcactccagcctgggcgacagagcgagactccatctcaaaacaaactaacaaacaaacaaacaaatccctcttgttccaccattatgctaagatagtttggctggttattgaattctagtaggagtttattttccttataattttgaaagcattgctcttttgttttctagtttccagtgttgccacagtgccattctcattcttaatttaatcttgaaactttttccactctgactcgggagtgttttaatattttttcttttctttggtgtttatgaaatttcacgatggtattccttggtgtgagtttatttttattcattggtctgggctcttcattcattgggcttttctaatctggaaacttacgtccttcaattcttgaaaattttattacttttcttattctattttcttagtttctaggactattaaatgttacatttatgaccttttagtcttcttttctctcctattttccttctgagccttctattttctatttctgctgtatttctaattttcaggaactctttttggttttctgaatattccttttaaaaaatagcatactgttcttgtttcatggatgcactcttttctttcacttcttcaaagatattgaagacaggtttctttgttgtttttttaaagttttcttcttgcatagtgtctgctttctccacatttatttatttatttttactctttgtttgggtctctgtttttctttttctcttttttttttgagtcagggtcttaccttgtcccccaggctggagtgcagtgacaggatcatggctcactgtagccttgacttccccaggttccagggatcctttcacctcggcctcctgaatagctggtactacaggcgtgtgccaccatgcctgcctaattttttgtattttttgtagagatggggttttgccatgttgcctaggctaggtcttttatttcggattagggaatcagggaaaaattgtctagtctccaatctggaatattagatctggcttttgatgttttggttgctgagtaataagtagttggaggtctcagtgttcaattttgcagaaggactttcagtttactaccttttttcactgtagtattctccctctcaactgtgtgtggtctatgctggttcagagatcctctgttaaactcctcagacagtagacctctagtcttctgccaaggttgggaaagggtggaggccttatttggagtaaggcaggggtaactaactgcttcttaaacagatatccagctaagccccttgttttcagctccaccttcaccatcacttccagaggtaccaatgcagctaacaattgaatcttttgggggtcctgtcatgtacattggcttcctttttggctttttctgcttagtttttttgagtccattaagtcagttgtcatttgcttttctgctttctgatcttaaaaatatagttgccatcttctccttttctgttgtctttgtccttgcgtttctgttttgttttgttttgttcttttattgttattttagtggagagtggcattttggaagacggtggagttaaatgtacaagttcactctcatccagtcacactgtttctgaagctctgctaattttcatctcataattagatgaaatgcattttcaagggcataggatctttcccttcagcataactgcctttctttatctttcctttagttctcctatccacctacctacctacctacctttttaacccaagatttatttattttaccttttataagcccacagtattgtttttcttcattaggatgagcacagatttgaaactatgggctttaggtgtgggtatttggaggtgccagtgtttgttctaactcttttccctgttagtgcttatctaactcaccttataaaattctcaaacttgaaaagttgaaaatatatgcatttgagagctgacttttttaaaaaaggaaatgtctgcctgattagtgtttaagattcttccaaagattactttctctctttctctcactgttttccttgcatttacagagtctattttacaatatctattgtaccctgatgttttaattatactgtataaactgagagccgcatatatgtaacttctttttttctgtgtttaacttctcatttttaagtcattaattttattttttaaaatcttttttattttggaagacttcaaatatactcaaaagtagagagaatagtgtaatgaacctcctggacctataaccagcttcaataattaccacttcttggccaatcttttttatctataccctccaccctgcctcctgcaggatcatttggaagccagatgcacatactctatgattttttcatctgtgatccttcaaatacgtatctttaaaagacaaataagagtcctttaactgttgaccttatagaaaacagacaatctattctactaacactactccttcagtgagcattctgcttcatcttgaaggtaaaggtccacatcttctttagtactgagtgttattaataaggctaaattgtacccatggctaccatttgatatttctgggtgattaagacatatagggaagacaaagacataagaaagagatagaaaagaggtagaaggaaagaaaaagatatataagacagggagtgaacctgtgtctacttttgatgctatttaggaatatctttgccatggggaccaatttcaaatccatgtaatgatgtagatggattgaaaattcccacttcatttgaagggtgaagtggttggagctgaggtcatgggaaaatggagtgagttatcacaagtccataggaaaatataattaaataaaaatgatgagacttctataaaaactacttttaatgtcatgaaaagttaaagcaacattaatttgtagtctttgataagtaaatgtgaatgaaaattatgtaatctttaaataatatgtatatacttagatatgactattatttacagagttgcaaagagtgtgacggtggcatccaatagcagcaccattgttatgtttgctaacaggttttttgcatttagtcatggatccccacaacagaaatgctctgattttgacttttgtatagtacacaggggattgctggaacattttgttgtttttgtggatatcacttattacaaagtttggttgcccaatagttcaaaagttcagagatattctggactgtcttacagtttatgagtaacagtgcccagagccagtgatagctgaacactacttttgcagtttgttattcctgactttcattttagaatgactgaatattgcacttaccagttggtagagtttctcactgagtttatttgaaaaatttgtttgaaaaaatggtctctaattcatttatagaatgacagagagagagactttgattgcaacatttaaaattgaaaaactgaaaatgaatctaaactcttaattcatgaagtactctttgatgacaggtaagccttcaagcaggagagataaattactgtatattttaaaggctgaaatgaagcaccaaaaacattattctctgttttcagtaatgaaaacttgtcaagtaaaatctaagggttattttttcctacctttcctttattgatgtgctctcattcattctttttcctgaggagtaatatgtagtacatttttaagaaagctcatgctttttgaaagaaattaaaagttttgttgcaaattcagatctgtgcattgtttgttttgtagtaagtacatgtgtgggaaggatatctgtccttccttcctttccaaaccatgtacttggaatgtgtttaaccagcttaatgccctatttctaatttcctcacaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagtaagtaaaaagcaagttctttaactttctatttcctcaaaccttttgatccattgagtcctggattgcctccagggactcatatgactctcaactattcaaatttcatgcttggttggtagaaagtaaacaggtttgtgtgtgtgtgtgtgtgtgtgtgcatgtgtgtgtgtgtacgtgaatgtatgtatgtgtgtgtgtaatggaggtagaggtgatggtgagttatcttttcccggatcatagttttattcagagccaccatcttgctgtcatctatttccaaattgtttatttccatttacagagtccagttcaagggaaacaagagtttatagacaagggtgagcaattactttttccagtgggcagtaactctcccagacactactgccttcatcttggcctctttccacaccaccgggctcccaaggtcttgctataaagatggctccttcctttgttgccttcagggtgctgtctgccggagggatcatcactggcttctgcagtgttttaataaccatgcccatggcagaaggtatggaggaaatatgtggccatcagcctctgtggctcactcctctctctgccccttcacctgtacattcagtctgtatgcaccagacatagttttttgttctgtcaaactgctaatctctataaagtaatcatctggaccaatagcaaactcatgtcatccacttcctcacatagagtggtgaaactttcctcacttacccgttttcttgtctatgcgttgtacttatgtataagtttttgattactgcttgttttgaatggagggaagccaatgagtgcctttgttgtttcagctgaagatcattatccctgatttagactggggtagaaagatcaacttctgttctttttcttcagtgaatctgaacatggaccatgtcactttctcctacacgtttcacctccttgacaccatcccccactcccctgccctcacctcataccccaaccaaaaaaatgaaagaaggaaggaaagaaagggataaagggagagagaaagagagaaagggagggaaggagagagaagggaagagaaccctagagggaggggctcagtaccttagtgggaagggactcatttaatcttttccaactaggttagatagacctactataatagcctcaattttttgaggctcaattttttatagtttaccaaaagtcaattctaatcctcagaggagtatatgaaaatttgagtccagctttttgggttgctggtatccaaattcaggctaacacaaatataaactgtatttaggttaaggcatgtgtgtgaggggtggtggggtgggatatatttgctcatcattacctacactatttgtaatagacctttatgattaaaattgttacattgatatttacataagcatttctttgcatttttaaaggagaatgttttcaatcatatgggttcctctgacttctggcttggaaatgaggcttttgcaaactatgcaaaatattctcttttgagtttatgtccaagtggtgagcagagaacaaattacgtcttcatcctgcagaggtaatgaaggccacgttgcccgccatctcaggcatgagggagcctcttttgcactattccattgaagacataactcaatagtgaataaattctctccagattttctacattttttggagtttttgataattgtacccttcatgatccgaatttagagtttagcacagactgttaagtattttaattataacagtggccttaaaaattaggaaaagttgatgtaataaaattgtcttaaaatttaaagtcatcagttggtttttgtgtatgtgtgtgaaggaaaaaaacaaggttaaaaagtgttccatagattgtacagtgattttgtttatccaggactagcaagagtttcacagttgagggtcttgaagatcctgtttaaataactattgttttgatctgtgataattatatttgttgtttttgaccttataggtagatgaaccatgaagtccaacttccagatgttactttcttccttaaaacctaaattacatagacttccctgagggcatgcagtgcactgtttcagtgtgatactttccttgtatttatgtactggttgttaacatcattttaacagtgaagactcctttggatcctctttgagaaaagtacagtgtccataaacgtgtttttgtttttgtttgttttttaaactttttgtgttgtcattttctaggcagctggaggaagtatctcacaccaggttagcttctcctacttcaatgcatttaactcgttactgaataacatggagcttgttcgtaagatatatagcactctagctggcacaaggaaagatgttgaagtcacaaagggtaagattttaaaatatacataaataagaatctcagcattttcacttttcttcactgaggcatgatgttgatctaagcttaccactctaaagccagatctagaaagtatgttaccatgtgtatgtatgctttacttgggctccaaaaatccaggtggatttaatgtgatactgaggtcaggaatggaaaagtggctttgacagttttgaaaagaaccttgacccaatctgtcaaacaggtcagtggcagtgtggcagcagcttgtttgtactaggaaggagttgccacagaaagatgagcaagcctactccttttggtgagtggtattaggatgttttgaatgactggagaacacccactttttttgtattataactctggagaacaaagtgaataagcaagataagaggagattctaaagagattgttttattcttgaagttaattcatctgttttgctgttttatcatcttaacattttatcttttaccagccttcagaaatgcatattcttgtatagttgaacttaaatatttaaattcaattttagattttaaaaatgatactaaaatgcctatagctttcaggttatattatagttggtgaaggtagaactttgttatatattaagaatcattcaagattttaactttttttttctctgttccagaggaatttgcccagagtgccatacgctatggacaagtcacaccactagaaattgatattctatatcagcttgcagacttatataatgcttcagggtaagtatttcaataattcttcatgatatttattatagagtagttctaaaatgtgaagcagtggtgtccttttagttcattctaacatgagttttttccatgtatttgaatagtttatattcagaatataaattccaagaaagacaagcagatgtaacaaaggagaggaaagaaacacaggaagacagacagagggagaagaagatggagggaggggaaaggagagaacaagggagagaagaaagaaagggaaggaaaggggagggaagagaaggcgggagtgaggtgagataggaataaggggttgagatgcatgagagagtgaaatgggagaagaaagcaatctgacagagaagagaagggttgtgatagggttcataaagtgggaaagaggctgggcccagtggctcacgcctgtaatcccagcactttgggaggccaaggtgggtagatcatctgaggtcaaaagtttgagaccagcctggcctgtgaccagtcggagactgaagtgaaggctccctgtgtccagaccctgtgtttctttcttctcctctgttacatctgcttgtctttttctcttggaatttatattctaaactattcaaatagactgttcttctgcctcatttccccctgagagacgtgatcttcataaatctttatgggaggcagagggaccaatagtctttcttctgtaactacttcatgctgattggggcacagtccctacctattggggaccatggaactctagcactgctctgtctagtggagatagggtgacttcttgatggccagggcaggcatcatcatctggaactggaagccctgctgcatgatcatttgaagcttaatcgtctctaggtgagaagaaataatctggtaaaaagatgaacaaacatggtccaaaaagtcaatgcaagtataattattaacaatgggctggccaagggaaggagccatgaagcccagcttggtgcccttgaccaggagccctatgatgtggacagctgttgttatattttagaagtcctgtcagctaattttcgagtggcatccctactaatcctgattggttgatataaaaacaacattcttataggaaaagacataagccatctttttgagcagttaggagatccagtctccttctattttgtacagtgactgctgccaaggagtctgtttgattttgtaaggtgacaatactttgggcagtgtcttccaagctgtctggaagatccttggatgagcattggtaataggatagggaagttggaagcctgctaactcctattgctattcctgcagttattcctagccctaccaaaaggggtatgagttggatggctcatttgtgcttggtagttgcagttagaggtataatgagagactggttattgggagctatgttgattttaagggggtaaatatacaagtgtacagcttccaatccagttggctgataaacataagtacaactagttccacacaggagaaaggatctttgttttttaagacaaaaattgttgtctatggtgaacatatgggttagtttgttgttttcattttcccaagtgattaaggtccctgctaaggtggccctggttaaaggctggaaaggaccttgggaagtatcctgagttgccccagcagcatttttccagtggaggtagttgcacttagtgtccaccagcaaccacctagaggtattttcatactggggaaccaaaagacaactagatgtctcaggattagtatggtttttcccaagggaaaatatgaacacagctactgggcctatcttggcagtacttagactgtgtatcctttaaagtgccttgaactaggaatggtttccttgaaaccatacaggtttaccaaatgatgcagtctgggcaactgcatagcttacatgatcatgtgaagggttaatctctagggtgtagctcttaagccaattaattagagctcctttatataacatcacacacacaacacttgtagacaggggaagatctagctgttgttacgtttttctttccctttaatttttttttttttttgagacagagtcttgctctgttgcccaggctggagtacagtggcatgatctcagcccactgcaacctccgcctcctgggttcaagcgattcttgtgcctcagcctcccgagtagctgggactacaggtgcgtaccactatgcctgcctaatttttgtatttttagtagcgacagccatgttggccaggctggtctcaaacttttgacctcagatgatctacccaccttggcctcccaaagtgctgggattacaggcgtgagccactgggcccagcctctttcccactttatgaaccctatcacaacttccacagaccatctatgacgtgcttagattttctgacttgtcctgtatttccctgtttcctaagtaattaagcattctactttaggacaagaatttgccatacaagattctttctcatataaaatttcttttcttcataaccttccttatcataaatacatcttcatagctataactttctttatatctctctttcctactaaagtaatttctgatgcctccaaaagtcaaaaaggtcaggtaatgtgatgcaaaactgagcagagccttagattttgagagggacctgtctgcctacagttcttggggttccatgaggaaaacaggggtttctcctaaaatggggtctgtggcaccttctgtttttcccaaggagtcccaggctcccttaggtcctttcatgggcatcaagagtggcaagaagatagaccagggaaatagtccagtcaactgagaagaaaaacaaaactgttgtaaagatggataaactgaggcacaacgcagtttaaaaattcacgttcacatagagctaggctacgcagctcgctgctcagtcactgatgcacttgtgtggtagctcatggtgtacttcaccaacaggtttcctgccccctcagagcttacaacctgggtttcatttcctgctctacagctatataatttaacagttttcctctcaatgtgttggattctaaccctatatatctcacattttattaatattactgaatcttaaagggagccatgatgtctttaatcctcagaaatattaaacaacctggctgggtgtggtggctcacacctgtaatcccagcactttaggaggccaaggtgggcggatcatgaggtcaggagttcgaggccagtgtggccaacatagtgaaaccccgtctctactaaaaatacaaaaaattagccaggtgtggtggtgtgcatctgtaatcccagttactctggaggctgaggcaggagaattgcttgaacccgggaggtggaggttgcagtgagctgagattgtgccattgcattccagcctgggcaacattatgagattccatttcaagaaaaaaaaaatataaagcaacctgtaaacaaaggagtacatgaggttaaacagtattcaaatttctttatgctttaaaacattgagagagtatattgagaaacacacctaagaaactgcagtcaatctactgtgaacaaaaatttagagaatatctcttcaaaataagctatctagtggtatttatacatattcttacatatatcagcagtgttttacatgcttgtaacgttaaacataattgaaaagtgtcaagattatagggcttatacatttctgtgggcttgaaaatgatgcaatatagattatttgtttctataaagtagtcagtaaaatgtacaaacttctaaacggagtaataactaacaagagagttcatactgaaggtagtaatactaggaacaaaagagggctcaacactgccttcaggagagaaagggtccagattggtatattttctaaaggcttcctccagcctgccataaaacacggctagattttcctccttgccctgtgcaacctcccttactttatcataatttactgccttagttattccctttttcattcctccaaggagagccttaagaaatttggcccagttgttcattcccatgggggtgttatagtcccagttaggatcagtagcggagactgtgtctgggcctgggcaattaccctgagggttttgggcaaataaattgtctgcttctcggcaagtggcctcaaagattcattccttttccaacggggtgcaacaagttgctggaatgaattgaacgtctctctatgagagatgaaaggctaaggtcaaagcttggaacctatctgcaaattttctggggttctctgaatagcttcctagctttttctttacattgttgtatgttatttatggagaaggggacctacactcagaccagcccctcggctcctgctgcttccctaagggatagcagggctatagaggtagttgaatagagtgttcccctctgaatgtgaggggacttagcagggcccttggttttagctcttgggtttgagcctcagaaacacttggcaaggggttatatgggggtggttgccattgcccctgagagacaggtggcccttgcaaaaaggaggtcatccacaatatccggttctgccttagaacctgcccttttgggggcaggttctgggagttttgcagatggttgggttttgatatagggccatgaaggcctgcacatatgggatttctgaccatttacactgccttttgcaaaataggtctaattgcaggatggtgttgtaattaagacttccattgactccccattattcctggctgtctagctaattttggggccatacaatattatggttaaaaaaaatcagatgttttctccttagattgtcagggtcaaattgattccagtggttgagaatgcagccaagtggggaatcaggtggaatggatggagagttgcccatagaggtctggaagaaagaagagaacctagcttatttggtgactcaaattttacctggggcatccccctggaaaaactctgggccttgattggggtcctcaggggtgtccccctttagggccccatcttagtctgtcagatgtctctgaccttagatgggtgatggtaccactttgggaaggttctctccaccactgatgacccactgtgagctttccttttgtccctggatgaaggccttgtcttctagcatccatataatttgataaggccatggtttcctgttccactggagtgatagccatgaactttaataataggaactagaggttggatggatttcttttgtcatgtggattacaggtaatctcaaggggggaaaggtagattttgggcatgaaaaatgaaataatagtgttggctattccactcaggccctcgacaagagagggaatgtttaaaaatccaccaccatgacagtggaccctgtgtaagggcaggccattctataaaaataatctggtgatgacaaaagaaacaagatgtagaatgtattctaaagattgtgggccccaaaagtcctcagcaagttgaatagattgagtaggataagggaagtcaaaacatctaagagatatcctttgccattacaagctaactctttaggagaatttgacataagaaaagagggcttaagttgactgaaacatctgtgagtttgttctggaagagctgccactgccaatttcgtcacatgtagggattagggactttaactaggaaagatagaaaagagtacttccccattctgggcagggcagctatccccattcacttcttggccttcaggtaacaccagagagtggctctggctagttgccctcaattaccaaggatctactaggaaacagcctctgaaagactgaaaaaaagaaaaggactcaggtccctcacccaaaccaggcaatggtggtcaggtgcttccacatggatacctttcagtctcccgggagagtggacctggccagagacctgcagttgccttcatgcttagatgctgtctgtggagggtcccgtgttggaaaagggaaagagagcagaaagggttcccctctgtggagtgtagggagctctgcatggagatagctctagcctgtgccctcaaatgaaggctcaatagagaggaaaagaaaaagagcaaaagcaaagcaaagaaaaataaatccccaaatttgggcttacctcctggctgacttgccaagatatgttaccagtggagggtcttgactacaagttgtccagtttcttggcatattgaacaaagaattggacaaaacgcacaaacaaagcaatagaagacaaaagcatagatgtattgaagcaaaagtatactccacagatcaggagcaggcttgagcaagcagctcaagagccctagttgcaaatcttccggggtttaagtacccattagaggtttcctatcggttacaccctatataaatgaagacttggcccacaaccaatcggaggctgaagtgaaggctcagcccgtgatcaattggaggctgaagtgaaggctcagcctacaaccaatcagaggctgaagttacatcctacgcaaatgaagacttggcccatgaccaatcagaggctgaagtgaaggctgcctgtctccagaccctattctcctgcctaaaaatgggtcaaaactcaaagggttggaaagaacatatcgttggaaaaaaaaaaaaagtctccctcatacccttgttcctttccttcgaggcaaccagtatttatcagatttatgtgtatccttcccagatactttgcgcctgtcctttagataggtatccttggggacacatttagtgggtagggacagtcaatctctatacttttgcttctggcaataattatttgattttaatatctatcactggagtcttaccaaattcatgcactccacattatttctctggagtcttttgctttttgttgatgaaaacagagttaaaaggtttttatttcactaaaatgatctgtgtaaatagggaagtaatgattttaaactatagttcactgttttttgtttttttttttgagaaaagatgattttggcgtgaggagtttgtcagtgtctaacaattctttcctatatttttcctgaaggcgcttgactttggcagatattgagagaatagccccattggctgagggggccttaccttacaacctggcagaacttcagagacaggtatgagtaatctcataaatatgatcaccttaaaaaaatgctgaactagtagactaaataggagctgacagcttctgaatgctgtaaaaattaaaaattactttccagagaaagactttacttagcttaaagattacctttatagaactactgttacccccacttttatagaatatatatatattttttgagatggagtctggctgtgttgcccaggctggagtgcaatggcgtgatctcggcttactgcaacctctgccttctgggttcaagagattctcctgcctcagcctccccgagtaattgggattacaggcgtgcaccaccacaactggctaatttttgtatttttagtagagacaaggttttgccatgttgggcaggctggtcttgaactcgtgacctcaggtgatccacctgcctcggcctcccaaagtgctgggattacaggcatgagccaccacacccagcctatagaatatttttatgagataactagatttatatttgtgttttgttttttgttttgttcagataaggaaaataagagttcaaacatacatgggtttgaccccgttccccttagaattagcattcttttcatttgcctcgtcacatttaaagattagtgttaggtttactttgtatcattaaactgatatttatagggtttctaaaattaaaaaacttccctcaaattaaataaatcattcactgggattgtgccttacagattacagccaggaaaaaaaaagtaattagtgaaaccagaaagaaaaccctgactgttaattacatttttgataaatattacttttggtttttataaatgttaagaatgattaaaacagtagcttctgagtcctataaaattaatacaatcccatttctgattttacaaatactatcttggtaagaaaaagaaaatccatgaaattaccttgaagagtggaatggaacagtttttaataaatctcgttttaagttgaaacttctacttctatagcacttaggaagtttcagtggtagcagatgatcacattgcttttgtgtgtgggtaagggttaggagggccagtcattgtcctcctggtactttcctgctctaatagacatggaacctgtgttcctcataattctctaggagagtgtgatgccatactaggcaaggcgacgtggggagggcatggataaagaagacaggatacagagagagagagagagagagacagttactaaatgtgcatgctatagaaagaggctatgtctgctctttcttcattgctgccacattggtgagtagccagggttggcttgctgttattgttcaccttcaccaaatgtgttaatgaaacatcaagatatgtttaagtgtagttcgctttgggaagacttggttaggaaacctttcttctacttgagctccatggaatgatgattctgcctgtgaaactaattagaatttacagttctactttacataaggaacaagaacattttgtagtcaggttgaagtaaattgaaaatggaaaagaaaccattatatctgcattttgtattaatactttaactgtttgcttgatgtgtaataaagcttcctacagattaaaatatgttgtaactcattgcaatttagcttcttttgtatcagaaaaactcttttatctgctgccatcaaagtttatttccaggctgggtacagtggcttatgcctgtaatgccagcaatttgggagcctgaggcaggcagattgcttgagcccagaagttccagaccagcctgggcaacatggcaaaaccccatctctacaaaaaaaaaatgcaaaaaattagccaggcgtgatggcgtgtgcctgtagtcctagctacttgggaggctgaggagggagaatcacctgagcccaggaagttgaggttgcagtgagcgtgactgtgctactacactccagcttgggcaacagagtgagactctgtcttaaaaaaaaaaagaaaaaagtttatttccattaggaggtctcagatcctttaaaaatagatggatttatttcaattcagtgattttaaaaaaataaaattttataaaattatgtttaataaaaggaaagaatgtgaaaaatttttaataaaattaagagacattgaaatatttaaagagctcttactgaatttaattttattttttgtagcctatacatctgtgaaaatttgctcttgaattttgaaaaattgcatttcaaaagaagatattttgcagtgttgcatgtgtctattgatatagctctccctggaggtttccttaatatttgtaattggggaatatttcatttagcttattaaaaacattgaatttaaaagtctcaactcatttctcctcctcagtttttctgctgcttacttttctattcacccacctctcttgcccctagcaattttcctagaggccatatctgaagcttgttttgcaatctttggcaccctgagtctgcatccttcacatttcttcatccttaggaaagtgatgtaattttgctactgctgtgaattctttttaagacagattcaagatgatttgcctgtcttcagtggcagcgctgatgcttttatgctgggatgggtggcctcaagggtcttgtcagatatttaggaaatgggcagtgataaaaaccaccattttcttcttccctgggtctctgattggtatccagagtgatggggagtgctttctctgcctttccttaaccagtgagatagtacagggatctagaatttctggagagctggtagaagtcttaggtattcttacattgtccccaaaggaagaacctcagagtctcaggacaattttttttttttttgtggagacagggtctcactctgtcagccaggcacaatcactgttcactgcagtcctgacctccccggctcaggtgatccttccacctcagcctcctgaatagctgggactgtaggcatacaccaccatgctcagctaatttgttttcagtagagacagggttaagccatgtttcccaggctggtctcaaactcctaagcttacattaatccactgatcttggcctcccaaagtgctgggattacagtgtgtgtgagccactgcactcagctaaaatgtttgatgtttcctctcacatagaagatagtctttctactgaggattaggtacagagaaataaaaattaaggtcttaagtgtatattttcctgtacattattataggaacaaaatctgagaaaatagaactcaacagaaataataaataattattagaattttatagaaacagatttgtgaaggttaaggattcagattaatgtccactaatggccattgtgaaatctgatctttactgtccttgagatttgatacaagtttatttgggactcagttttccctttaataaagtgagtatcttcatgtatttctgagaagccttcaagctcctgcattctgtagaatggtatgtatcaatggattttattttcagaattctaaatttatcctcctttttcctttgtaacatttaaaattttataaggaatacaggctggactcaagtagaataatatgaaaatatgcttaagttcttatagcaaccaaagtaatggaataaactttcttcaattttcagccttgaaaaaacattcctcagttaacatatttcaggtttatgaggcattgtaaggcagccatatagactacaatcctagtgactcagtttttaacattctttagttcacagaatttcagtaatgctaaccttaactattcccatgttacttccagaagatatcttgatttgattctcttgtaatttttcctatattgccaaattagaagtacataattacttacatttattatgcagagtattcccttatatgaatctattagaaacctaaatataaaataggaagaaggatatatgtcttgttatctcaccttatgaaagttgttatgaaaacacttgtttatgatggagaatctgtgagtccagaactagaagttatgagggagagagtagttaagagcctggccactgattatgtaacatcctctcattctgtttcctcatttattaaatagggacagtatgccaggcacagtggcttgtgcctgtaattccagcactttgagaggccaaggcgggcaggttgttttgagcccaggagtttgagaccagcctgggcaatatgatgaaaccctgtctctaaaaaaacatacaaaaaattagccaggcatggtagtatgcacctgtagtctcagctatttgggagacagaggtgggaggattgcttgagcccaggaatttgaggctgcagtcagctgtgatcacactactgcactccagcctgagtgacagagtgagaccctgtctcaaataaataaataaatagggatagcagtatgcatctttataggattgttatgggaattacatgagtaataatacacttacattaagcctgacacctgctaagcatgcaataaatgttaactgctattattgtgcttattactgttatcaaatatgagaagcccatataagcaaactccaagatgggctgaaacatatatgtgacacaactgcttaatctaccctcatctacttccattaggtagaaggggatgggaagtgaggaaaaagtattaatatatctttgtattttttaagtgcctgaaatgttttatattttaattttttgatgctggctgaaattttaccaggcctgtttttaaaaatttttaattaatgatggatattcaacaaggaaaaaaaatcactaccccataccatacacaaaagtcttttcctgttcctaaatgtgaaagattaaagaggataacacaagatattctatttatgatctggagataggcagagattttgtgaatagtacagaacaccagtcataaagaaaaagattaataagttaaacttcattagatttaagaacttttatcaaaatataccactaagagtgtgaaaagacaagttacacaataggcagagatatttgcaataatttaaataatagaggatctgtatccagaatatatagtataataaacttgtgcaaatttataagcaaaaggcaggcaatgcaatagaaaaattggctaaatacctgaacagaaacctcacaaaagaggatatccaaatggtaaggaaaaataatagaaaagtttaatatcattagtacaagaaaacacacattaaaactgcaatgggatgctattttatactatccagattgatcaaaattatactctgacaatggcaagtgttgttcaagaggtgaaggaatggaaattgctagcatcacaactttggcaactatttgtcagtaccactgcagttgaagaaacacataccccgtgacctgttggttcctctcctgggtgtagtccctaacaaaaatgtttacacatgtgtgttaagagatatgtacaagaaagtttaggccgggcgtggtggctcacacctgtaatcccagcactttgggaagctgaggtgggtggatcacttgaggtcaggagtctaacatgatgaatccccatctctacaaaaaatacaaaaaatttagccaggcatagtggtgcacacctatagtcccagctgctcgagaggctgaggcacgagaattgcttgaacccaggaggtagaggttgcagtgagccaggaatgcgccactgcactttagcctgggcaacagagggagacgctgtctcaaaaaaaaaaaaaaaaaaaaaaaaaaaaagaatgtttatagctgcgttatttgcagttgcaaaaatattggaatctaaatactcaccaacagtagaacggataaatatgttgtgctattaagatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctcccaagcagctgggactacaggcgcccgccactgcgcccggctaattttttgtatttttagtagagacggggtttcaccgttttagccggcatggtctcgatctcctgacctcgtgatccgcctgcctcggcctcccaaagtgctgggattacaggcgtgagccaccgcgcccggcctctttttctttactgtatattacataattacttttttcaactgtatgggataaatgatctgtgatagacctgcttgggtatatatgtacttactttaaaaaagttttgtttctatgggaaattatattaaagctataggccactcactaaaaaaactatggaatataagctggattgtgttctgtcaaaacatcattagaattattaagaattattattttaacttttaagtttgggggtacatgtgaaggtttgttacataggtaaacgtgtcatggggtttttttgtacatattattccatcacccaggtattaagcccagtacccgatagttatcttttctgctcctctcctttctcctccagtcctccctcaagtagaccccagtgtccgttgtttccttctttgtgttcataataagctcttatcacttagctcccacttataagtgagaacatacggtatttggctttctgttcctgtgttagtttgctaaggatggtggcctccagctccatccatgtccctgcaaaagacaggatctcattcttttttatggctgcatattagaattacttttatctttattttgtgtatagcgttccttagacataggactttgttttctttgtgtaatttgcatttctgtggaccttctttgaattttggattcatgagcacatataggaagacattactgtccatttaggaattcctttttttggaacattttacctctttcacctgtgatattttaccacaaatggaagtctgttctcaaaaagaaagttaggtttatttattagtctattattagctattatttattagtcatttaactcatttaaatttaactcatttaaattattagatttgaagacttaactatagtctttaacacaacttaactccctttttgctgagagaaaaatatgtattgtttagcattcaggggaaaattatatatatattaatatatataatatataataagtattatatattatatattattatgtatataacataattatatacttatataattatataatatatattatatataatatattatatataatataaatacatatataataatatatataattatatattatgtattatatataattataattctatattatgtattatatattatgtaaatatataatgtatacattatatatattagtatatattatatacatatataatatgtattatatattatatattaatatataatacgtattatacatatataatacgtattatatatcatatattttatatttatatataatatgtattatatattatatatatattttatgtatatatatatttttccttcatctccttctcctatactgtcatggctttaggttttaatcttactttttaaggccaagaatattgaattcaaatcccagactattgaagtcatagatgtagtttgcagacagaaaaattttgttttgttttctctagccttattttgccattccagtcatacatttttgtttttatagaatctagccttttttcccccttccaatgcttgatataaaaactttagctatttctcccttttattctacccattaatagtgtgtcatttgaaagaggtagttctccctattgagttggcagtgtggtttgggcaggtttgacttgttaactgacataatcttgccttatctaatgcatcatcactgctcactgcagcctcaacctcccaggctcaagtgatccttccacttcagcctctcaagtagctgggaccacaggcatgtactaccatgcctggctaacttttgtatttgttgtagagatggagttttaccatgttgcccaggctggtcttgaactcttgggctcaagtgatcttgcctgcctcagcctcccaaagtgctgggattactgctatgagccacctcactagacctaattctcacttacaaaatgagatacgtataacaaaaaaatgaagagaacatctctttaaatgaggtctcaacttatttcctatcatacacatatgcttagggagtaggttaaaaatcatttaagattctcaactcttgttttgaaaaacacttaattaaccttgttaaatatcaaactttacgaccataatcataaccttaagggaaagagcgtcttttcctttggcccatttgctcacggcaggcaatcttcttagtgctgagtgttttccttcagcctaaatgctaaaaattcaggacacagtcattaatagggatgacagcggtagcatttcatttatgaatattcatgaagtgaaatccatagcattaattacattaatttacatacctgaatacaagtgagccataagtgataactaagccttaaaaaaatgttgctaaccatatattgtatgttttcttttaaatgttatttaataagggtgaaggtgacatttctgtcaaaaggcatttgggtatttatagttagaaatgtttttagcaaagaattaaagcacagtataatccttcagttttcataggattttgtagggcttataaacattctttaaaggaagaaagtatacagaaaaatatatgcagttgaatacaggagaaaccttttatatgaataagggtattagtggttacttgatgcttatttaggatcataggctttttattctgtgagttttaattcaacatattcttttgaaaggatacatgattgaaaataattcataatctatgagaatgaaatttattttcatccagttttgtgattgagaaactctaagtgggggaaataacattctacatacatttttttttttttttttttttttgaggcagagtcttgctctgtcactcaggctggagtgcagtgatgtgatctcagctcacagcaacctccacctccaggtccaagtgatgctcccacttcagcctcccaagtagctgggattataggcacctgccactatacctgactaatttttgtatttttagtagagagagggtttcaccatgttggccaagctggtcttgaactcctgaactcaagtgatccgcccaccttggcctcccaaaatgctcagattacaggtatgagccactgtgctggcccagtgcatttttaaagaagttaaaaacgtatgccaatgtgtttagtaggtagcataatagctatattgattttaaaatgtgagctaaaatgcctgtctttgtttggactcctattacaaattaccataggtggtttagatagcaaacatttatttctcatagttctagaggctagaaagtacaagatcaaggtgctggccgattcagttactggtgagggccctattcctagtctgtagacagcaggctgcttgttatatccttgttataagagggagagatagagggaggtcgtctttcttgtgtcttttcttataatggcactaatcctatcatgagggctccattttcatgacctaattaccacccaaagttgctaccttcacatcacatacaatcacattgggcagtagggtctcaacacatgaattttggggagtcacaagcagtgaatctgtagcaatgccataacttgaattccttcaaagtatatgagattaaatatcatcattgccttgaaaggacagattgtgtatatgttttcaactgttgtctttgaaacaaagtatcagaattaactggttaatcaacattttagaaactcattgaagcatattcagttaattatactgaagcatattcaatatagtgggccctccatctgcttgagtttcatgtccttggattcagccaactgtggatggaaaatatttgggaaaaaacaaacaataaaaaataacactacaacaataaaaaaatacaaaatttaaaaatacagtataacaactatttacatcttatttaccttatattaggtattagaagtaatgtagagatgatttaaagaatacaagaggatgtgcataggttatgtgaaaatactacactattttagataagggacatgagcatccatggattttggtatttgaaagtagtatcaggaatatttttgtgccaggtgaggtggcttatgcctgtaatcccagcactttgggaggttgaggtgggagaatagcttgagctcaagagtttgagaccagcctgggcaacataaacagaccccatctctacaaaaaatttaaaaattagctgggcatggtggcatgcacctgtagtcctagctacttcggaggctgagtcgttgggatggcctgaacctgggaatttgaggctgcggtgagccatgtttgtgccactgcattccagcctaggcatcagagtgaaaccctgtctccaaaaaaaaaaaaaaaaaaaaggaatatttttgcattaattaataagtgaaatataaaattacttagaaatatttatctcattctataatttctatttttgtatatactttaaaatacatcttatgtgtaattttataatgtatattaagtttatgtatatataattaagacgttggcaaatatgtgaactttttatttagtttattctgtcatttcatactgtttacatagtatagaaggtcttttcatagtgaaaatattaaagaacaagactgacacactagtatagacaagttatcttagatcctttctttatgctgtgggatacctgtgaaataacatctggtggaatttttctcttttttattattatagatttttatgttagaactgtggcagtagtcattagagatggtagattatgatcaatattctctgatttaagaatcaagttaatttttatacactttagaaagctttttaaattttaagttagttaaagaaggaaaaaaattttataactgaaatgcttgtttacctgaaagattcacttctgtaaactgatagtgtattcccccaacagtagcagataaatgaggcattaataggcttgtaaaaattggggtaagtgggaagctactgtgtatttggcctaacatggtttttaaatgctgacaatagagttatctatttttaaatacattgctttcatttttggctgcatgaatatcctattttcttcttttagaaaagatattactgcattaacaatatcacttttaggttttgttttttcttgtcttaaaatagtcaaattgtagctttttcacttgctgtgtgcgctttcaagatttttttttacccgttttcttctctgcagcagtctcctgggttaggcaggcctatctggctccagattgccgagtctgcttacagattcactctgggctcagttgctggaggtgagtgacatgtctgtgtgctgtttgaggcttgtgttaatgtaatattatctcaccagactgaggcagatcagcaaaggtgcagttcattgttcccatgggtcacgacttcagggctttctgaagtgttctttatttttacctatgatcaggagacttgtcgtagcaatggctatgaccatctggctccagtctgtcttcaggacagaacctctgtaatgatgtgaaagtctgggatgcagtgctgcactcaccttaattatactggctaaggccagtatgaaaaaatggaaaatgagactgtgtttatgggacaggttaagaaattgagattcgctattatccttagcaaactaacgcaggaacagaaaaccaaataccacatgttctcatttataagtgggaactaaataggagcttattatgaacacaaagaaggaaacaacagacactggggtctacttgtgggggagggtggcaggaaggaggggagcagaaaaaatgactgttggatgctgggattaatacctgggcgatgaaatatgtacaacaaacgcccgtgacacgtgtttacctatgtgacaaaccttcatatataccccacacctaaaataaaactaaaaaaaaaaagaaagaaattgagatttgggatatgaatcccagaacctcgtgaaataaaagagcctctcaaagtgacccagttttgcttttctgcttgtatgttttcctttcccttatcgcttgcttaacaatatctggacttgatgtttatttgcaaaaatgaacctcccttccctccctgttcacagccaaaatttgagagactgtttttgcttaaatactctacttagaaaatgtgtacaatctgaagttgctttgttgagaagaagctagcaggtgtgattaaaatgcttacgattttttaagataagcctgaactcaaaagacttttttttttcttttcactctcagttttagaagttgcaaaccaggttttggctttcagcagtcaaaatgtgtaatactctcgttcatgtaaataaattttcattccctgagaaattctaaagcatagccatattttcttttaaaccaaattctatacatagggataggataatgttgaagtgtgtttctaatattatggttgtaactatgattaatttaccaagatgctttattaaactaaattttaaaatcgtagccacctagtgtacggatatagtcattttaagaagtaactggcataatatttaagcatttaatggaaaatataaataaatgttatacataatagtttaatgttgttactatagaaaactgagtgttgattatctaatttgggaagtgactcgataatccactctgtagtttatgaacctacgatatcaaagagcattcttgacagttgttttctgaagcagctgtatttatggatttcagtgcttgctatagcctgctatccctaaggtgtttgtgagggaaagaaaaataataaactctcttttgtgagaatacatgttgtgttttattttctcatcctttaagataagatttgtcatccttatggactctccatttaattgtgttcttttttaagcctaaaaattgttctgtttgtagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtgagtaagcaaatcccagctgctgaagttagtgatttgatctcaccagcagcagattttaactcactaattatggaagccaatatgtagtatgcctagccagactaggtctgtttctctctttttattttctctttgctcatttccctttttgcattctttctggtgattagcaatattaatctgcaaataaggtcttcatttcttcttcttgtggtttatatttcttggtgtccaaattatgtgtttgtcccaacatgggtctatgtcaccatgctcctacaaaccaaggcacatatctgcaggtggaatacaaggatgatagttaagaaatatagagctgcttttctcaaagaattaaagaggagaaatacatctctttcctgtgaaaaagaatccaggttaccactcaaagatgagtttaccctccatatatttatttcaactgaaataaatatcaaatgtttttgtctctttcagggaccatttataaattttttccaatgagccatctgaaggtttaaaaaaaaaaaaaaaaaaggaaaaccctttggttccaagtctaattcttgcttctttcccccacttagctcagaggtgtacagtcaaaacagagagattttctttcgcagggaatgttagcagccactctagactgagcacagtgcagttggcatcagaggcagcactgcgccccatgcagaattttccccaccccccgttgtctttgtaggaacttgtctctttggagagagaatgactttcatgtatgtgttttcacattagaatatagggtttcctttgggagggagattaattttttaatctctttgggcgccacttgggattctatgaaaatactctctacatgctcaagtccatgccatttatgtaatttactgtacttgtttgtttgcacatacaagctcattaatccctagcctattctgagctctgttgaactatttggcttagaaatcttcctaagaaagactgggcccgaacaaagctttatgctcatggacaggaggaaaaaaacaccgctggttagcattatatacaggtattcaagcaaaaaatataactccgataaactcataattgaagtagagggtcacaaggatgttcatttttagcattatatatagaataataggagagagttatcccgaaatcaaactaggctcaagtaccctgctcttgagaatgaatgtgatgagttttcctcaaatattcagaattgtagtctctttgaattccacctgtacagcatgtaccctgtggaaaggcgtacaatatccagaatgcagacctttccatgtgaatgcttgttttaactgattaaaccctgcatatccagattttatttaatggggaatcaaggttgagtggcattaaggttgtttttttccttgatatctccaatatttctttgttgaataatgacctttctcctctttggtatacttttaaattgcaaagaaaatgtcccctattaaaaggaacctagatatttactgcatagtttagccttctcaatggatagatgcttacagaagatttcatttgagagagatgtcatgtttattaaatggatgcaatatagcaagtaggggaggggattgttggttttattcaggatgtaagctcataaaagcagttctttaaatgagagacttttgtattagggagaagattgtaggagtcctgtatgtgagcactatgattattgagattgtcatatattgcttgcaactggtccattattctgtcagatgattgacaaaattgttgacagattagctaaatttcttcgcaggcaacaatgataaaatgacacaaatcagtactttattaaattccatgagccttattgaggcgagttgtaaaacaaatatgcatgctgacatggttgtatgggagttagattaaaagtaatagagcctgataatcacgagggttagaaagttaatactgccatctgctgatttgttcttttaaatcagtctgctacgcatgaaaggtgtgtgaggctttgtgtgtatcattgataattcagcctgactgacagtagcctatatgtatgattacttgtggctctcaacttatggaactcagcagtatcctcaaagcaggcttaagatcagcagtcagcaagcaggcaaacacatatataactcccctttggctggatgatttaaaggatataaaatgtttattgttagcatctttaaaaaatgtatgcaaaaaagtatgctaacaatttggataagctgtgtgctttagaaagctgagcccaacagatgttgaattgtttatttttttcttttccagtttacaaccagcctggggaatttaactttctaaggattatgatttcctttgttttgaggggattcttttaaaatgtcttaagcttgacatatattagtcaataagaatacaacaggcatatgtttttgcttataggagatactcgttaaacaatacttaaaactgcatttttctttgcagttttggcttccttttaaataaatgaatattgaatgctgtgtttctctgaagagaagattatgggagttagtattctataataacgaagccactgtatgccattatgtaggtagcaaaatctggggtatgcttaacagcatgcttttcagagcttttccaagtgtacagtatctgtgtatgtttatatgttgttggttgtaataagggagggaatttggttacattgttattggcagtgttcccagaatagagaagacgcatggctccgtttcttcttcatggactttttgggaagtgttggataactaggctttaaagtaagcatgcttaagaagaggatttatagcctcaagaaaacgtgacattatactgcatttgtaaataattattacatatgtatacagagttttaaggataatctttttcccattttaatgaaaactctgcaatgtttgatgggtaaataatatgggggaaactctttgttgctgggcttgtgtattcatgtctggtacagctatattgctgatgattctgtccctttacctaggtctgataccacaacttataggggttgctccagaaaaggccattaaactgactgtaagtttatctctaactgaatttatgtcatttgtttagattaccattaagccaaaaagctaaaatcaaggctaggcgtggtagctcatgcctataatctcagcattttgggtggtgggaggatcacttgagaccagttctaaaccagcataagcatagtaagaactcagctctaccaaaacaacaacaacaacaacaaaattaaaaattagccaagtgtggtgatttatgccaggaggctgatgtgggaggattgcttgagtccaggaatttgaggctgtagtgagctatgatcatgccactgcactccagcctgagcaacagagtgagaccctgtctcaaaaacaaaactaaaattgatgctgctgacactggcacactgtcgcagaatttgtacaactttaattttacatgtaagcatttgataattttaaattttatcataagacaaatattttgctgacttggaaaagcaacagtatgccagaagagaaatggttgggaattttggttaactgatgttgtctttctaattaggttaatgattttgttcgggacaaatttaccagaagagatggctctgttccacttccagcagaagttcttgctggaggctgtgtaagtattactgttaggcgcttcttgtgacaaatacattccgttgacctttttgcacagatataatagatatcttagtggcatttctcttgaactcaagggattctaagcaggttttctcaataatcatatggaataagttttaaattttattgtaaaagctaacgggttttgagtgtagaaaagaggtagcattttccgccagttagaatggtgatcattaaaaagtcaggaaacaacagatgctggagaggatgtggagaaataggaaccattttacactgttggtgggagtgtgaattagttcaaccattgtggaagacagtgtggcaattcctcaaggatctagaactagaaataccatttgacccagcaatcccattactgagtatatacccaaaggattataaatcattctactataaagacacatgcacacatatgtttattgtggcactattcacaatagcaaagacttggaaccaacccaaatgcccatcagtgacagactggattaagaaaatttggcacatatacaccatggaataatatgcagccataaaaaaggatgagttcctgtcctttgcagggacatggatgaagctgcaaaccatcattctcagcaaactgtcacaaggacagaaaaccaaacaccacatgttctcactcataggtgggaattgaacaatgagaacacctggacacagggcagggagcatcacacactggggcctgtcatggggttgggggttgggggttgggggagagatagcagtaggagaaatacctaatgtaaatgatgagttgatgggtgcagcaaaccaacatggcacatgtatacctatgtatcaaacctgcacattgtgcacatgtaccctaaaacttaaagtataataacaaaaaaagaggtggcattttcatcagctctatctctttgatgctcctaaagcattaccttccagacttttttaaaagttctaattcctatgccttttaagaaatagagtacagaaaatatagtagtggatagagttaccattcatatatgttaactggaactttaaaacaagtgtgagatggctgattaattgggcccttatatcttaggtataggactgagtaagccattgtttaataataatttttcttctttagaggccagagggtatggcaaacaataataacggtaactacatttcagctattgacagaaattctgaaccaagagactcagatatttacttagcgcacaaaggtttctgtctttaaagtgtaagcatgacatgattattggcaaacaataataacggtaactacatttcagctattgacagaaattctgaaccaagagactcagatatttacttagcgcacaaaggtttctgtctttaaagtgtaagcatgaccaattcttaaatctatttgcagctcaactaatttcatttgtggtatttgtttcatatttgataacacatggttcgtttcagacttgtttagtccattttgttcttggaaacattaataacttccagttgaattggctgacagtcttggctaaaacttcctcagttgcttgtgaaacctgaagtgatgaggtcagtgaccttggcaacatttaattcagagacactgcctcgggggtcagagagagagagaggttgctccaggttctctttgatatgtgtcagtgtggcacatacctgagtcctctgcagagttgctttggaagaggtggactgctgtgtgggtgtgtgtgtgcctgtatgcatgccccagcacattctcaggaaggaaatctctttggctacatttcttttttaatgaagagttaacagtggacatagaataaaacttttgcttaggtggatcaccaaaaatgaagtttctcttcttcctttattccaattagattctgtaattggttcttatctagagagcgaacctttgccaatcataaatattctttttcttggtcattttaagtttctgtttggttaagaagctttctaactcatttttatcacagcacatgcatacctttgccagaaatataagtcatgctctttctgttccatgtagctaattatttgtttccatttgcaatatccaggtttttggtcatgaagctgacctgtttccatgtctgacatgtgacctaagtggttaaaccaaaataagatgtttagttcctttgttcttcctagctaccgaccctgtttataggtttgaactttaggaatttctattgaagtctgggttgccttgagggttgtgctgacactctaaatctcttccttaatcatgactcatttctggaggctttgatggattgtctagtgggaaattgacagcatgaaaaatagtcaggttggactctaggcagaatgataaggttgtctgcagttcttcaccacaaacgttttctgcttcccccttgctctaaatctcttctttcagggaagaagaaaaaagtgcaattattgagtttctactgacaaattcagttatgctatgctataaatgattgttaaaacataattcactgtttctccccaaagtctataaatttcaacagagaataaagtcttaaaaagaatgagtctctctttatagaatatcaggctgtatgggacataggatactccatttcctaaatgatacctggcaaacagccaccagattaacactgtgaagagtggctgtctgtgagcctgaccctgagtcttcatcatcctgagtagtggtggtgatacgatgtacggtgtccttatggcttttggctgagtgctgtcagtgccactagtgagaagaatgctgctgttcttccaaaaattacccaattttaaagatgcacctaatgcattaacctattgcaggttaattaggaagaaatggctcaaattgagttctaggctttttttcccagaggaaggattagctaggacctaggccttgagttccctatagatgagagggaaattttattgccatggaaatgacaatattcccttttaggaaaaatggtgtgtgttgactagatcatgaagtgacctagaagtgaaaatctctagtccttgggcattatatattttgttgttgttgtatgttttgttttattatctggtttgtttttgttttcgtttttgttttgagatggagttttgctcttgttatccaggctggaatgcaatggcacgatctcggcccaccgcagcctccacctcccaggttaatgcgattctcctgcctcagcctccctagtagctgagattacaggcatgtgccactgcacccggctaattttgtatttttagtagagctggggtttctccatgttaggctggtctcgaactcccgacctcaggtgatccaccggcctcggcctcccaaagtgctgggattacgggcgtgagccaccacacccggtctttatgatctgtttttaaaggcatgtgatttttgtttttttgtttgtttgtttttcttcttttttgagacaggatctcagtctgttgcccaggctggagtggcgtggtgcgatctcagctcactgcagccttgacaactcctgggctcaagggctcctcccatctctcagcctccccagtagctgggactacaggtgcatgccaccatcctctgctaatttttgtattttttgtagagatggggtttcatcatgttgcccaggctggtctcgaattcctgggctcaagcaacccacctgccttggcctcctagttttgggattacaggtgtgagtcaccaggctggccaaggcctgtgatttttgatacatgcaaaagaatacaaacaatataattacagaataataaaatgagcatccatgcttctagcacccaacttaactaaaacgttactactattgttgatgatgattattgcttttgatgtagcttgaatcagctaatgaggaatagatacctttcttactgggctgaacattttatagggattatctcattattgttcccaactagagttgaaaaaactaaaaccttagtgaaatccaaattttgacttagtaaatatcaaaattgtggttcaaaccacttctatctccaaatccatattctttcacacttgatataggttttcatttgttctttcatatattcacttactcattgaatacctgatatctttcatgcaaattttaaaaataccacctttaggccgggggcggtggctcacgcctgtaatcccagtactttgggaggccgaagcaagtggatcacctgaggtcaggagttcgagaccagcctggccaacatagtgaaaccccgtctctactgaaaatacaaaaaaattagccaggtgaagtggcgcgttcctacagtcccagctacttgggaggctgaggtaggagaatcgcttgaacccaggaggtggaggttgcagtgagctgtgatcgtgccactgcactccagcttgggcaacagagtgagactctgtctcaaaaaaaaaaacaaaaaacaaaacaaaacaaaaaaacagaaaaaataacagctttattgagatatacttaacgtaccatacaactcccccatttaatgtgtataattcagtgttttgttgtgaaaccatcaccacaatcaattttagaacatttttatcaacacagaaagaaatgcagtaccttttagctatcacttctcaatcttcccatcccatccgtaagatctaggcaactgtattgcccaggcaggagtgcagtggtgcgatcaaggctcacagcaaccttgaactgccggctcaggcaatcctcccacctcagcttcatgagtagctaggactgcaggtgtgtgccaccaccctcagctaatttttaagtttttcatagagacagggtcttacttggccaggctggccttgagctcctggcctcaagcaatccttctgcctcctcctcccaaagtactagagttacagatacgagccactgcacttggcctctaggcaactattaatatactttctgtttttacaaattcaccaattctgaatattttatataaatggaggctgggcgtggtggctcatgcttataattccagcactttgggaggctgaggtgtgtggatcacttgaggtcaggagtttgagaccagcctggccaacatggtgtgaaaccccatctttataaaaaatgcaaaaattagccaggcgtggtggcaggtgcttttaatcctggctacttgggaggctgaggcaggagaatcacttgagcctgggaggcggaggttgcaatgagcagagattgtgcccactgcactccagcctgggcaacagagagagactctgtctcaaaataaataaataaataaataaggaatcatgatatgtggccttttgtaagcatgacattgtgcctaacttttttcacttagcgtgttttcaaggttcatctgtgttgtagcatgtatcagtacttaattcatttttattgctgaatatatggatatactacagtttgttcattcattagttgataaacatttgagttgtttctaccttttgacttatgaataatgctgctatgaatattggtatataaggttttgcatggacatgttttcatttctcttgggtatatacgtatgagtggaattggtgtgtcatatgacaactgtaattagcattttcaggactgccagactgtttttcaaagtggctacatccttttgcatccctactagtagtgtgaagcttctgatttctctacatctttgctagtatgtgtgtgcgcgcgtgtgtgtgtgtgtgtgtgtgtatttttttaaataatggtagcgtctcactatgttgcccaagctgagagtgcagtgactgttcacaggtgtgaacatcacatgctacagcctcgaactcctggcctcaagtgatcttcctgccccatcctcctgagtagctgggactacaggcatgtgccatcatgcacagctactttccacatctttgataacacttcttattgtctttttactatagccatcttactgagtgaaaagtgataccttattgtggcctaatgactgacaatgttgagcatctttttgtgtgcatattgaccacttgtatatcttctttgaaaaaatgtctattcagaatttttgcctatttttaaattggattgttttttggttacagagttctttgtatattctagatatgagtcccttttcagatattttttattttcttgatgatgtcttttgaagaattgggctttaatgaagttcgtttaatctattttttcttttgttgtttgtgcttttggtgttatatctaagaagtcattaatccaagatcatgaaagatgtatgccttttttttctggtatatagaaattgactttatatgtatgcctccttttttcttttcagagttttatagttttagcttttacatctaggtcttttccgatttttaagcctaagttttttaggttttttttttttgccttgaacagagagagatattactaaatgtcagttttgttttagttttgattgctaatgttttggtgtatttccttctaatgttttcatatacatgtgtacatgctcttatgcatagacatatgtgtgcacatgtgtacacacacacacacacacactttttaaaaccagatggaagttttgttgactctgacttcctgattggaaatgcaagcaactctcacttactacaggaaagagggagtcacagtggaatgtcttattttagaagtagtatataacctttgggaatagtagtataaacagattgtgcattttcagatttttatttttatttttattttttcgagacagagtctcgcactgtcgcccaggctggagtgcagtagcgtgatcttggctcactgcaagctccgcttcccgggttcacgccattctcctgcctcagcctcccgagtagttgggactacaggcacccgccaccaggcctggctaattttttgtatttttagtagagacggggtttcaccgtgttagccaggatggtctcgatcttctgacctcgtgatccacccgcttcagcctcccaaagtgctgggattacaggtgtgagccacagtgcctggcccattttcagatttttaaatctcattgtgaacattaaccaaacttgtgttttgtatctatatcaaaatcttctcaaacaaacttactcattcagaatttatgataacttggatgtgctatcccaacatgttttttgtttatttgtttgtagtatctataaattgaactctaggttaaattgcctgaccttggctaggtgtggtggctcatgactgtaacctccacactttggaaggctgaggtgggaagatggcttgagcctaggagttcaaggccagcttgtgcaacatagtgggaccccccatctctacaaataataataattttttaaaattgcttgacccttttttaggtggagatggggtaagattgtatgtgtgtgtatacagttgctcagtaaatatctcttatgaatgttgagtgttgtatgagtattaaatatgtaacagtaggttttaaataatttttcctgttattctcataggtaaaccattcttatcagaccatatgtttatttttctattagaaaatttctgtctttctgtacacacacacacacacacacacacacacacacacacacagatccagatattcctcgacttacaatgaggttacattgtaataaacctatcatgagttggaaatttttaggtcaacagtgcacttaatacacctaaccttctgaatgtcatagcttagcctatcctacctaaaacatgctcagaacacttatgttagcctataattgggcaaaatcataaaacacaaagcctgttttataatacagtattggatatctcatgtaatttattgaatactgtactgaaagtgaaaaacaggctgtatgagtacttgaagtattgtttctactgaatgcatattgcttttgcaccattgtaaagtcaaaaaaccataagttgtatcattgttaagttggggaccacctgtatatatgtgtttatatataatatttatatgtacaaatgtatgtttattcgaagacacaaatataattgaatgtttgattatgatatctattgtgggcaaaaatagtaccttaatgtcaacctagaattttcaaagtacattattatgcattattgtcaccctctataaaataggtagatgagaaacagaagtccaaaaaggctaactctcttaccccaatttacacagctaatatatgctggaggtttcatgtgaacccaagtattctgatttttttagaccaagtccttttattctatgatgtccttttgggggaatcaaatcattgattgtgtcaaaataaatctagatgaccctattcaactttatagtgactttcttgcctctttccttccttcctttaataagtgtatgaatatgacatatttacatatttggttttttaggtataattaacatttttaaaaggaacagattttagatattcagctcaatgagttttgacagttgtatacacccatgtaatcaccacctaagataatgaacatttcaccccagaaaagtcgttcatgcgtctttccattcagtcccttctcccttaccccatgcaaccacacttctgatttctgtctgaagttttgttgttcttggatttcatgtaaatggagtgcacgagatgcattctttcatggctggcttcttttgtttaacatgttttcagagagtcatccttgtgtgggtatcaggtttgtgtttgttttaaattttgctgagtagtatttcatcgtacgaatttaccacaatttgtttatccatttttctcttgatggatgtttgggtttttgtctgttacaaataaggttgctgtaaacattcttgtacaaatctttttgtcaaccaatattttcatttttcttgggtatctaagaatagaatagagtcgatgtatattcaatttaaaataaactgccagttagttcttagaagtggatggatcattttatagtctcctaagcagtgtacaagtattccagttgttccacatcttcactaatgtttgatatctgtagtgtttttgatagtaatcattgtaggtatgtgaaatagtatcttattgtggtttaaatttgcattcttctgattcctaaagatgttgattatcttttcatgtgtttattggctattcgtatatgtgtgtgtgtgtgtgtgtgtgtgtgtgaagtatctgttcaagtcttttgcgtacattttattaggtttcatattttttactaattgtaaaagttgtttatacatcatggatacagccctttgtcaaacagatgtgttgtggatatttttttgccagtttgtgacttgtttattacttttattaatgatgtttatagtagtttttaaagaaaaagtaattatgtagttttttggatagatccagaaacttaagggagaataaatttaaatatcttttcaaattaacaaagcagaatattaaaaaatctaaatggactaacctttaggtactttctaatggtctctttggtaagtacctgttcttttttaattgttaaactcgaatcagagattagtgataaacttacctagctgactgcattacctctttcagagagtatatactcctgagtggatggaagtcatgaaactcaaaacttattactcagcaaagtgctaatgttgcaggtgaattttcacaaccctatgcgaacacactttctggagaacacgttctttccctttgtgtcttgctttcagtctgcatagtgctctcaaatgagttagtagtgcacaagacctcggtgaggcagagagcatggttgtgggaatggaatggttatgccgaatgcaaaatctatgacgatctaggtcagtagtcttccaaacctagaatctttcaactctcccatgctttttctcagcttaagcatgtgtctacacacaccacatacacacaccctcccttcatatcggtaaagcaaaaagcccacatgttaggcggagcatttactaatcctgggggccaagatctgtaactagccagctccttatgatgaagaattctatgtcttcctcagcaagccaagcttgtatatctctaaagagtagtttggaaacagctcttccacctctcatccccaggaattagtgtagtccaactttatgcctacatacttatgtgaacacatatagatatgcatacaagttgaaaatccttatatatttatgtcaaaagtggcttatgataggtacacagggattttcattcttgctgtcttagttcattttggctgctattaaaaaataccttcgatggagtaatttataaacaacagaaatttattgctcacaattctggaggctggaagttcaagatcaaggtaccagcagattcagtgtctggtgagggagggcttgctctctgcttccaagatggcaccttgctgctgtgtgcttgcatgtaccttgctgctgtgtgcttgcatgtaccttgctgctgtgtgcttgcatggtaggagagacaaggcagctcccttcaacctcatttataagggcactaatcccattcactagggcagaaccatcatgacttaatcacctcccaaaaggccctacttcttaatactataatgttggatattagttccaacatatgcattgtggggaaacaccaatattcggatcatagcacttcccttaccctagttaggagtatatgtagtgttaatttgtaacaccctcgcatatatcatcactcagcaatgagcacattgcatttatttcttttaaactatcactatcctattttagaaagaaccatagcatttcctattgctttacaaaaatatgaacggttggtggtgtgcaaggctgagtcactgtctgttcctgttcctcttgagtcagtcctagtgacagctagttctgtgacttttactgtttatctggttattttatacgcacatactgtgttcatctggagttgatgtgaccttaaataaattgaagttagattttcatcagtctcgataagggaagactttataatgagttgcttagattggatattttgtggttggagggaaatcatttcaatctataggagacaacagatcaaagaaggaaataaacaaaggacttggcacaagcagggcccagcctccaacctctttgtgaaccttgccccaggggtaggattgagagggcagaaggttgaataggcctaatcctgtatacagcccctcggcctttggcactgtggaggcatggtgacatctcaaaattacatccttttccccgctaacttttgctgtcagctttagttgattttctcattaaaaaattcatatgatataagattaaatggaagttttttattctttccatttctgttatatatgggtaaccctcattcaaaatgagatttgttcccttttatgtatcttttaaactcagttctagaacaaagaaatgacaacagaatactgaaaaatagaaagcatctaagtctgttttagtattaatgtttgtatctcttttaaaaaataggcgggaaatttaagcaattagagaattagaagctaattttggtgatttcatgagtgaaaaaaattcagcaaaggtatgatatagagtggtatgttatctaatgtaagcattagtaacagaagcagcaagatgccaaatttagcaatgtccatttacatttatatagctgtgtatcattgtgatttaatttaaaattttatatatcttagtgtcgattatttcaggtcactagctatatttgattaggttttttgatgttcatatataataagctttttaaaaaaccttgggtccacagtaactaacgccaaccagtttaaaaaatatatttgccaaattaccaaatttaccatgaagaagaatatgcgagagaagacttagtctataaagaagccattgtttctaagaccaggtctgtttcttgttgttgttgcgtagttaatacattcatatgttttgaaatttaaaaggtacaatagagtatgctatgaaaattatttctcccagctattcagtttctctttccaggaggcaatcaatgttttaatctttaagccacttgggttttgagaaacttaggtaaattttgacatatttatgatcaaatgtgtgcctaatattttatgttctgtttttgtcatttggcgtgattttattatcaaatcatattgcccaattaatagcatagaattgtatctacttagctgttttattgggaatttgaatttcttcctgttcaattttgctgctattaaaaatagcaaacattagcatatttgtagaaatacaggtactattttttattgaaaagttactgtatttatgaaattctctatattaaagattatatttactgcaagcagtgcttttcccctttggaaagctgttattaatgatatcatttataatcaatagagtcttagaagaaatatggtatttctctgtatttgtttcgcagagaggaaacacccagttcaagagtttgataacatcatagtccctcattctgagttgcttgatttattaccagtataattgaactaatctcagattttactcccccttccctatccccagtttaatatgtaggatagagagagtggtcaacctcagaatccgaaaaagaacagtgcatatttgccatgtgtgtttccctttaagcattataaacatccagagttttagacaaattattacgttggtacaaaagtaactgcggtttttgcagtctttatctttgctaaaattattcagcgtttctggaaagtatttgccttatgttcctaggcctatcatgaggttttaaaaatgtatactaattactaaaaaaaaaaaaattttaagagataggggtcttgctccattgcccaggctggccttgaactcctgggctcaagtaatcctcctgcctcagtcttgtgagcagctgggactacaggcatgtgtcattgcacttggcttgtatgttaatttttaaaacatatacaaatcattaattgtcagaagttttcctccttcaaacataggcatgaaacaaacttacagatgtgtgccttgctatagtgtcattgattatttgcactcttacttgctagattatatgtgtttataaatgcacatcaattgagttttgtggttatgtcctgtgcgttgttgggatttggtatgtgtgctaggtaactaatcttcaaagcatacaacaattaaggtgtatgtatttttaaaatgtagtcccagctgggtgcagtggctcacgcctgtaatcttagcattttggaaggccaaggcgagtggatcgcttgagcctagcagttcgagatcagcctgggcaacatggtaagacccccatctctacaaaaaatacaaaaattagctgggcgtggtggtgcacgcttgtagtcccagctactcgggaagctgaggtgggaggatcacctgaacctggggaggttgaggttgcagtgagctgttcctgccactgcactccagcctgggtgacagagtgaggccctgtctcaaacaaacaaacacaaacaaaatgtagtcagttatttctttttattgtaccatttttgtaaagtttcagtagaaagcctattacttgtatacttcaaaaaatttgaagcattgttaaaggagtataaatctcaatcaattatttctaaaagagagaaggaagaggaggaggcagctgtggggtgggggtgggggacacggattggagtactcctgcccagcaggatgttataatttactaatgattacaaacatgaaagaccttagtatttatttaaacataatgtccacatttaacacttggcacccagggactgacactgtctggtagtggcaaatttgggggaattagaataaaaatttgtggttctattcatttttaaatctgctttagttaaaacataaagcagatatgcaaccattatttaagatagtctttgcaaccattatttaaacaagagatttcagggaagtagtaaactttttcaattgatttggtctttaatactagctacaggagcaattacttggattatcattttaacataatttttcatgcagcaatccttttgaaagtattgtttgcttagattgaaacattaaagtgcttccttctgcctgcagtacaacagattcaaagagagagaaaggcaggcaaatcaacatgtaaaattgggtcagtacatcgttgggggacctgtgtgccagtggtctggattgtgtcgagttgaggagttagaggaaaccatgagagagagatagcaaattgctgcacctccctgctcgaaggacaaagaggggattaaggccctggggaatccaggacaataagctgtccatgaagagggaaggaatttagtatcagtgctggcaattttgaatattgaaaggagttaaggagtcaggattggaataggggtagttgggggatttatagtcccaaggcaattaggaaaatgggctgagccatgttcctgccccttggaagcgggtctgggagggctttgggttttagataagtgagcaggaatgtgggcaaaggttgagcactgaagtgccattgaaagctgcatgtgaatttttaggtgttctatacctgtggaattacagtgccccagatttcatatttcacatgtgattatatacaatgattataatgatatgaatatcattatgaatattatatgagtatggttatgattacataatataaacagctacagttgaagatgtacaaatgggatttttcatttcatgaaaggagatatatattttatttatttttatatatccatagtcacacacatttttttctttcttacagaaaccaaaaaaaagaagttggtagaagttttgttaaacgttttttttttttctctactagttaacagatttcagatgcaaatatactctcattatccaaattcaaatctctgtcactcaccacaggaatatagaatgtggctttgatcttgagggtgttgtactcatggtaactagatgttccatttctcagctttgccttgaagagtttttctggttttgtcttgaaatgatactgaaatttatctttctaaattcttcccttttgtgtgggtgtagccatgtacctgtatcagagttttgcttaggataatacattttagaattggaactggaggagacttttccccttctgacttaaggcaccaaagtagttttaattgctctacaatccaaggaagcagaagcaagtgggtctgctgccaagaacgcttaccacaaagaggaaaaaaataattgtagctctgaattttagctctggcttgtaaaatatgacagtcttttactatctctttttctttcattgagtaccttgctgccacatctggctccgcttttttttccaaatgggtttattttgttattttgaatatggctggggtgatcctggaaagactggtctgagaaacaatcttgacatttcagctagaaacaaacccagaggtagattgatctgagacagagtttgggaccatccctctgaacctctccagggttggcctaagtgtcaaactgtcattcccccctgaggaaggaagtttcacctccttcttttcaagatagcaagatgtggaggctttgctggattttccttttttacgctgccagtcgggctctgatgtggaatctgcctgtctcttctcccttgcctacaggctggaggctctcaggtcatttttaccaacccattggagatagtgaagattcgtctgcaagtagctggagagatcaccacgggacccagagtcagcgccctgaatgtgctccgggacttgggaatttttggtctgtataaggtgggtaggtttaggttataatgtactcaataaaatatgaaagaatgtggaaaccagacttcttccctccaagttgaaaagcaatcttgtccagcagggtagtctgtggagcagaaaatcaaacaaaaagaaaagaatcaggacacttgtatgagaggcagtgggatacacatgcagcctctcctgttgtcatcaggcttttatgaaactgccagcaaggaggccagcaccgcagacctgctggcctcaggctcacagcctttcatttgctggggggcttgggaaaactttccctggtgctctctttgggttggtttagggcttcaaaatagtcttatgtttattttcggtctgattatctctattgttatcttcccagtgggagcttttgtcttaataatttgaccacagtaaaacagtagtagagtttggtaggattcaggtctttaagaagttaagtggtaggatttgtcaataatgaattccattaaaaaaaaaaaaaacaaaccaacaacagagtgtactgtactttaacaaaatgccagtcaaaagattccttccctgcgggtatacttactcccatcattacagatcagatgtaatggagcagaagctattatttttcttaaacaaggaagaatatttctttccattcctttgcctggtataaggggaatacgtaaatttagccaccatagccaagtgtgtttccacagcatctgatatagatccatcactgcagaaatgtgtaaatttgtttcggtaactgcaaattagaaattagaaattctctagattggaatcacacagctacagggttctctggagaccagcaaacaatgatgcctgtctcaagagagtttcgtacacatttttgcttcctcctccccactcccaatttccatcctttttgaattccctttgagagatgaatttattaatattgcttctctctgtattatcctttagcgagtccttggattttttttttttcaatgtttgagtttgtctttttttaaaaaagccagggctgggagcactggctcacacttgtactctcagcactttgggaggccaaggcagggggattgcttgagcccaggagttcaagaccagccagggcaaaatagcaagaccttgtgtctaccttaaaaaaaaaaaagaaagaaaaaattagccggcacagtggtgcacacctatcatcccagctactcaggaggctgaggtgggaggatcacttgagctcagacggtcaaggctacagcaagctgtgatcctgccactatgctccagcctgggcaacatagtgagaccctgtctcagaaaaaaaaaaaaattaaaaagaataaaacagagtcattaaaaaaacaagcgccaaggtggagtgtttgcctagctaggtagtggaatggtgtgggcttctgacaaagctgagggaggtgttctttgagacctcagtcattgggacaagctgcccctgggtaatgattttctactcctgtggaaacctgccgctaaaatattttgtctgctatttaggacatggggaatgaggagagaagatttgggtttcttttccccctgctctagagtagttacttttccttcaccactgcctatagctttttacctggcactgcggggactctcagctgatgtaaaaacttaagagggtagatcttgtgtgtttttaccatagtaagagattaattaattttaaaaactctgaatctatataagaaatgccagaaagttcttagttttcagaatactatcattacccagttattaactctaggactgcaggattcaccatgctttcacaagctttgagatatgcagatttccctattccccacttatctcccgcctcccccatttcccttgcacatcagttctaatgctgtttaagggacacctcaggcttgtcactgagggacacctcaagcttgtcactgacaaatgtcacatggatcccatttgggcattcacactcagtttcacactgttttgcactatttcctcactgtgtgacagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtaactacaaatttttttttaactgaaagaattctcccattatttaaaaagtacagaatctctatgtactttccccctttatttctggaagtattattgtttgtacctgacttagtttaaatatcactttttctcctttgtgggatgtgctgtaattctgatgagagttaattacatttgcataatgtggataaacagcttaatgcagcttagcaactcagagccaaattagatctgcccatctaaattgggctttcatcattaacatgtttcttagtttcctgtgcccctgaaaccttgagtacagccaagctaagcattaaggtgggaaagtttttcctcaaatcagttgcttagctgtatctcatgctcatgcacagatctagcatgctcttactttctctcttctgtatattggaatctacatgatttggccgaaaattgagcttttgtcgtgaagctgtccctcttcttcctaccattgccctcattagaccaaagtaagcagtacccctcagcaaaccaccttgaactcaatttttgtattttttctaatcgttaacactttgtcattagccaggtgtagtggtgcgtgcctgtagtcccagccagctacccgggaggctgaggtgggaggatcacctgagcctgggaggtcaaggctgcggtgagccgagatgacaccactgtactccagcctgggtgacagagtgagagcttgtctcaaaaaaaaaaaaatttgtcttttattaatagttatttgcataattgttatcctctgtactaggctaatagcttcttgagggcaagagtttcattctcttcatccttgcctttcctacgtggccagtgtaatagtaataggtgctcaataaatgtcaataacatgaatgaaaaccttcatgtcgtctaagataccaaattaggcacagaagagatttcatttgaaagaggagccttgtaagagcagggaggtactaagatgcttccttctgacctcataggtacagcctgactcttgagttaggaaggagctgacttggaatagaaggagagaaccaggtgtccttggctgcaccaacactctgaaaagacaaaggaaggaaggggtgcatgtttgctctctatacaaccagtaatgaaccattacagagctcagtgtggctctgaccagccaggcttatgttcactgtgtggctcttccttgctgggctcattctctactggaggctactggctaaacatcagggcaacctgagcagctcccggagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctctgtaatggttcattactggttgtatagagagcaaacatgcaccccttccttcctttgtcttttcggagtgttggtgcagccaaggacacctggttctctcctccttttccaaatcagctccttcctaactcaagagtcaggctgaggcgagcttggtggctcattcctgtaatcccagcactttgggaggccaaggcgggcagatcacgaggtcaggagatcgagaccatcctggctaacacggtgaaaccccgtctctactaaaaatacaaaaaattagccgggcgtggtggcgggcttctgtagtcccagctactggggaggctgaggcaggagaatggcatgaacctgggaggcggcttgcagtgagccgagattgtgccactgcactccagcctgggcgacagagtgagactgtctcaaaaaaaaaagagagtcaggctgtaaatgtgaggtctcaaactcctgacctcaggtgatcctcccatcttggccttccaaagtgctgggattacaagcgtgaaccaccacacttggcccagtctcctacttttaaatgggggcagcatttgccttccaggcttttccttgtgctttccaatcaacaatgaaaaacagccagagaagaagagtctaattgtggacaggtgtttgcaagtggttgaaccaagtaaatatttccatggaactgtcagcaccgacttcttccccatagacatttgatgtcagttttcagaatgagattattttttctaatttttaccagtcaagctttgctagcaggaactgagaacattcagaagtctgcctccaaaggcaggaagtttacctagtttcatctgaatagggtgcaaggccatgccaaggggaagtatttgcattattccctagcagaacctcgtacaaggctgccaactccatccgcctagtgaggatacagtgatattcaggccaaattgaatttcttcccccggggaagattattttgctcctttgctctctgttttgttttataagtaaaaggtgtggttgtgaaatccatcttttgtgtcctgctgctgatcaatctcaacatgaccccagggagctcgggcacaggggcctttccctgaccagctcccctgttgtttcttaactggctgcctggccacctcttgctccagttgtaatgacttttgtcatgtaagcatgtctgaaaggagtcacagtcaactctcaaggtagcccttcaaacaagcgagtgattataagtattgatattcacttcccacactacgacaagaatcagcaaaaacagtagtttggtgtcagatacatttagtgactcactaagatgacattatcatttttttatacataaaaatacttgtatcttatttaagaaaaaaaggaggtaaaataattgaaactgaaagggaacgcttgggaattgtcttattaatattgctactttttttttctctctcacagttatttgggatcatgcaatgtagagtgattttttttttaattcaggaaaaaataataataattttcccctgatcacactgcaacagctaataggcttctatgcccttttcccattaatggccagacatctatgtaaagagttttgagttccgctcaagtggttgaagttgcaggctctatagtagatgttagcagtattcctatcttttataaggtactctagataaattaaatgtggttttctcctgaaaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcaggtaggcaggggctggagccatacagaatggctggctggctctagcgtcctcccctgtgactcagtggctgtctttaccacatttgtcctggtttcaagtctcccctgcccctgcttctctttttcagctcgagtgtttcgatcctctccccagtttggtgttaccttggtcacttatgaacttctccagcggtggttttacattgattttggaggcctgtaagtcagctgctcaactcctttacaaagaaatcactaagtccaaaacaaatgtttgttctgtctacaaaagcattgttgcaactcttagaaaactgataagacagaacctttaagaccaatgcatttaaaacagtgagcttaagaagcatttgtgttaagcaagtaaaacttgacagagtgacatcgtacataatattaagcagctatttgggggattttagggaagcagcaaatttttttaaaaaagacaggatatcctctgttgcccaggctggagtgcagtggcatgttcttggctcaccgtagcctcaacctcccgggctcaagcgatcctcccacctcagcctcctgagtagctgggaccacagaggcatgccaccacacccagctaatttttgtacttttttatagagatgggatctcactgtgttgcccaggctggtctcgaactccaccagccttggcctcccaaagtgctgggattacagacatgagctaccgtgcctagccaggaggcagcagattaaaatgctgtgtaaataattgtcttttttcacataagcaaatactgaacttcatggcgttctcattatgtggattttattatatggccctttcacagaagtaatgtaaatgtataccagtaacacttttgtgcattttctttcaaagtcccaagcccttttgcatctctgatatttcattattcaccacaatttattattagttaggtgcagatgttcttgaagctaatttactggaaaaaccaataggtttgaagagagattttgcccatggatataatcactagtgagctgtaggccagaaattgggcttctaaaagcttaccacttgaagcttgcactgagaagaagaattacaagttgaattttctgggtggggaagttgtacccaaagcaagcaattattagcttttcagcagaagaccaagtaccattcctgagtcctcacatcagaaacctgtgaactcctctgtgcccaaaggccatatagggaatcagctgctgaaccaagtggagggacctatgcaaaaaaagtgagaacagcagtcttacagttgcattgtagaaatgtgaggcttcaggcttttccatgcttctttcatcttctgtaaaagaactaaagctatttctctctctctcttttttttttttttttttttttagacggagtcttgctctgtcgcccaggctggagtgcagtggtacgatctcggctcactgcaacctccacctcccaggttcaagtgattctcctgcctcagcctcctgagaagctgggactaagggcgcccaccaccgcgcctggctaattttttttttttttaatatttttagtagagacggggtttcaccgtgttagccaggatagccttgatctcctgacctcatgatccgcctgcctcggcctcccaaagttctgggattacaggcgtgagccaccatgcccggcctatctctctttaaataatttaattgataatctttatgagtctactacataaaaagttaacttctaaagttatgtcaaaagaaaaatatatactttaaaaattactttcatatgtgctaagtgcagaaaatttggaaaaccataaagcataaaagaaaaaaaccagcctgggtgtggtggctcacacctcccagtgctctgggaggccaaggcagaaggattccttagaccagaagttcgaaaccagctttggcaacatagcaagaccccatctttacaagaagaaaaaagaaaaaaatcatccataatcttactacccagagagtcttcatatttgagtgtcttttcttctgacttttttcctatggatttgtttatatatgtatgcaagcattggaaataaggccatttctcttgtaaatcaaatatgtagataagttgctgtcaaagcagctataaatcatgactgtggtttctagtcatgcagcacagatgccatggaaatggttgagagaaacattcttctttgtggcacatgggtcagaccgaaaatgtccagctgtaagctgcgctcatccaccttgagcatgctaaccattggctttttttctgtcaacagcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctatatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgtatacatgtagttggatttttctttgtaaatatactgataatactttttgttctgattgactactgattgcaaataactcatgatcgggttcgccctttcttccacctttatagaaaacagaaaaattagttttagaaagggctagcgcagagtgaagggagggaagaagaaagagaagaaaagctctatatggtgatttagtggggtctaggttcttactttggaatccaaatgcaaactgttctaaaagtcactcatcaagggcgtgattactaatttggatctaaacatagatcttgacagccacatctacactttgatatggatgtgatttgatgtgcagtatcagaatttatttaccttaccaaagtgctctgggaagacattattgctactgccagtaagctgggatatgagaatgtatgcaaatattttcaagaggcgagcctggagacagaccaagttacttagtatcctgcacagtgctcctcgattgatggctgacagccctgtgactgcaactgtaggctccctggaggccctccaggaacaaaagaattagctttgaaagcaagttattttcaaatgtattagattggtctcatgggagtggaacaaataataatacagttgttttgctactaccacttgttagaaatatataagtagtccatggatatgtgattacaaaagaatcctatgtatgtatctagagtgagatgggaaagtgtcccgcttaccctccttctacctccaccacttcctggcccagaggtaatcactgctaacaggttacagcatgaatatgtagtctgtttttcataactctatagaaatatatgtacatatttatattttagaaacaggattatgttatgtgtgtgttattctgtgtcttgcttttgttcacttaatgtgttttggatatctttccatgtcagtttataaagttttatttttaatggctgcatagtatttcattgtatgggttataatacttttcataaatcttcccttattgatatttattcatttttttcactactgcaaacaatgctgtagtgaatggcagacatctttgtacacatatctttagtgcatgtgaatttcattaggatagatatttggaattgcaattgaaaacttttaagacaagctttatgtttttatacatattgccacattgttcttcaaaaagagttattaatttactttcctttgacagcatatgagaatgcctatttctttgcaacctcagcaaagagggatattatcagtcttttacattttcagcaaatcatgatagctgatcatggttattttatttttctaattactagtgagattgaatgtcttttcatatttactggtcatttgtatattttcttattgtggaatatggacaaagtacatgaaacatatgtatgcatgtccacaacagatatgtacacacatacatatatattttttaacatatcataatgtgcataccatatgaccaccgggtcaagaaatagaacatctccagtacctcaaaagctccatatatgtccctccctaacacaaccctctgtccactttaacatcatccct

SEQ ID NO: 17052 - DNA, 20538 bp, Human
cagctactcgggaggctgaggcaggaaaatcacttgaacccaggaggcagaggttgcagtgagccaagactgtaccattgcactgcaacaagagcaaaactccatcaaggaaggaaggaaggagagagagagagaaagaaaggaggaaaggaaggaaggaaagaaggaaggaaggaagggagggagggagggaaaaaagaggggagagaaagtccctctgctcaatttggcaccaagcctgccttgcctagacagaggtttcaaagccatggttagagagacatgttggggtttaggacacatgatgtttattaggggggtggagctctagaaaccaaatgaaataggatgtctcagaccctcaaatgccagcagcagttgtcatggagattttaaacgcctatgttgggaacttagctcaaaaagagggctacttcttggttcctgccaatgtttttctgttttgtgggcaaaaagggatatgagaaagttgtccagagcagtttcctggccctgttactgtggtgcttaacttcctggtcatgaaggctatgagaatactgaagttttctgttctcaaggagaagagtgcatggcaaggggagggaagcatgcctactgaggccaacaccatgggccagcaatcaaatcagcacagaagacagtatgtttatcttatgcaagcatggatcttgtagcccactttcctttgaatgaaggaatgggaaagaatggcccagttgatgatgaaaaaaaggtgcacttatggaatgccatttagaatgacttaacctgtcgcttttggggaactttgagtggaggagtggtggcctctcaaggtacacatgtacactctcgtctcttctgactaagagtacacatttaggactttggcacttttagaaaccacttgaaattcaccctagtatgaagtcatgagtaagtaaagaacctcatgctacctttctctttgagtaggataagccccatttatgaattactttagccccttcattaaaattcctctttgtagaagacaacctttctgcatacttaactctgtcttattttgtatagctctttagaatggtttgatggaccttagctcctttaaccctcccaagagctatatacaataggtgaagaacattctatccctttttcttagattaagtaaccgaggccagaaaagataaagtgatccatcccagattgtagattgaaagggtaagagccaggcttggtgaacagccatcccacttcaatgctagctctactgctatatgcatctgtattccaagaactattatctgagtaatgtttccctatctgtgcacctttgtgcaccaaaatatgtctacattctgggttattctcccctcccattctgcctaagacagaagctatggcaggtattggtcctcagaggtactgaggccactgttggcaaagagaaacaatgtttcagctttttcagttataaaataaagatgacaatctctataatgcttacctcacatggatgttgtgtagatcaaataataatagatgtgaaagtactttctaaattgttatgatctgttcacacatgagggattgtgattattctttaccccctgggcagaagccaactccttgtcttattactctctttacaaattcagctcctggtatagccactgactgtgaatttgagcaaattgcttggtctctttgcctcagtttcttcatctgtaaaatgttgctaacaataattcttaatatgattgtcttgagaatggaatgagttactacatgcaaagcatttacaagaactcatggcacatggtcagagctacataagcattaactcttttgtgttggcttcctcgtccctactatctcagatctagagaatagattaaggggacccagaagccaagtggcatggaagccactacttatagtcccttcccactagcttgctagttcttgtgttctctacccacagccttcccaccatggattgccaagaaaatgagtactgggaccaatggggacggtgtgtcacctgccaacggtgtggtcctggacaggagctatccaaggtaagttatcctattcagtacacttatttctgttgcatcttaggaaccagcccggcaactgaaagaggccaagattaggggagtcagccctacttatgactgatccagttcagcgggtaaaacctgggatccacagagtatgcaatagcagtcatgattccagcatgaagtcagcctagcaggatcaaggtcaagggaagtttccatgagataacagagtatttcaagaatagatgtgtaatgcagagacccatgaggactgttcagcattagggtaatctgtcatctaaagcaaggcccaaccacatggtgttcaagagccagatatcaggtcttaggaatgagaaagagagaagagccaagaagacctctgttctagagggtctgcgctactgaggaagctgtgcaatggagaatatagggatagggaaccacggagggtctaaaatcccaattaaagataaggatcagaataaaatgaccagcaaggcagagactttatgtaacttacttgtttcaagcctggatctgcttaattgttctttcctcaggtcccttgtaggtccctgaacttgggggtggtattaaattttggctgcagctggggctacagaggccagaagcaagcagctagcagatggtttctgcatattcacactctattttatgcaatttttgtttattcagcagttgcttattgaacacttgcagagtggcaggcatggttgtagacaccatggatatggcagaacaaacaaaaatatttgccttcatggaccttaccttctattattagtgaaaaaataataattgagacacatacagagataaatgaagaatctggatatgaagatatgagaagaatcaaattagggtgactgggtggctacttcagattatgaaacaaggaaaggtctccctaaggagacagcctctggggagaggatactagtgcagagtcccaaggtgaaaatgaactaggcattttgaaggaaaaggaggaaggtagtgcaatgggtgtatggtgaatgagagggagggtagtacacaaagaggtcagagagagaagtatagaccagaccagatagcagcttgaggtctatgagaaattttcatctttctctaagtgcattaggagctctttggagggttttgggttggaaagttataggaatctgtggctggaaaacaacataataattatctagcccactttattcctacctttgtattttaaaaaatgaagagaataaggcgcagggatatcaagagatacaagcactaattctaagtttttacacatggcattatgtcccacagtggggtacccacatggttgataaaggatcccagtaccaaggaaagatcgccagaggtaaggtcatgctggacattaaaatagatattaaagcttatatatgtgtaatacatataagctttagagccagatacacatgggcatgagtcccatctttgctctgggcaaattatttcacctcagaatcaattaggatgtagtaagttgaaagtaacataaaatttaaccatgacatgaaccataagtatatttatttatgtaatgaagtctggagacaggcaacctttttgcttgttgggcagatcagcaatgttatcaaggactcagcctcttttcatccttcatattggacatcttgctgttttgttctcattgtggcctcatgattgcaaaactcaaagcatcatatctccatacaatagtcaaagtcaggaatcaggggcaaggtcaaaatagcttgccttttgtagggaagaagtcttttcccagaagctgtccaacagatttttccttatatcttatggtccagaactgggtgatgtagctatctttagctggaatagagactgggaaataagtatctggccaatgagaatgggattgtgtgattaagaccaatcaagaatccgttctggaggctagtcttcatgccacctagaatgaaatcagtgtttttatagtaaggaagaagaggggcaattgtttgaataagcagctagaagcatctgatagccttttttaaagtaacttttatttacttttaaattttactcatgaattataaacatcactgtaaataaatcattgcagaaaattaacaccatttcctcaggacatttttcttgatgtataattgccaagctaaataatgcgtacgattttaagactcttgaaatatatcagcagataacacttctgaattttgtttatactaatttctattaccattacatttattttcaacagtgcatagaattcctgttgtggccctctgttcggggtccctgacttcccacaacaaattcccatgtcccagaagcctaaacgcaaatgaataatagatattttcatgatctattaattttatgccttccttttaacagtaattactaatttatgaggactttatgagaattttggttttactttttatctatttgataggggaaatgtaccaactttactgtgtttatttgcccatttgcctttccaattttgtgatctatttctgattgtttctctttctattctttctattcattatgtattgttctttgtctactcacataaggaacctaagtagacagacatatagtagataacagagtattttaaaaatcgtttaaaatgtaagtatatttgtatttaaaaaccagaaatgcttttaaattttgtttcattttagtatcatctgttgatttgtaaatatattttccctttgatgtattaatttgatgacatgtattaataaattcctaaaatttaaatatcctgcattcccagtataaaccattcttgattatagttttaaggtaaatacccttttatgttgtataagttagtattttaactaaaacaaataattattattgtaacactatcagcatcaaaattttggatcagcattgtgctaccatggcaaaatcaagaatatcaatgttttctggctataaaagtggttaatagcaaaagaaattttgcaccttaatgatttgaaagaacttcctttgcctcctaattatgaaggagaattctcaataaatttttaatgataatttgctccttaatttattaaaaattattcatttatttaatttttattgagtacaatttgatagtctttggttttatttcactatgccaatccctgtcttttaattggcttacttagaacatttatgtttaaataatctttgatattttaagatttaaacctaacattttattctttttgtgtttgttttctctgtttcttttgtccctctatttgtcttttcttgccttcctgtgggttccatgaacattttatttaggattccatcatgatttatttgtagtgtttttgagtgtgtctctttgtatcatttttttagaggtggttctgagtattacatgaaaaactaacacgttactttttcaatgtcagctggtatcaacattttgccatttcaagtgaagtattgaaatatctgttccatttagattcctttactttccccacttttaaatatcattgtcacgaatatcagatataatttttgttaaatttgttttagtcatctactatgatttataaaatgtatgaagagaaagatagtacattttatacaaccatattttttctttcccagtgttccttccttcctgatgctccaagatttcttcttttatcacttccactctttcttaaatcatttcatttgtgttttatgaactctctttagaattatttaagggtaggcctactagcaactcattctgttagttttcctttgcctgagaatgtttttatgtcccttcatttctggggatactttcactggatataaatttgcagttgacagtttttttatttcagtacttgaaaaatgtaatacttccttcttggcttccatggcttctgacagaaacccactgtcgtatcatttgaatgggtgtttttctataggtaatgccatttattcttggctattttcaatatattttttttagttttcagaagttttattatgatgtgtattggtgtgcattactttggatttttttctgtttgggatctgttcatcctctttaacttgtaggtcttttaccaaatttgtgaagttttcttccaatttgtttgaaaatatttttagataaacatttaaaaaattttcttttcataagattctgacaatatgatttttctatattttgttatagtctcataggttcttgaggctttgttcattttattttgtcattttctccctgttgttcatattgcataaattctgttgttctgtcctcaagttcactgattctatcatctgtctcttctctactactaagcccatccagtgaatttttaaaatttctgtcattttatttttaataattaccatctgtttatttaaaaaaaacttctgtttctttgatgagattttctatttttaagagaattttaaattgttttttaaaacatttttattatgggtgctttagaatccttgttcaatcattccaacatctgctttatctaagagttgctgtcagttaattgacttttctcattcatgttgtgattttccttattcttattatcatgggtggtttttcgttgtgttctggacattttgtcaattatgtcaggagactcagggtcctatttaaacttttactttagcaggcagtcatctgtttatgtttagcatacaggttttggcctacgtttgtgagctgcagttctaaaggctatttaatttccagaacctttgtagtgtgatttttggtctgcggggtttatcttgtgctgcctcaggtatagacgatttcctgggccaggtcacttggtccatttaggtcggcataaagaagtgtctgagttgtagagtcaaagaacatttcccatgctcgaccacttgttattagtaggataccacttgccagtataccccagccacctgttcctatgtgggggaaaataatctcagacccacaggacaaagaagcatttgagctggttacttatggtggaatctcaagtgccccctgcagcctattgtctctagttgtgtgtggggaatcgcaggcccatggggaagaggcttctcaggccaacaatttgtgcctcaattttgcttatttgtgaaacatggattatattgcacccttataaggttttatgatgaataaacaagtatataaattcatgagtgtgtggatttttgtctgattgattcaattatttagtcacaatattcagaatagcatcctcatgcattgtagttgcttcaaaaatgttttctgagttaaccaataaaatgaaagggagtgctaaccaattaatcaatcaatcaatcactcaacttattggttaactttcaataaatgctagcttgcttttgtcattcccttctctagcaagtgagtaagtgaggagtcaggcacatatcttctgattccagtgctatagatagaataaaaacttgctttccagaagaacaatacctaatgttcatctgttcattgaaggattactatgttctaggcatggtgacaagcactacacacaacccacacacagagctatatatgtatctgtgtgtgtgtgtgtgtgtgtgtgtgtgtgtgtgtgtgtgtgtttgtgtatctggttaagagacatcctttatctaaataagagctgtttgtgtttctttttctgtgaatatatgtttagtttctcataaggtggttgtcgttaatttatactagttctgtgttatcggaatataaatctttagtctgtgatatggtgtacatctttttactagttcattatttgtcttctaattttgcttatgaatcttttaccctgaaactttttaaaatttttatgtaattatatctatctttcctttactgcttctggacttcgtgttgcagttagagaaaatttctccactcccagattaaagaggaatttatttatattttgttttggtactttttggttttaatttttatctataaatttctgatctattttggtgtatagtgtgaggaatgtatcaaattttatcatttttcacattgtcattcggttatccaacataacctatttaaaaagccagctattctccattgctttgggatattccttttgttcatttggtcagctcatgtaatcttaacaaatctataagttggatagcattatttccaattggattgacaagaaaattcaggcccaatgacttgcccaaggtcacatcgctggtcagtagtaaaagtgggagttaaagataggtcttcattaccttggatcagggattttcatcactacattatatttcctaataatttgacccccagctcactgttttaagcagatatggaagctatcaccattccagtggtgcacataaggtagcagagattccaagaaaccctttaacttttcaagaaacttagagcatgagtaaaatgactactgcccatgtcagatcccattggtagatgggatcattgtgagtgaggctgcaaggcattgagtaaagcctgagtgggcaaacatggggcagaatggaaggagtatttcgagcctgcctgatgctcactttttccaactcctgggaaagtataacttaaatgttagttcaggtaatattaactgctgtaacaaatactaaagtttggtgacataagaggttaagggtttattcctgaatgtgactccaatccatgttggggagtaggaagattcttctcagccattcaggaagccaggcttatgggagctctgtgttttttaagcagccttattaaaatacagttcacataccagtcaattcacccatttaggtttacaattcatggtttttggtatactgcattatgatttttaagattgtggtaaaatatgtaatctcaaatttgctgtattagacattgtaagtgtataattcagcagcattaatcacattcacaatgttatgcaaccgtcacccctttatttctaagactttttattaccccaaatacagtctctgtatgccttaagcaataactcccaatttccccctccccaaagtgcctgatagcctctactctctgtctctacaaattttgctattctagatatttcatgtaagtggaatcatattttttcatgcagtcacctttaccagagatatttactctttgcatggctttgggttactctccattgtctgttcatttcagcctgaaggactctcttcttgtagtcaggtcaaatgatatcaatcagctgttgtttgtctagggatgttttaattattcctttatttttgaagaacttttttctgtatatagagttcttggttaacagtttatttgtttaggcacttatatgtcatctcactgactttaagtctctgcactttgtgatgagaaatatgctttgaatcttatcgagaatacctttacttgacaagtaatttcactcttgattttcaatattttctctttgttttcagctataaacattttttgatagtgtatctcagcataggtctctttatgtttactctgcttggagtttcttgagcatcttggatgggttaatttatgtctttcatcagatttgagaagttttaagccattatttcttcaaatattcattctcgtcccccatctccctgttttttctgtgaatcccataatgcatatattggtcacctgcatgatgttccacaagttccttatgttctgtttactttcttctcctcagacttgataatttaaattgtcctacattcaggtttgctcattctttcttttacctactcaaattctctagtgaagttttcatttcatttatcttactttttagctccagtattcatgtttggttccattttacaatttttcttaaccaatattctcactttgtttatacatttgtttcctgatttcttttagttctttgtccatgtgtgtctttgagcaaatttaagacagttcttttagtctttgtctactaagtgcaatgtctgggcttcctcaagaatagtctcaattctttctttttcttgttcctttgaatgggccacacttgcctgtttctttttacactgtgtgatttatttttttgttgttaaaaactgggcagttttgtattgtaatgaagtaactctggtagtcagatttcccctcttcctgttttacttttggttttggttttgtttgtttgttttctagatttgtgttgttgaaggctatagtagtccatctgttgttgttattattatcattattgttattattattattttgtttgggactgggtattgctctgtcaccccaactggagtgtagtgtcatggttattgctgacttcagcctccacttcccgggctctagcgatcctcccatctcagccacctgagtagctgggaccacaggtgcatgccaccattcccaactaatttttgtatttttggcaacaaggctttgccgtgttgcctaggctagcactccatttgtttaggtgtttttccaaactatttttgtagagactattttttgtcatgtatcgccattgaaacctatgttaatttagctcatgttcagctaatgtttggacagcaatttcattgaatgctaaaagttaaaaaatgacaacaacaaccaaaagaaaaaatagtcacacattactctcacatttttagattggctctgtgctggggaactacttaaacagttagccagatgtgcacttagcttagggatcagcctgacatgtaagctttaggtctccactagtattttctgagcatgtgtcttgtatgcacacacctttctaaattcctccatgtggatacttttgaatgtacttatttctaaaggaacctcccccagcttttgctcccagattcagacagtctgttttatgtcttaatccataatcattgccctaggtattgtggtttgttagtttgccttgcaacattttgaaacagtgcccatcacttttccaatctgcattctcaatcgagtggaacatacataaataccttgtatcagtccttcaaatagccctcaaataggttaggacagacatacacagtaatttgtcaataagttttgcttagctcactctggaatcaggtactgaggtctcacactaggaatacaggctgaggctactttaagacttccactactttaggactgccactgctctggggtgagggatgtaacaagtacaagtaaaaatagcagaaaactttcctattattttcaagtgacctttttcttgatttaacatttacatggttgatgtaagcctttgaatgttttccagagttctgacaacattgattatgacagttcctgcttgtttttctatgtttctgtaggggcataagagcttgaagctgcctactcctccattttatctggcttccgctatcattcttaatatatttattccaaggtttccaggggtgtcagcatgcactggaaaatgaatgtatgaagaaaatttaagtatcacacaggacatgtttttgagtcaagcctgggaatggcaaacaatattagtatccatatttcattggctagaaatgatgcacatgcccccacttcattgcagtggggttaaagaattttggctaatggtgttcccaggagaaataaagaataggttaagtgaacaaccagccagcttctgctacaactagcatacaattaatatgctttcacaactagaattgtttctttgagaaagagctgtgactggtatcaggcaggagccttgttcctgttgaagttaggctgtcagatctaagaatctctagagagcatttatttcaatttcctcagtgttgggacttctgatgcccagaaactgggggtcggggggaaggaatatggccaaagttagtaccagagctgagacaagagccagctagagtgtttgcctctcatctataccattggcattcaaacattttttaccatgacctagagtaagaaataactttttatcacaacccaatatatactttcatgcattttatctgtaaaacttttataaaacagtacttatgtgggtagtgcttatgactatttgtcaaatatttcagctccccacattctgtcacattgtagaattgcattttcttgtacctgttgtagttattaatgatcatgtgatgtgtatggccaaggacatgtgagtaaagcaatatgggtcatttcttggggaaaactttaagagcttgtacgcagttcacaatgtttcaatcataaaagcagaaaaataaagcttctgtaaccccgggtaccccattgaggatgatgtacagcagagtcctcaggaaccccctggtaggcaaatatgatgagtgagaaataaacttttattcttttaagacactgagatttagggtttgacttttgccatactgcagcatagcctatgctgactgatacaaatacttagctttacttcattccatgtactcttatatttgatactattattctatttcattctattttatctttcaatgctggctggaagctagtgaattggttttatgacttagtaatggggttgcaagttgcaaaatactaccctgtacagtccacttgtcccacaggtgatcccatctccaagctcctataaagcaatattaacaacccccatctgtctacaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggtgagcttgctttatgagaccaagcttgtctgggcttttctagctgttggaggtttctcccatcctcacctctcagaacttagtcgaaatattcttcttataaacataatattcagtttaagctcccagaagagagaagtggtgtcttcccaagatacctctataaagtgcttagcacattgtcagtcacagatgagtacttgaccgcttttccatcatcactctcagctgaagaccaaagttcaaggtaaatctcactgtagacttaaaagaagttatgatgtacttggtatcaaagcagtgcacccctctcttgtggaattaggtctccttttggctacatggtgtcatgaatgggggaagaagtagagtgtctgggtctctgagtcagaaaaagacacagaggcagataactcagaaagaggggtgggcacttactttcaggttggcaagattcttaggagctgctttcccaggaagaactggtccaagtgcattgcttgtttgatcaccctgccattcctaattgctctgaacacaggttctaccgaaagacacgcattggaggcctgcaggaccaagagtgcatcccgtgcacgaagcagacccccacctctgaggttcaatgtgtgtacccagttctcttcttccctttctcctcatcccattgggtggcagcaagatagggtagtaaagactacccatatcccctcataccttttcatgtagagtagagtggcaagggaatcagattagaagtctggttttacaacatattatctttgcaactctatgcaaatcattcaatctcattgaacctcatttcctacttctgaaaaaagggtgagtcatgataatcatttttcttcataccttgtgtgatgggtatctaggtctaatgagaaaatggatgttaggaagcacttcacaaattataatatttgtaaacctatgagatattattattatatgaagtatataggagcccctagggctgaggacttgtaagaggctgaatgaagaactagggtccaatctatgcctataccactatccatttatctaatcgtctatcttttttgtctaccatctatttacttacttcctattttaaaattattgacatattttttaaatcatgaaagttttcaaacatgtagaaatatttttaagtgcagaaaaatataaaattaaaatgcaatcacccagcatctatccaaagttaataaatcatagcattttgcatatttgcttcagatgttttaaaagaataaagattccacagatataatggaattctcttctagattctctcagagtcctattacctccctacctcctcagatacaaccactatcctgaaattgtatgtattctgttggtaggctatgctaaagtaacaaacaaactgcaaaatctcagtgactttatacaataaaagtttattttttttttactatgcaaaggccttcctacatcatttgactgtgcattctagaccatatgtcttccaggtcaatgacacaggggaagagatggaggagacatactggttcttaactgcctcagtctggaagtgacacatgttatttcaactcacagttcattggccagaagtactctgatggccttactgcaagggtgtaagggaaatacatgggagtatgtggataactggtgagcactatacctctgccatactctccactaatgttttaatacttgggttcttttgtgatatgtgtgcatattcataaccaatatatgctattgttatgtattgtataatgttttatagaaatgatatcaagctatatgttctgtttctccaacttcctttttccccctctagattatttatattgatccataaaggcctttaagtgctgtataataatgtaagattttaggattatatcatgatttgtttatcttgtgctctactgatgaattttttagcttgtttccattgatctggattatataattagatgtggcacagaaagatcacaggatatgtgcatcttcgattaattgtactaatttctacataccagcactatatacaaattattttgccttgttctttataattttgcctgctctagaaagaagtaaaaccagcatagccaccctaattggggaaggccctagggagaagggtgacagcctgaggaagtccaggtccagggtcagggtgactgtttactgcccatgctaactgacctcccccatttttttgtctcacaggtgccttccagttgagcttagtggaggcagatgcacccacagtgccccctcaggaggccacacttgttgcactggtgagcagcctgctagtggtgtttaccctggccttcctggggctcttcttcctctactgcaagcagttcttcaacagacattgccagcgtggtaagggtggctgtttcatgtttcacatgaatcaggaacaaggctcttattggcagaagagagggatgttctggggttgagagacaatgggccttttctaccatgcttgaaaaccccatgaatagtcttctgttggcctggggaactatctggggctgcaatggaaagcatgggacttaagagattactgaagccaaccctgagagtttagaagacctggttcattatgtttcaggggattttaaaggaatgtggcacggtgggaaacccctcaggaaaggaatcgggagacctaggttctatgtctacctctaaatcaccgtgtaaccttagacaagtcatctagcctcttcagacctctttcttcctaatctttaagataagagataggattggatttgttgatttctgggttcttttccaattctttatatctatactagtaggtataaattctagagcatgtcatgaattgaggaaggcttggctatatctgagatacgactgtaataaaagtggttgaggtctaaggccactgctatcagtataataacttcacaaatggggataactgaaagccctatgtccagagtagttggcaaacctggactttctccctcagataatactgatgtcaagaggtctagcccagtccatatcagacagccatgcaaaattccagatggaaaatcatatttaaagtcacagtaacattgtgatctctattaagcacaacttcagctactagacaagaatgtgggacagaaaagccagctcactgaggacaaagatgggggaggtgggaatgtggctgatcaggaccaggcaaagagttagaactccagccaagagtaccaaggttcagtgcagcttcattgccattaagggaactgagagttaggcagggacactgaaacaggaactcagatcagagaatgaagttgatttataagggggaagataaagtttactagataaaagagtgctcaggactccttttcagcccactggatactgtgtgcaaagctgcagtatttgtgtgggaagatcctgctaatgtaaatttgccttgggtcagtttggctctggggcctagcagatgatcttgaaaagcccaagaggtatgtttggttgtgccctggcttaattggagatgaatatagcatttcatgggctgcaggatacacggggaacactgttgttcctttatgatttttctcaaagtctacttcttgctagctcctgggacactgtgactcaaggtagaccttcctgtctctgactttggaggccagtgtcccagataagagttgttgcttaggccctgggtgcatggacatgaaacatgagcaatgaagcatttggactccagggtccagaagatgaaaatgagaaaatatcagagagctgcctcagaagaagagagatgggtaacccttttctgctctccttctatcctgaagataataatgtggtaacctgcttggaatatgagggcaggcagtttcctcactgtttttataagggctaggaaggctagacattttcttactttggaaaactgtttttcaggagtcactgacttacacacatactggggtgagatgtatgtgcgaattaaatccagtgtaaggttgcaagagagaaaagtgcaactgtggcaaactacagagcacatcccttatctaaaggggaatcccactacttggatccagctgtttgtaaccatatggaaatatttaatgttgcaagatcttctacattttcaagagaattcagaaatctggattttttttaatgaagttgtgttaaccatagtcaatgaatttgaataaagagcaaaatcacaaccaaagcaaagaggacaaacacaaatcccataggttctcagtttgtgacctgatgttgaaccagatccatgcatgaagggggtattacttttctatcatggccataacaaattgccacacatttagtagcttattatcacagtttccatagctcagaagttcagtaggctcaattttgtctctgcttagagtctcacaatgccaaaattaagatattggcagggctgtgtttctttctggagtctctgggagagaatctgcttgatcatgcacaaaagtggcagaattcaggtctatgcagttaaaggacttaggtcccatttccttgctggctgtaagctgaaggtcattcctagcctctaggaccacttacattctttggctcatggcccccttctattttcaaaactagcaatgatgagttgagttcttctcatgccacatctctctgatactctctgtctcctctgccttcctcttctgcttttagggacacaggattacattggacccatagagtaatccaggattctctccttattttgaaatccataactttaattccatctgcagagtctagtttgccatgtaacttaatgtacatagacataagaccaggccatgaagattatggcaagggagatggtatcaaaatcctgtttcccacaaaggtttctttttctctagagaaattgattattttctctgatccagtaccagctagcctcaatctgatacctgaatgtaagtatgtttctcaactgtgtcacctcagcctggtgctaggtgctctagaccccagggagaggaaggaaagaatcagctcccagacctttacctgtcttgtactcagtacccagtgcccagctgagaagagcccctgcttttgggtaacccagtggctttctgcttcgagttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtgagctggaaaggtggatcagaaaaaaacaaaaaaagcaaaacagaaattaaggactaacctcaaggaattctcttttggaatagtattattcactaggagtggaggaacagcagcaagctaggaacactttgggtggaggggcaacagtggtgatgctaaacttttaagccagacagatatcacacttctgggtctacaattgtcagggaactggcaaggttgtcatgataccagtctctccattctggtctttcgtaagctctctcagggccccactatctaatggtcatattcaggtatctccctttatgtgtgcaagcagcatagcacagtagaaaaagatatacaagccttgtcatctggaaaccctacatttcaaatcaaccttcattccctaataactatacaaaccttgtgtgtatgtcacttcattttacattttacagaggcaggaactgagacacagagagggaaagttagtttctcaaagtcacagggcaaattagtgggctagaactgtgcaagaacccaggtttgggggctacattttagagttggttcaactccaccattgcaaccatttgatagccaatgttactttctcaaagcttatgtagcatgaggtaggagagtaggtagattcccagttttcaactaaccaaatatcttgcagtgcccacttccgtatttcttcagttaatacattttcagttctcccaatgacttccctgctccctgcatccaacctaagaaaacgtgaacaaatgtatatttgaaagtcataactgatatcaaatttgaaagttataactgatgtcaaatcaatcaacttaggtaccttcaaggttatctagtccagttcttcttccaaggtttgggtccattttataatatccccactaagagtttgtgtagtccttgctcacatactttaggtggcagagggctgactacttctcaatgtatattacagtatacacaattgtgactggtgggtttgagctcaatgtaagaaagagctttccctgtagtacccgcctatccatcctggctctgttcctcgtgccagacagacctcatcagtttcctctgctttaagatagccctgcagaggcttgaagacaacaccacctctctggagaataccactttaggttcttctaaagtatgtggagcttagaactaaacctatcttcaggataaatggtttcaacaatgtagaatagggtagaattgtcatatccctatctaggtaatgtctttctgctattacatcctcaaccattggcttaacctatgatatttggaggggtagagaaagaagggtgctagtgagatttccccacatgtttctaacttggtttgctctctccttaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttga

SEQ ID NO: 17053 - DNA, 76221 bp, Human; identical to SEQ ID NO: 12009

SEQ ID NO: 17054 - DNA, 28696 bp, Human
  misc_feature (1)...(28696): n = A,T,C or G
atgcgccaccaaacctggctaatttttaaattatttgtagaaacggagtttcgcccgttgcctgggctggtcttaaattcctgggctcaagcgttcctcctgcctcggcctcccaaagtgctgagattacaggcatgagttaccgtgcccagctagataactcgattttttaaatccaaaaaaaatttagaaattttatattgaaatttaggcattagaattctagagattaaagttagagcaggtgtttaagggactgaaaggggttgcatggcctttgggaaatgcaattaccggaaatgatactgtagtaatgcaatagtaatgcagtagtagtagtagctgcagcaacaactgttatctatgaatgtttgctatgtgccaggctctgtgctaagagagctttgcaagcattactactgcatgaagtaggcactattatggccattttactgatgaggaaattgaggtgaacagattaaataattttacccaactttacacagaaccattccagagcacgagccataaacacatctttcccgtcttggaaattaaattattaataaaaaacgtggtgcaaattggaaagaggacggttgtggtagattatcacaaagttaagtgggtaggtggttgctgggtcagggtgggagaacaaaggcagctgtaataaaaaaaaaaattaaaggcatataaagaaaaaggctggttgagaacaatttgcataaactgattttggccttagaccctattcacttctccctcaccagtcactttgcaactgtggagcatagtattctgagggtcccctgcacataacaacccctttcatagcatacaagataaaaagaagaatcaggctgcaaagagagaagcactgaaggaaagaacatctcaggttgaaagaagggcaagtccagggtgcatgtgaggaacaaatgcatggacacggtgaagtgccacttcttcatttctagttcaacacaattcaattaaaaattactgggaggaggctacgtcttgaattaaactcagcattccacatctttgaggtggcggaatgactgaggggagggggtctgtctagccacatccaaatcttcctgagacagagggagatccctcatttgttgcagtgtattttccttggtcgcatctgacacaggggttctgtgggttgaacagaaagggactttgctggaggggaggcactctgcatagaaggaaagtagggacatctggcagaagcaggcgctccgagaataaacagtcaaagcagctcgcaatagtcccaaaaagctacccctcaccgaacctggcgtgcctgtcgccgcttgccccgctcccagggctcattggctcccagtctcgacgtcagacccgtagcctctcacctattgggccagccaggaccggagtgcagaagcgagggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggtgagtgtgtgcggttcgcgcgtgcctgggaggggctttcctctccctacccccatcccgaccccagccctagcctctggggcattgtctgcccttcgccgtcggccctccgcctagccgcgcacttcccgccctcccaccttcctttcgcccttccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatcccagttcacctggtatccagctccagcaacttagagcgtttcacgtcacgccgggcgccaggcgtcggcttgtataacctgaaaacgctcctgtttttctcatctgtgcagtgggtatgatttttttttcatcaacaaatttcacgtgggtaatctgaaatgaaaccacttaagttatgaaactctttccttttgagttattctggagaccttactccgccttcggaaccgccccagtggtgtcacatacttgagggcctgactctcggttgccagacatggcacagaatgttcgattttactaccagctctcacactccgcttctgtttccccttctcttacgggccgctgctcaaacctttatttatcaaatttaagtgagttcaggtaaattttattttgggagctttgtaatattttctaacccacttcagagagttatagtttgaggatattctggactgtactagatcatatggttttcaaattttggtatgaaaagattcgtaaatagagttttagaaatacagcacctgtttagtatgtaccgaacatagattttggctttgcttgttttgtgaattgtgatgtattgaggctacttgaaaggacctctagcagtttaccgagaatttcaacaagaaaagatataatacatttgatctatcagtttctaatgtagcattctttttttaattgtattttttttccgttaacatggcagagctctcattcttgatttcctagagttgtcatttcttcaaaaagccttaatgaggatacattgcctcatagttttgaatctcattctgatatacctcaaatttttgtctttgtaatttttaaggaaatttaatgttaagattagattatattaacattgttccgttctagaaagtgttttaaagcaactaaagtgtaaagtagcgtaagatacttatcaaattggtgatctagagggcatttcaaaaatcgcactgaggcaatgtgcacacaattaaaaggtttcttaagtaggatatgatgtagggagagccttgggctttcgggtcagtccctttaaatcctgggtaagtgaatctaagtctgtcaacctcatctattaaacgggagtagtgaaaaacctacctcttttggttgtccttaggattccagtgaggtgatcgaacattgtcttgagcgttcaagtgctcaaggaatgttagtttccttccattcaacaaatatttgagtacctactatgtgcccggctttgactgagacctataaataccagaatgagcaagactgatggacgtcctgcctccttagtttcttgcattcctcagggataagtttatgggcaagctcatgacaactgggagtgaacgcagagtttccccatgcggagttggtagtatttcccagcttccaaatccaaagtagcgactgaaacatagtaggtgctaatatatattcatttagatgaatagggacattaagtaaatacaggtctcaaaggatattcctgcctgccagtcagtgtgattgataaaatcaaagtgtggcttgatcgcattttccctattttagtgcaactggttggaaaatttatcttggaagtggtagtatcactgaattattaagaatgttccttgttcatgagatgttcttggcttttgaattaaatatacctaggtttgaatggagtcactggatgtgcttactctgtgtttaattcaatgaaacaaggacaatagtatctatgtcataagatggctttttgagttgtgtgttaacattttgatagtgcatggttcatagtagacagtcaatgagtatcagttctcctcttttattaatcacaaaaggaagttttctgcagaatgaggatattcttgattgctagggagagaattctattctgtaatcactaaaagacccagtttctattttttattgggaaaaaaaaaacaacctttaaattttacctccagttagcattgaagttattcaagttggcaaatatttataaaacaatgacactaacaatatttggaaaggtgatggctgtggttactagggcagtttatgaaatttattctcaacttttattcatgtatatcctaaaactgacagtcccaaatggtaaatatcatttttcttcacaacatactgatagagtatctccttgattctatttccttccctgccaagtaccacacgttctgtagtctcttttctggctcttttttcttataatttttcagaaaatttaggctaattttcatttgagaaagttttcttttgattgagagttttgttcttgacaaatcagctttaaatgaagtgattgttcaccatcataatttttcagatcattctactcataatgaagcaatcaaacttttttttcaagtcttactttgcaaatggtaactgaaggtaccaaatgaataaaatactctagagaagggttgtacagggcaaagtaaggtatagaaataaccataatacaaaataaaaaatgttgtttcttgggaagagtaaaatactagaattaagaagactttacagtactccagcaagaggtagtaaaggcttatgctagatagattacagtggaaataggaaagaatatgggcagtactgggaaattgaatagggtctttttggcaattaggtgtaaggagaaagaaaggaggagtcagcattgttgcatgatttgaacttgagtaaaccactggttgggatgtttttgacagaagtatttaaataactcgagtacaatttttaatattctggttctttttttttttttttttttttttttttttttaacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctagaaatagaaaagactagtgtgcgttttgcctttccttagaagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaatagcttgaacccaggagacagaggttgcagtgagccaagattgtactgctacactccagcctgggtgacacagcaagactctatctcaattaaaaaaaaaaaaaaaaaaagtatgttatagtacagggatggtgtatttatccaggatgattttactccttatgtttctaaatgttattgcttatcttatgctcatgtaaggtaattaaaaaactaattaacatttcaattttaaaaaggtatatagctgtccctttaatgtggtcacatgataattattacttaagttaggttttatccgcttttaagtaagtatgtgtagaactgaagtccaaatatactgcttgtgcttttttattctgggaaaaaaaactatcaaattactgtatgttttttctttttgttttaagaagtcagcactctaaataattgtattaatcaagtgttgtgattgtttctaaaggtgttactaatggattgagaggccagtctgttttagttgtgattttgttattacctggttgtttcaccttgagcagaaccgttaacttcagtgtatcttagtttcctcatttagaaaatttaagaagttggatgacgtattctccagctgttccaatgacaggaatcatgattctgaatacatagtaattctcctcctttgacaaagagaaggcaaggaaaagctaagacatgagattccattatcagtaatgttattcctgtaagtgtgtgcacatatgcacacacatatgtatgtttgcctgtgtatttcttgtgacttgatttaacatgtggtctgttctacctctcaacagtggaaaaatgactatctctaatggattaacagatttttttccctctttcgtgtgtattttgaggctcttagtcgggacattgtcatagttacttaagttttcaactttaacttgtgccaaaactcatcttaagaaatttttaaaattaaatagtgattattagggtaaatatatgcagtacatatatagtatacaatatatgcaatacatatatagtataggtgactaagatgtataagaaaaatttggaaattaagaaccatgtttaaaaaggatacagaccgggcgtggtggcccacacctgtaatttcagcactttgggaggctgagggggtggatcacttgaggtcaagagctcgagattagcctggccaacatgctgaaaccctgtctgtactaaaaatacaaaaattaacctggtgtggtggcaggcacctgtggtcccagctactcaggaggctgagacaggagaattgcttgaacccgggaagcggaagttgcggtgagctgagattgcaccatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaggctaccaaaataatgccagttttaccttttttttttttgaaacggagtctcactgtgttgcccaggctggagtgcagtcatgtgatctcagctcaccgcaacctccacctcccaggttcaagtgattgtcgtgcctcagcctcctgagtagctggaactacaggcatgtgccaccgcacctggctaatttttgtattattagtagacgcgggatttcaccatattggccaggctggtctcgaactcctgacctcgtgatctgcccgcctcagcctcccaaagcgctgggactacagacgtgagccaccgcgcccagcatagttttatcatttttagaatctttattcctatcattgctatggctgtagttttcaattcctatatcatctctttcataaagacatatatcttgttatttaatcatagggaggcagtatgagtgtgatatttaaggactgagacactacaaccagactctttgggttcaaattccagttctataacttatcagttctgtatctttggcagcttacttaaccccgctgtgccttagttttcttatctgaagtagagacaaaatagtacttgcttcaagtccttcccagggttgttgtgagcattgaatgagtattacatgttaatcactaagaagaatgctttttatgaaatataaagtaagctattacagtatattgaaatgctattgtgaaatcagatttctgtttttagagaagttctgaaataatgtttcttttcactaattgtcctagtttcctaatggaagttggctttctagaaagtaacaaataattgatacaagattatgatggtgttaatgagtttttaaaacagtattctaaccagaatatgaacactgttctaatttaagtgacataatattgttcaaaaatgtcttcgtgtagattgttttaacagctcttttgagctctaattgaaatgcaataaactgtatataattaaagtatacaatttgattagttttgatgaatatatatacactcacctatgaaaccaccacaactgaagccgtaagtatatccattacctccaaaagtttcgtcatgtctgtcagtgatccttccttcccacttctccctgcctcattacaaggcactgctgatattttctgtcactctatatttgtttataatttctcgagcaaccttgtccagtctgctgcctgtgggcctcatatagcccaggatggctttgactgcagcccaatgcaaattagtaaactttcttaaaacattatgagatttttttgcaatttttttaggcttatcagctctggttagtgttagtgtattttatgtgtggcccaagataattctttttccagtgtggcccagggaagccaaaagattggacacccctgttctagagcttaaaaaatactatatatggaatcatacagtgtatatttttttggtggtctgactcttttcattcagtataattattctgagatatagtcatgctattacttgtaacaatagttcattcctttttattgctgagtagtaagtagtctgttgtatttatatactacaatttgtttgtccactcacctgttgatatacatttgtgttgtttccagtttggagctattaaataaaaataaagctgcaattcaaatacaagtcttttatttatttatttatttcaattttttttttgagacggagtcctgctctgtcaccaggctgaagtgcagtagctcaatctcagctcactgcaacctccgcatcctgcattcaagctattctcctgcctcagccttcaaatacaagtctttatatggctatatacttttctttatcttgggtagattactaggagtagaatggctgggtcatatggtagatgtttgttaaactttgtaagaaactaccaaattgtttttcaaagtggttgtacattttactttcccaccaccaaagtgtgagcgtgccagttgttccaaatcctcaccagtacttgctatggtcattatgtttagtttgaatcatcccagtaggtatgtaataatttctcactgtggctttaatttgcatttttctaatgattaaagatgttgactatcatttaatctacttatttaccattgtatatgttctttttttttttttcgagatggagtctcactctgttgcccaggctggagtgcagtggcgtgatctcggcttacttcaagctctgcctttcaggttcacgccattctcctgcctcagcctcctgagtagctgggactacaggtgcccgcgaccatgcccggctaattttttgtatttttagtagagacagggtttcaccgtgttggccaggatggtcttgatctcctgacctcgtgatccgcccgcctcggcctcccaaagtgctgggattacaggtgtgagccaccacgcctggccttgtatatgttttttgatgaaatgtctagttagaccttttgctcgtttttaaattgagtttttaaaaattatttttgaattttgagaggttcttatatattctgggtttaagtcccttattagacatatgctttgcaaggatttttctctcagtctgtgatttgtcttttcattccattaatagtgtttttgaattgtagtttttaattttgataaaatccaatttactaatcttttattttatggattgtgcttttgttgtactacctaaaaatctttgcctaacccagggtcacaaagttgtgttgtttttttttcttgcaaattttgtagtttcagactacatttaggtctataatctatttttaattacttttaactggtgccagatatatatagaaggtttttgttttgattttttccatatggatatggatatccagtttaaccagcactttttttttcttaataactattcttttctctctgaattacctttgcatctttatcagatttcagtttttgtatatacgtgggtctattcctttactttccattgatctattcgtgtattttgattccaatactacacagttttgattactgaagctttataacaagtcttgaaaccagatagtgctagctgttttaccttgttctttttcaatgttgttttggctgttatatacgttctttgcatttccatatgaactttagaaattagcttgtcaagttttaaagaaaaaacctgcccagattttggttgagattgcctggaatctataactcattttgggaaatgttgatatcttaataaaaatattctgtctctgaaaaagtctttttaaattaataggccttttaactgtctcagcaatatttgatagttttcagtagtcaagtccttaattagatttgtcctcaagtatcatttttttatgcctatataaatttttttaacgtttcaatttcttattgattgttgttaacgtatagaaatacaattaatggtagatcccgttgaattttccacatagaatatcacacttttatttctgcctttccattctggatgccttttatttcttttctatttttttcttttttctttttttttttttttttgctggattgcattggccagaacttccactacgatgttgactaaaagtagaaaaagcagacatgcttgtgttgttcatgatcttagggagaaattatcaaatttttttaccattaagtctcatattactgtaggtttttcatagatgtttttgatcaggttgagaaagttcccttatactttgctgcaatttttttttttaacaggaatggatgttgagttttgtcaaaggctttttctgtctctattgagatgtttatatggttttttgtttttagtttgctaatatagtgaatgacatttgatttttaaatgttaaaccaatccaacatttccaaactaagcaccagtttttcacaatgtagtatccatttatatattgttggatttaatttactaatatttggctaaggagatttgtgtctagattcatagaatattaatagttttcttttctagtaatatctttggattagtatcagtgtaatactggcctcaaataatgagttggggaaatattccttcttcagttttttggcagtttgtatagaattggtattattccttcctaagtgttttgtagaatttaccagtgaagccatctgtgtctgggagatttttataactacaaatataatttctttaatagatatatagattttcaggttgttcttcttatgctttagtaatttgtgtctttcagggaagttgtccatttcatctcacttgtcaagtaaatacaggcacaaaggtgtttgtaatagttcttcagtatccttttaatatctgcagactctaacaatgttatctgtcttgtttatgatattggcaaaagtctgttattaaggacacgtgttttagattgttatgtactttttattaattgacccctttatcactgtgaaatgaccacttttatacctggtaatgttatttttcctataatctgtctaacattgaaatagtcacttcacctttcttttgattagtgctagcatagtatattttctcctatccttttacttttaacctatttgtgtctttttatttaaaatgcatttctcattggcaacatggagtggggcggtctttctttcttattcaatctaacaatctctgcttttcaattggaatgctatacaatttgcatttaatgagattattgatatggttagatttacgtctgtcatcttatttgtttttggcttgtcccatgtgttatttgttctcttttctttgtttcctgctgccttttcaattgagtagtttttatctccctgcttgtcttattggttatgaccagtccttgcccctcagaatatatgatttaatggacttactagaggtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcaggtaaataagttttatgttcaaactaacctgtttatctcctcgctggttttggataccttcaaaacttcaaatttcgtggacaggacaggttatatttaagctgaatatcttgattgcagtatttattcattaattcctagtcatttttaaatactttttctctacttcagatctagaaaatagaggttcagttgttttgttcattcaaattcttacactttccactaaaataacatgcttaatactatttaggaatagacagaccaactttcattattataatcatcacagaactttgatgtattcgtttcattatgggaatgttttaaagtggttaggtgaaattcggaataggtatttctgtctatactacaatagtgttgtttttatatttaaaaaaaaatcctaagaaaaatcctaaaaaaaaaaaatttttttttctgtttgagtaacattctagaatatgcaggaagtcaagagcaggtaagtcatttgctttaggacatcatctgtagacttcagttccttctgttttgtcacacgatcatacccaagagctatgatgtctaaaatgtgtgctgaggcacctcagggctttacatgaaattcacagggatgccatagaatattttaaattttgcagtgaaacatagtgatagcatctgttgaatacctcaactcaaagtagttcacatttgcaacattaaatcctgcagtatttttttatgatggtgttctttaatgtttgagataagtttttgtttacttatatttttggtgacatctcattgcaaagccaggattttaggttgtaattaaaagcgagtactgcaccaaaattaatgtagaactgaaaacaagaatgatggtctccagtcttattctaaggcataagaagctgtgcagtgttcaacaggcacacaaatttcattaataagttcagtgattgtggttatttaagaataaaataaaaatattactttttctttaaatgtgtattttttacaatggctactaagcagttaggatatacttaagttttttgggtgtaactaccttattcagtggaattgttaggtgtttctgtggcctaagggtactgtgaaaaagttacttacatactaagaggagggtatagtaaaagaggaaatggacagcaatcagctctttttttaatatatatagacatgacttagaggttacacacaacaatttttgcactgcctgctttccagagcttagtcatatggccccctagctgcaaggaaggataggaactgcagtctctggctatatgaccatttgatagctgctaaattgaacttattgctaaaagtagagtggtctgggatttaaaaaaaaaaaaaatccagggtattgcaagagaacaagtgggtgaaatgatcatctctggatgatcactggggcagaagtgaagaaagaaatggaaaatttaggtggttgacttgaaatcacccaagaggataggatttgggaagtagaaaaaggagcaaactaagtgttcaaattaccagagaatgaggaagagaatggccagaaattcaccaggtaaagcaacattaaaaatgggtattaattgccagaaggcaggaagttaaaagaagcattgtgttaacagtggtgatgaaatgtagatgttttcttcttatacttctattttttaaaattttcattaaatatagattacttctaggataagaaattttcttgatgtaaaaatattaaggacattcctattggcactataaatttctgttgtaaatgtatacatatttagaattgattgtatgttcagttttaaagaaaactgaccatatgttaggataagcttctctttggtgtctgaaggaaccttagaccatgtattttaaaataccagacttggctaggcatggtagctcatgcctgtaatcccaatgctttgggaggccgagggggtaggatagcttgaggccaggagttcaagactagcctgggcaacacagcaggaccccatctctatggaaaggaaaaacacgcttgtatcataaatttcataaaggactatattacttttctattcaccctttaaacaaatatagctttgaatctgtaataaaaatagctgactttatcgttcttagttcttagttgatgctttttttttttatagattatttgaagtgaagtaaatgactaattatctctattacctgccattttttgtatgttgtgctatgtagcaggcacacactgtctagggtttttaaatatgtcacttaattaaatccaaacaaccctgcaaaagtgggtttgaatacctgcattttatagatgaggctgttgaggctgaaaagtaggtaattctaactagacataatagaagtaacattgaaaactgtggtttacacagattccacagcccatgttcttaacaactgagttatagtacgtcctgttgaatgtggtacttttcctactaatccttaaaagtaagttaccatttggttcaaactagtgatttttaaacttcttaatagttaatcttatcaagaaaccccatgtgtaaaacataaaagccaagccaccctgtttaaaacagcaaaggtggcccagaacttcacccacagaacccacagcactccaaggagcatgctctgaaaccgtcttgcatttttatttttgactttatattcctcttgagtttgtttataattctgagtcctaagccaaaaagcagttatgttgttctgtccaagatttaaaaaacattcacaggatgtctgatttatgacttttttttaccataaattagtgagtaactgttactaaaatcaataatcataaaattgagaaagatcttgttttataagccttcaattaccatacataatagtgcttttactttgcttgttttggtggttcttgaaataaattatttcatttttgtttcagatctggcagaggacggaaattaagtggagaccaaataactttgccaactacagttgattattcatcagttcctaagcaggtaggttttttttgtgtgttcttttgttttgttttgttttgaaagattgaataagtgtcctagaacaatattttaaaaactggattgcagatcattaatagaaattaatttttgttgtgttgttaaatttatctggtctgaaaattctatttggttctacattttatcttctgtttctttgttgacattttctattgtgttttcattggtttcaagtgtttgctattgtttgttggagcatttttataatagctattttaaagccttagagaattccaacatatcattttggtgttggtatctgttgattaacttgccttgcaaatttagatgtattgtttttatatgctgaataattctgggttgtttcatgaacattttgaatactatgttttgagacttcatcttatttaaatcctgtggagaagcttggtattttttatcagatgatcaatctggataggcttgggtgaaaatgtccagcccttctgtgagttgtagttttaatgtcagttcagttttcagagcatttgctttcgttttactttgttttttgttttttgatggacataatagaataaaatagaacagaatatatcagaatgtcttgtattttttgaacttttgatcaagttttgatctgtgatatgaaatgtatgttttcccgtgggttaaaaaagtttgaaaaccagtgttttagaaagcccatttttctaataaatcatcaatgatgtgttcattaagttgcccctttgtggctgataatgttgatcaattaaatttagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaagtatgttaagatttatgcttttggagattaaactactttttagattcctatagttaaaattaggtgatacaattcacatttattagaaagcctatttctttttttttttttaatactttaagttttagggtacatgtgcacaacatgcaggttagttacatatgtatacatgtgccatgttggtgtgctgcacccatcaactcgtcatttaacattaggtatgtccctaatgctatccctcccctctcccccaaccccacaacaggccccagtgtatgatgttccccttcctatgtccatgtgttctcattgttcagttcccacctatgagtgacaacatgcagtgtttggttttttgtccttgcgatagtttgctgagaatgatggtttccatcttcatccatgtccctatggaggacatgaactcatccttttttatggctgcatagtattctatggtgtatatgtgccacattttcttaatccagtctatcagcatatttctaattatcagttgtttgttttctgtcatgttaagtaagaattttatatgttcaaatgacctagacatagttctagtaagttgtaccccaagtcttttaaaattatatttatatatgtatcgaaatcctactatatgtcagattctagactccagtctctgccatggagactaaggtgaattggataagagttctaacaagtttgtacttcagtaatatctacaaactgataggtagagtttattgtttgtaaccattataaaactgatgcaggactctaagaacttaagagtaattgtgagtttgtgttagtcatccatacattatttaatcccttttgaattgaatatggaagatcatttagagatgcagggaattactggaaaaaacagaatgcttgagtattttcgtttttatttatcaaaatagtacatgtactttttttaaatcaaaaactgtagaagaacttataatgaaaagtgagacttctgacccatcactcttagccagttcttccaagaaacagccactcaataattttctgtttggatttcttcaagtgtttgtcatcgtatctatctatatggttatattgccatttcttgtttaccagtaacagacattgtccactgacattcatactatggtaaatgaagatttatttcttactaccattccctctcctttattccagtctacctcactaatcactctgctatatcagaaaaacacacttaaagttcactttcttattcaaacatagaaaatatttttatcatatatatatataaacacacacacatacacacttcataaaaattaggacattatttcacattttctaatacagttgttcctcaccttctttctctcagctgatttcagctatacatttatatttacattgtctaggttgataacatttacattctttgttgttgagttgtccaaatgtctcaatgctaaaacacattaaattgtgtatttttaaaggatcctttaagtgagtttcttaatagatgaataccttgcattgtggaagtatactgctgctctcagtaggaacctagtatattgctatagtgccttattaaattagttagaatggaaatgctttaaatgaggctaccaacatatcatataagtgtattttgatgctactggcctgaatgagttaatgtattcataggtatctcacatgctgagagagttgttaatactattggcaggatatgatacctgttgttatttaatacagtaactaaaagtgattgattatattttgaggtctggggaaagtaggatagaaagaaagaaaatgggcctgtattaatttttaaaagtgaaatacaatttttcttagtatgtaactgatttgtacaacaattccctgggaaattggtatttacagactttttttttagtttttacattataaattttaagaagaaatattttaagtaattagaaaatgttttggttgtctatttttatgtagtgatttgtaaaagatccctataattctttttcaattaatctttcagattgttattaagaagagagaaccattgaattttggcatcccagatgggagcacaggtttctctagtagattagcagctacacaagatctgccttttattcatcagtctgtaagtatgttaatggttctagggaagggttttgttgtatttctgttttctttaaagcagaggaataaaatctaaatgagtttaacatagtatttatatttttgtaactttgaaacaggtttagcagtttgatagaagttaatctggagttttaccaatcctaaccttttatgagattgtaaattaccttagatactaagatcaaggtctcattgtacacatgaaagatagagatacaatgttatttaaaaatataaacatcagagagattaccattaaaatgagagattaaccctaatggtagattattttaaagtgagttatgaattgttttcttcatagagtgtattttcattcaaagtatgacttaattttaaacggtttgacttaaatgaaactttttaaaggaaaaatttatgaaacaagtagacagctgaggttctcaaccttgggagcatatcagaatcagctttggaggttttttaaaagcacaaatgtccagacccctccctacctaagctttaagcatgctttgattgattgattatattatctgttgttgtgtaacaactccaaattcagtgacttaaaataattacaaatattaatgtaacacagtttctgtggattgggaatccaggtgactaaactgggtggttctaactcagaatttctcatgagtttgcagacaagtcattgggttggggctacaatcatctgaaggcttgattgtggtcgaaggattcatttcaaagacagctcacttctacacctgacaaattaatgctgtttgtttgcacaaagcctcagttccttgctgtgcacctctccaaggagctgcttgaatttctttatgatgtaactcctgattttcccagtaagttataagacggtgagagcacttgctcatgggtgagggtgacaccacaatgcctttttgtgatgtggttttataagtgatacactgtcacttccatgttatttcattagaagccactaaatccagcccacatgcaagcctccacctcttgaaggaaggaatgtcaaagaatttgtggacatatttttaaattacatctgtctgtcaatctatgtattttatttgtttgtttaaactgcacagttgcttctgaggtccctcttcccaggggacccatgtatatgtatgtttttaattcattgagtaaaaacactgtttttactaaagccaggccctgtggcattaaagggtctttgcctcagaaaaatgcattctagtaggggagacatgatattaaatgaatgatcacacacgtcaatataattacaaactttgataattcctatgcagttacacgatgctatgaacacataacaccataaatacttagctgaataacatagcattataatgttttttattttatatatctcaaaattaaattttattcataaatgtttgatccatattggtgaaatgctttaatcccacccactgaattagcaatatttgccacctaaatataattataatactatcatagctcattgtaaagttttaaatatacaactacttacagagttgagaaggggtaaatagggtagatggagaatgtctccactgctatttccacgtattttcctcccaagcagacagaataaaggggcattgcataggagaggatggtaacctattggactttgttttctataccaaaaatatcttaccattcattctacaaattagattcttcttttaaactacacattttattcttttctagaattcatcattcgtattgttgtgagagttcttttataccaaagataaatgtcatgttttatacttttttagtttgttaattggtttggatatttttgttgggcaggtgtatttagtttttatgtagacaaatctatcaatggtttcccccttttcctttttactaaggccatctctactaaaggatcagataccaccctttttaatggtctctatagttttactttttaaaaaaatctaaatattttatgtactctaacagtcaaatactttagtggaagaatagataatatgaatgggaaatttacaaataagaaatagacataacctaatttgaagaaaagcttgatcttattagtgctcaaagtaggcccagtgaggtgttacatgcctgtaatctcagcactttgggaggccaaggcgggcaggtcacttgagctcaggaattcgagaccagcctaggcaacatggcgaaatcccccctctacaaaaattaaaaagttagctgggtgtggtggtgcgtgcctgtagtcctcgctacttgggagggactggggtaagaggattgcttgaacccaagaggtcgaggctgccgtgagctgtgatcacaccactacactccagcctaggtgacagagtgagaccttgtctcaaacaaaacaaagtaaaataacaagatacaattttaaatcttgtcaaattagtaaagatagaaaagaaagccagccgagtgcagtggctcacacttgtaatcccagcaatttgggaaattgaggcaggaggatcacttgagttcaggagttcaagaccaacctgagcaacatagctagacctcatctctaaaaaaatgtaaaaaacaatcagccaggtgtggtggcatgtgcctatagtcccagctactagggcagccgaggtgggaggatcccttgagcccgggagtttgaagctgcagtgaaccatgatcacaccatgcactccagcctgggcaacaaagtgaaacgctgattcctaaaaaaaaaaagggagaagaaaaggcaggatttctacctactgcggtcaagaggataacttggtacttttcaaggctgtcatttgcactttgtttcagtagctttaaaaatcctcctttcagaaatgtatattaaataattagaaatattttaagaatttttaacagagtatggtattacatatattctcaggagaagaaaactcaaaacattctatttcatttttaggggtaagtatttaaaacaatatgatattaaataaatgtgttcacagattggtaccagttattttacacacagtcacttccacacctacctaaacagtccagcatgaccattttcattggttattgaaagaaaacagtgaacttttagaggtctggcttgggaaatagaggtagggaccagtagatgataccaggtaagaaagactgggaaaaggaagcatgacctagaagtatttcattaaagataaattttgcatgatttgtcatttttgcctaggattgagacagtaagtgccaataaaaaatctccagtaagttacatatgcttaaatgaagaatgactgtgctagtttttgaacttcagctcgcagttcttctcagcacagattagtccagtcaaggatttctaattcagtctgggatcagtcagtttcttgtcactctatccccagctccctcatcttactgaggagagaaagaaacaaaagacatgttctgttcttgttccttccaaaataaagtacagcaaagaagagaatttaagagagtatcccatgaaacataaagaagaaagctggccttgcctaggactgttgaacactgaaagtcatacatcagttctaggcaagccaaaagcaaaatcatctgtgccttgtataggacagggtaaggaagctgagaagacataggagaatgacaggttctgagttatgtgttaaaagatactctttttaacggctatgtggagaaaggatggcttttactctcttaattttgttttacttttcattgtagtctgaattaggtgacttagatacctggcaggaaaataccaatgcatgggaagaagaagaagatgcagcctggcaagcagaagaagttctgaggtatttgagtggcatttatattgcaacctgagtagaagaactagatttcttccctgctgtgtttcaagtcaagggagcctattttgccaaatattatatttttcttcatttgatccttagataataaggacttttttttttgtatttcagactgcagatactattttatatgattaaaacctcacagaaaccaagaattttaagctctataggaacaaaataactttattaatggcaaatggagtgttatatatacatgtatataaaaggttttatatatatgttttatatatatatatataaggttatatgcatatacataccatattacaagcttgatattcctctaggtcagaagttacaactttatttccatttcctcatgatctagcatagtgcccagtactgctcatttgagtgaaaataacttatgtgacactctacatttgtacatatatcttaaatgatgtccatgaaagccctatgtgttagatgaactacccattctgcaaaaaaatactattctggaagttttaaagttcatttttattggttgttcttttttgtgtgtgagcagcaaacatatttcttagtactgctacattaggtcaaagagtaaagagaaaatttatcttaagggagagctagtgactgattactgctttttaaaagtcagatatttaaatgcatctaaagaattcatacattttttaaattgtgtagtaagatacagcaatataaatttttttattttaaaattgagattgtttttaccataggaatagcagacaaattattctttatctgactcaacaaaaaaactgatttcatttttgtattttcctttcttggctttgtcaataaattacagttactgtgaacaaccagcagagggtgcagctaaataactgggaattttgtttgaagtttttgtttttttcctttgaaatatatcaagccctttttttttttttttttttgcaggttaggggacgtcacatttcaaaattcagtcagtaaaattgtgagagtttttaaaatttagttcttatttaatcagtatagcttatcttttataaagggaatattttttaaattgtgaactataacacttaggatattgcatggatcatcaaaaaagataaatcatctctttaaaattctgtgttattttaaaaaacaaataatagatacagatgtctgagtattttaagacattttggggattctagtaattattagtgccattaaccacaaagacaaaggaaggggtctgtcctttttaaatacagtaatctcactgtagagttcaagccatgagttcacaagtatcttaatattgtacaaaaaccttttctttttcattctagcctcttaacccctaagcaaaacaaatgaaaaaatgtacttaaaaacttaatgttttaccctttaaggacagcttgggagagtgagattgttaatccgtaatagacatgcttcatgccgcaagtacataggtagagccaaagagaaatggaggtgtcagtacattgttactgcccctgaatagacattgagcattttaaaagtgtatccacattccgtattgtctaactctgagcttttttcctgttgccactataaataatgccagtactgtgatcagtattgctaagaatgaagattctggtactttaataattcccagcatgaatctggataggtaaaatgtatttttgtctgcagctatctcgtaagttgtctcttttatactttagtttttgatacagattgggtatccctttccaaaatgcttgggaccagaagtgtttcagattttgaaatttttgagagtttagaatatttgtgttctgctgctagttcatcatcccaaatatgaaaatctaaaatctgaaatgctccaatgagaatttcctttgagcatcaggtaggccctcagaaagtttcagattttggagcatttcagatttcggatttttgtatttgggatgctcagcccttatattatttcagctagtaaccaggtcaaaacttcgttatcttacttgtttataacctagccagccctttataattttttctctacctcccttttttcttctggtttgacatttttagttcagattattagtttttattgaacatcagcagagtgatgaaaaacagattttttaaaactattcttcagaaattgatagcaaaagtcaaaatgttgccaaaaatagtttctttactttcttgaattttggtcatccataactctgcctactcctgtttatgactgagaactgtacatacatttcactcactgtagttaatattgagctcccccagacatagataatccactttggatttttctgcatataacctaatgttgcctattccatgcccaattgtgacctgtagcttccttcctcaacgttgcatacttgaatgattttctcacaccctaacccttcagatccaggaccaatgtatgtttactctgctctctcctgtttcatcatcccactcctacctccactccctacattaaccaatcagtaaagatagagagagtgagtctgggtcagtggagttacggaaagagtaaggaacaggtatgtatttcacaaagtatgattagtaaatacctaccactcttttttttttttttttaaacttaagttcagggggacatgtgcaggatgtgcaggtttgttacacaggtaaacatgtgtcaagggggtttgtcgtacagatatttcatcagccaggtattaaacctagtatccattagttatttttcctgatcctctccctccgtctaacctcagcctttccggtaggccccagtatgcattgttctcctctatgtgttcatgtgttctcatcatttagcgcccacttataagtgagaacatgcagtatttgattaaatacccaccactcttctctttggtagagttagtcacatgttaatcctgaaatttacttggtggaaggtgtatcttaagtttccattttctttttggagcgtgtgttctgttcagctgtgttcatcatgcactttaaaaactggctgtttgtaactactataataacaggagattatcaagctcaatatcaagcttttctgaatggtatccccagaaaaagatgtggttcaatggaagtattgttttacaaaatggagataatctaaataagaagtgtcagaagatgtgagttcttatccctgtacttaatcctatgacttcgggcaagtcacttagcctttatgcctcattttacttatttgtaaaatagagataatatttcttctatttcacaagtcacgttctaaggactaagagaaatcctgtttttgaaaatatttggaattttcaaattagtgagaaaattttaagactttcaacattttatttggtgataataaaaaggcactgctatttctttctagaatttatttgccattttacctgtttggtattttctaaaagtaaaagtatgtttcttttcagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaattgggctcaaagttttaataatgtattctcttccttctttgtatttatagttagttattatgggaatacaacatatcttctctaaatttggaattcataaaggataacttcctttagctcaattacttgtattgcttttccctagtagctgaaaagtatttaagtttggtttggtcatgattttcatgtgtttgaggtttttgttgttgttgtttggctttttggtttttgattatttaaaaataaagacattagcaattatagttagtatgattaggaagaaatagatttttcttgtggaaagaatagataacaattctggaatttattttatctctattgatgtgtaaactaaattcctgtattaacttgggtatattttggtcccaaaagtagtcactgagttaaatgcatatgacaaacaattcatggtagcatactgtctcttttagctactaaatttatggtttctattttttgttttcttgatttcaataaagaattgtcagttttagatgcttattagaaataataagaaatactggtaggcatagatagaattagtgaagttttaaccattagcaaaatcgtgcatttcatgtactgagataacaagtaatcaaagacatgggaaacttaccttgtgtttttttttgttttgttttgttttttatgtagtaatttcatggtttctagccatttcctcttcttaagctttacctagggatattctctacttggct

SEQ ID NO: 17055 - DNA, 18011 bp, Human
  misc_feature (1)...(18011): n = A,T,C or G
ccccgaggggcgggccctcgggtccccgcgtcgctcaggaaagacctgggttccctgaggccttggcgggacagctagggcgcgccctggacggtcacttcccagccaccctatggtcgcccgagtcgtgtccccctgttatgcgcccgggctgagccgcacgtgacacccccgaaatccaggagttgcagtgggaggaagcaaaagcaaactggcgggagatgcgcgagcacggcggcggggagaacagccgcggagaaggagcccctgagagtttccctaccgccgccgccgcgccgtggagcgtcgcgtacgcgtgcagaaggccgatagagtggaccccacgtccgctccgtgtggcgggcgccactgagagcagggccggcgcggcgcaccgagcggacgggcgggagaggggacgcgctgtccggagtgtcagtctgaggcgcatcgtgcggggcggcaacagcccgcctatatatttgcgttggcgccggctagctgagccgagcgctatgcgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccggcctatatattgggttggcgccggcgccagctgagccgagcggtagctggtctggcggtgaggagttgctgcgcgtaggggggatgtgggaggaaagaaagcccagttgggccgatcacttaccacaggcgggagcctcagggaggaaaatcgggagggctgagaactagacgactgggggtcatgggttcccgcgttccgtccctgtcaggaaccttggcaggggaccgggaagcggctgggcatggagagccgcccctcattctaggggcttctctatcccaccctcatttggggagctatcccgtgggagagaggatgggaggccgggtcccctccatggggagaaaagttcccagccagcccagtctcccctttctttagctccttttcctgccctcccccacgccctccgcttcccatctggagttggggtcccggcgcccctccgagcggcggtagggcggcagggccgggaaggagggaaaggagactggaggccgtgacaccagtcttggttcctccgccccctgcttccccgccaccgccgctctccaaattggcgcggaaccggcttctccacagcatttcgcctccacaaccccctctccccgctggtccaggagggaggcgggacgtgggggcgctgcccaagccccactcccggtgtacgggggagagggtggaggacccagaaaaacccgtttgaggaagatgtgcctccctgcgcgttcaaggtgtcaggagtgcttggtaaatttttggacactcgcgttccagctgtacattcagttgaggaaatgcaggcttgtatccaaaatgaattaccatgagctagctaacatagcacagaagatggcagggtcacagggcccaggcccccttcggagggactgagctttcacctccgaatcagcgtcttactggcacttggagaatgtgaatgacaatgtacttgactgcggcttttcctctccccccttcagaggttttatacacctgaaagaagagaatgtcaagacgaaggtaacattatctgtcttagagacatgtttcaaattagttgctgcctttaacttactaattacacttcctttttaaaaattcactacagtagccgtttacaagctaagcagcagccccagcccagccagacggaatccccccaagaagcccagataatccaggccaagaagaggaaaactacccaggtgatttaaggagaaagagggaggaacgaaattccatgctgggactttagtttaccaatggtcttttctattttccaggatgtcaaaaaaagaagagaggaggtcaccaagaaacatcagtatgaaattagggtaatgcagaactgggctgggtgggtttgggggaaaaatggaggatagatgaataagaatagaattatgtgtttattgctttgcgatagattcctctgacacttttacttttaatgcccctagaggtcagcaggaaggcgcctatctttgggtggtttctatgtgcccgaatcctactacagctgcagaataagtgccttcaagcagctggttcctttttgtaaatccctccctcttggaactgcctggtgcaccagggcccgcctaatctgtccaatatactgctctttgttccctcgcagactctagtagacggtcctaatagctgcttcttgggcataaataggatgtgagatcactgacagcctggcacgcagccctttggtacctcttcttcctatgtgttttacagaaagcagcactttggagatagtgattgcgtttgaaaccagcattattgggaaaagaatcgtttaagtaatcgattccatttttaaggttttgctttcaaatattcaaaagtatcagagcacactttttttaaaaagagcttatttgaaaaaaaaaaaaaaaggtccctgctactattgctagatacagagaacgattctgtgatcttgaaagtgattagtattttagactgcagatgcattttgttattactgtccttcttcgacacctggtgtcttctattaccagaattgcattttgttgtctaaaacatcctattactctttataaaaatcaatatgagctatatggcttgtttataaaatgtgaatgtcaaattagctatattgccatctatgttagctaaaattatgattctttagacatattagctttcatttatgaaagatccattacaaaaactaaggttttccttgcacaaattgatatttttctttttttttatgacagaattgttggccacctgtattatctggggggatcagtccttgcattatcattgaaacacctcacaaagaaataggaacaagtgatttctccagatttacaaattacagatttaaaaatctttttattaatccttcacctttgcctgatttaaggtaagaaaaatttcagtaattttatttcaaagatataaagttgtgctgatttaatacatggcactattttgtcttttgctttcataaagtagaaaaacgtgtaaaaattgtttactaatatttaatcatatgtcattttatctgagagtagtgctggttgcaaatgatatgggtatttaaaacactgattctataaaattattttcatttgcttgctgagtactataaagacttaacaggactgaattagttttttgttaagatagaaacatttttacatgtacagctttttcctttaaaatttttattcgtgtttcttgcagcttcaactcaaaggaagcttttccaattgatgtatcaaccctatttatttcttaccaaacttaataaggtctatacttaattcttttttctagtccatgagtgtaactaagaggtacagcttatacaaaacatgtactgtattaatttatgattggccttaataagcaatttaatggaatcagacacttaaactcaccaatccccctttccctgcattctgtcccaccttacccaccccataggtgatcctgctgtagatgatctatttagaggtgattgagacttctcttgactgtgatcacatgccttatgtgtttaacttttttgtattgctcttgagaaaacattttttttcacttttaattgcatttattttagtgctgaatttactcctgtgccataagtttttgtttcttcagtttcttctgggatatctttttcttctgggcaaccgcctcttctggtttaggaacaatttgttccttttcactaaagatcatttcgatgtggcagggagagatcacgtgtgagttaatccgaccatgagctctgtaggtccgttggcacatcgtaggtgctttgttcacttggagatgctcaatgaccagagaatctacatctaaactcttaagttcagcattactctctgcatttttaagcatgtgcagcaaaaattcagcactctttttgggccaccaaccttgtgtccagtcccactgcttggcctgggtacacctaccaactccaccattgtaatgtcagaatggcacatgctgtttctgtaaagtgacattttaaaaatacttcatggtgtttttttttttttttttttttggagacagaggtttgctgttgttgcccaggctggagtgcagtggcacgatctcggctcactgcaacctccacctcctgggtgcaagtgattctcctgcctcagcctcctgagtagctgggattacaagcatgccaccacgcccagctaattttttgtatttttagtggagacggggtttcaccatgttggccaggctggtctcgaactcctgaccttaagtgatccacccaccttggcctcccaaagtgcagggattacaggtgtgagccactgtgccggccactttgtggtttttcatatatgcatacccttgatagcctgggcagtttcacgagtgttcttacagtgaacacaaagatttgaacctcttgatttgcatgattttgtggggttttccaggtaaagtgaatagccagctattttcacagattacttcagaccacttatgggaaaagcaacgtggttatcttttaacagcaacctttgtaaagtataaataagtggaactagaaagcactcccttgaaatctgcaggtttggatgatcatagtccaggttcccactgtgttacttcaggcttctatttattcatgcaaaggaaattgtttccaaaaattaaggcagaagttttttttcttatttactttaagagcttcttccaagttctaattaaaagttgcatttcaatgtctgaaagttgaattttatctatgtgaaacagagtttgtatattacatggattgcacaatttaaattatgttttttagccgggcatggtgggtcacgcctgtaatcccagcactttgagaggctgaggcaggtcgatcacttgaggccaggagttcgagactagcccagccaacatggtgaaaccccatctctactaaaaatacaaaaactagccaggcttggtggcaggcacctgtaactcccagctacttgggaggctgaggcacaagaatcgcttgaacccaggaggtggagattacagtgagccaagattgtgccgctgcactctagcctgggccacagagcgagactctgtctcaaaaaaaaaaaaaaaaaaatatatatatatatatatggtttttttcctctctttccatagctggggatgttcaaaagaagtctggctaaacatgttaaaaaaggagagcagatatgttcatgacaaacattttgaagttctgcattctgacttggaaccacagatgaggtccatacttctagactggcttttagaggtatgttacagcaatacaaatttcctttgtctctgtatgatggaaacatatttagctgtaaatgtgctttctatgtactctcaagagtttattgttcatccccaggaagctgtcttttttgaggtacttactgtagttgattgcacccaaagtggaaagtgactctataagagtaaaaccatgacaaagctactacatataactaaacccaattcagaattcctgttacctgtggatactgctgtgtaccaaccactttctgggtgccacagatactcaaggtgaatggaatgtatagttgattaggttttgaattatgctatacaaagtgaagaactagaactaggcttcagggccctctgaagtctttttctgtattaacaaaatcatgatgatgaggaatcctgatttctatatcctaaaccataatgagactatggatatctggaagctctacgccctctattgtccagataccttctctttattatattcttctattcttttccgaaatataccattaatttaaaggaatagtgatcctgaagcccctatagatttgtgccagatttttctctcttgtttaggtccattccctttcctctggataatagctctaaaaaagtttctaaaattattattaaggaaatcattacttatgttgatgacaaactgatttttcctccaactcttggatatttgctctgtagtctgtctttaagacaagagatgaagcattctaagggaaaaagaccatagactttttggaggaggaacacatggcagaatagatctcagaagctatcagaacagtttttaagactaaaatgttatccttttgcatcaggtcatctttttccttattctgactagaaggaaagattgtattttaattgtgggcacaagaaggcattgggttttgactttttctgactgtctagtgatcatggaatcaacttaagcacaattatgttaatttttaatttgtttcctttttgttatactgatattcatccagtggttatccaattcaatttgttcctgtttttacctaaatatgattatgtatgcaacagcatacagaatatatcaaatccagcagtgttaaactctatcttagtgtattcttcagtctaggaatgcaaacttgattcaacatttgaaaatctattaatttattaccttaacagtaaataagaaaaatgctaagatctcaatagatgcaaaagacattttttgaaattcgacattcttttttttttttttgagacggagcctcgctgttgtcacccaggccagaatggaatggcacgatctcagctcactgcaacctctgcatctcgcgttcaagcgactctcttgtctcagccacccacatagctgggattacaggcgcaggccaccacacctgctatattttgtatttttaatagagatgcggtttcaccctattggccaagctggtcttgaactcctgacctcaagtgatccgcccgccttggcctcccaaagtgctgggattacagatgtgagccaccgcactcggccagcaaaagagattttcttaactcattattagaaactcatgtggccaggtgtgatggctcatacctgtaatgccagcactttgggagactgaggcaggcagatcagttgaagccaggagtttgagaccagcctggccaacatggcaaaatcccatctctactaaaaatacaaaaaattagctgggcatggtggcacacacctgtaatctcagctactcaggaggctgaggtaggagaatcgcctgaacctgggaggcagaggttgcagtgagccactgcactccagcctgggtgacaaagtgagaccctgtcaaaaaaaaaaaaaactctggtatatatctctatttcctcacctccaaaatggggataatggtacctacttacggagttactgtgagaattaaaatctttccctaaaagtgtagaaatgacagatactatttattattaataacaatagtgaaacatcagggcaattcctattaaagtcagaaacaagggataagattttgtttatcaccaatgttaaccattcagtatcctttgataatttttaacagtgcagtaaaatatgaaaaataaatgaggtaagaaaaactataaaactagtaaatgtgcatagtaatagatttgtttatcctaatagtacatcttagtttctttttttcctttcctatcttagctttgctatcagtttggcttaaacatattttaaagtctgatatgctaagagatgactttctaatttggagaaattcagaagataatatttaaatgtttggattcttctctaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggtaagttcttaaaagtttatccttagatatatttatcccaaacttttttttaaatcaacatattaatcccaaagaatactatgttttatattaactccttagaaaagtgaatgtttttgtttctcagtacattttctgaacattaccacagggatgaatgataaattatcatagttccctctgtaatgtctgagccttattacaaatctctagtttagattctgggattagtatctaagtgaaatgtcccatggctcattctgccaaacgaaacatattgatgctctatttatatacataattatagcatttgtattcaacagaatgacctttgaaaactaaacagctaataaaatgaaatgaaatgcatactgtgttgggttagaataatggtttatccagccttttttttttcttttttcgagacgaagtctcactcttttgcccaggctggagtgcaatggcgcgatcttggctctctgcaacctccgcctcccaggttcaagcgattcttctgcctaagcctcccgagtagctgggattacaggtgcttgccaccacgcccagctgatttttgtatttttagtagagatggggtttcaccatgttggccaggctggtcttgaactcctgactcaggcgatccacccacctcggcctcccagcgtgctgggactacaggcatgagccaccgcacccggccagcctaatatttttgtatctgatggtgcagccctgatagaaggcacctcctttcttaagattttccttcacataagctcaatttacttttcttaatacatgatggatatcatcaatactttcatctaagacttttatagctggtatcattttgagagaagagggattgtgatcatatattaattttttaagtgttttcctttttcttttaaatgtcttttgagctttaagagccatccccaaattctgctgaatttggcacataaacttgtgttcagtctatccttacttgaaattatactgttttagacaactttctagactgaaatcctgatcttttagcctgttctcctatgtgggagacacctaatcctttgatgattctaattcttctcaggagtgctaaaacagacctgttagccaaactgcatgaagtattttttgattaactgtatttttgtactagggtaaaggaaatgtttttagtttctagaccttatttgttgggtgctttgcttttgttttttgagacagggtcttgctgtcacacaggctggatgcagtggcactattgcagctcagtacagcctcgacctccgaggctacagtgatcctcccacctcagcctctggaatagctgagactacagggatccaccaccatgcctggctattttttcttgtagggacagcgtttctctttgttgctcacgctggtcttaaactcctgggctcaggtgatcctcctacctcgacctcccaaagtgctgggcttataggtgtgagctgctgcactgcacccggcagggtgtctccttttgatctgactaaccatatcaggcaatcttaaagcaagtttggctgttctttaactgaaatgacatattctagttgtattaatgaaaattcaaagtcaattctatgaaaagaagtcttgataatcaatatagttactagatacctagatatgaaaatatcttcctttgttttgactttagaattattttactgagatttatagttagtgaagctgtccttaaatctgaagcctgtgtgtgatttgtatatagatggtcccctacttaccacggtttgacctacgatgttttgactttatgatggttgaaaacaacctgcattcattatgccccttgacgtacaacagggctatgtctgcttaggttgaaaatactgttaagttgaaagtgcactttctggccaggtgcagtggttaatcccagcactttgggaggccaaggcaggcaaatcatttgcagtcaggagtttgagaccaatctggcctacatggtgaaaccctctctctcctgaaaatgcaaaaaatagccgggcacagtggcacacacctgtaaccccagctactggggaggctgagacccaagaatcacttgagcctggaaggtggaagttgcagtgagccaagattgcaccactgcactccagcctgagactctgcctcaaaaaaaaaaaaaaaaaaaaagaaagaaaatgtactttttgtctttgcttatttctccaagaaaatgaaaatgcactttctacttaaatgatattttggtttattgggatgtaaccccattgtagactgaggaacatttgtaattaatttctatctcaattgtactcaataaaaatattacaatttaaaggaaatctatgctcctaaactccaagagtttgcttacgtcactgatggtgcttgcagtgaagaggatatcttaaggatggaactcattatattaaaggtaataataattatgttttcctagttgcaaaaaagaaaccatgttactaagtaacataagtagttataattgaatctcaaatactacaatgtaaaaagtcaaaactgaggtattaggatccagttctaagaggttaatgcatcaaaatattgacaatggttatggttggatggggaatgtacttaacctctaagctctgctgtataatgtggtgtatgtgtctacattcattaacaggcatttttaaattttgtttaataggctttaaaatgggaactttgtcctgtaacaatcatctcctggctaaatctctttctccaagttgatgctcttaaagatgctcctaaagttcttctacctcagtattctcaggaaacattcattcaaatagctcaggtactgacatttttattgattcaatggtaatgttattaattacaggttttagtgtatatatagtcttaaataggctataccacaaaatgacatattgacttcactccttaattctagaacaaaacttttgacgcataaagttctgtccccagtgtttatgttgcttaatatttctagaaaaacaaagtccttacacttttctgagtactttcattctttaggagtccaaactaaagtatctctttttgatataaaatggggaaaagcatttttttcgccagttgtgtttaagctttataatggcatagaattattctgtatgatgtctttacatttggatacacagagtgcctatcaagttaaatatcagaattaaaattactttgttaaaaaaattttttagaacataaattcaaagtaaacttttccaggctagcatatttaacaaagtaagtaagtagaggaggaggaggatctggccgggcactgtggctcaggtctctaatctcagcactttgggcggctgaggcaggcaggcagatcacttgaggtcaggagtttgggcggctgaggcagcctagccaacatgttacttgggaggctgaggcaggagaatcgctggaacctgggaggtggaggttgcagtgagccgagatcgcactactgcactccagcctgagcaacagagcaagactccatctcaaaaaattaaaaaaaaaaaaaagaggagatcccattctttcttgcttacttctcgtaagtaatcttaaggctgctgtatctgccatataacaaaagtgaagaaaatctaccctcttattctatgtgggatgtgaaaatctaacatatggaagacatttggggataattattaagtcacctaggttaaaatttgtgggcagtggtgcttaaatctagcacattatgaatactcaaattggataaccactaagtatactgaaattggtttattttataaaactttttattaaaagcttaattttttcatccagaattcctagcatcccaaattgtcctaggcagctatacccttctgatagtgatggtaaatctttgataagccgataaacaatgtggactttctagaggtatataacagtaatatttcacttccaattcccagctcttctcccatttctcctaccttctggaccaatgaggacaaagagaattgaagtttaattccactgcacaagtatcttctcaaatctgtgaaatctaccccttttacactataccattccactgctactagttcagctcttattgcctagattatacagccttttaactaatctcactgcttaataaacatgttttcttctagtctgtctgcttcactgcattctaaggtatctttcttaaaatggaactttgatttaaaaatcttccagtagcttcaagaatcagcctataaaattctgacttcttaaagaccctttgtgatccaatctagaccatgcctctttctagccaccacccctcatctttcttgataagaaatgaaggtactccttatttatttttcaccttaggagttctgaactgtgaactgagttccaagtaatgtccctatacctagaacattctctgcctcctactcttcctggctcccttatcttttaagacccatttatggcaatttgaggccatcactatcttttccaatctggattaggtgcccttcctgctagtacatgtcacactgtattgcaacagtccttccttgtctacttccttcaggttggtggcttgttttttttttttttgagacggagtctcgctctttcgcccaggctggagtgcagtggcgcgatctctgctcactgcaagctctgcatcccgggttcacgccattctcctgcctcagcctcccgagtagctgggactacaggcgcgtgccaccaagcccagctaattttttgtattttttagtagaggcggggtttcaccgtgttagccaggatggtctcgatctcgtgaccttgtgatccacccgcctcggcctcccaaagtgctgggattacaggcgtgagccaccgcgcctggccgggtggtggcttatttatctctagatccctaaggttttagcaagagacatttagtactcatctttctcctaaattgcttgtacttttgtttttcctgttagcttttagatctgtgtattctagccattgattcattagagttccagtacagaatactgactgctgctgccttgtgccattttacctccattgaagtggttaagaaagcctcaggtaagactctctatttgttgtcttcttaccttttcacaacttctaatgggactacagtctctgaactttaacattctgctaaacatgcatttaaaactttggcaaaaaaaaaattagctgttcagtaattatctttctgttagaagtactttccaatcctgaatgtgtatcaacaaaaagaccaaatggaatttaaatacagttgaaatgaatcaacattatagttctgctttaagagttctttgggatttgaccatttcaatttcatatgtagaaggtactggttaagaagttctgaagtcctttttcccttcaacatagtcatgtaaatagtttgagagtgataatctgttttgacatgctaaacttcttggttatgatttggtttcttttaaaatatctcaaaaacagcaacaagtacatcagacatatgtaagatagtttctgatgtacaaccttcatgcttttctaacttttttctatctatctaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggtatgtttttttgtgagttttttggctttgctatctgaatctagtaagtcaccaaaactgatggtaggaatagagtactccttcaggcagtttcaggggaaagaaagttctaaggggcacactgatttcaaaatgtagaaaagttaataaaattactttgaaatcaaagcaagatttgtgaagtgtctcaagatcaatgccaacagtctagataaagagtttaaaaaatatataacgttacagaaactttcagaatatgacccttcacacttgcaaagacataaaaagactattaaaattaggcctaaataatctcaaataagtacccagaagtctggtttgactttgatttatgaaatcagtgcatgatttcttcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattagaggtgtgtcaaaaattaagttttgttggtacaagtaatataaagctacctacgtgctaacaacgatacagtttaatgattaactgaacctcttaactgtaaaacccaggagtcttggaaaaaaattaacataaagattaaccagggccactctcaaggaaagatggactgctgagccatagtttatggaattacttaagtggcattttaatatattaagtaaattcatgtaaatttatttgaaagtataagtaagctctacatggcgatttttagagttaaactagggctccacttgttaatgtgcaaaaataactggtggctcagcactatggtagcatatagttgctcaacttttcatgattagaaagaagtgcctcaaccaactaaatatacacactagttttttgctatggactgtttagggccttaaaatctatagatgatttaaaaaaaaaaaaaggtttttttttttttgttttttgttttttttgagatggagcttcattcttgtcgcccaggttggagtgcaatggcgtgatctcagctcactacagcctttgcctcccaggttcaagtgattctcctgcctcagcctcccaagtagctgggattacagacgcccgccatctcgtccgtctaatttttgtattttttagtagagacggggtttcaccacgttggccaggctgctctcaaactcctgacctcaggtgatccgccacctcagcctcccaaagtggtgggattacaggcgtgagccactgcacccggcctagaatttctttaaacaataagacttctgatatgtagcttgaagagagaaatgactattcagatatgatcgtcaggtatgggaagttagggaataggagaaattgctggatgatgccatttcaacatgaaggaatgcatgtggcaaaagttggtagtagagtataaccagagttgtttcaaacatgtatcccaaagataactggctataaaaacccgaagtgtgagacagaagttggaataggagccagatatttgagagcagtaatacaccccatgtggacagtaatcaaaaccgagagtggattaaattacctagggagaatgcagggttacagaaaagtaacccaaggactaacttcttgagaaaaccaagtttaaggagtaggcagaaggagacacccaaaacaaaaaggaagaaatagagaacgtaatccaataaaaatgatgtcagggaagccaaaggaataaagactttcaagaaggaaggagatgtaatcaggaaaaggactgaaaagtatccactggatctggcatttggtggctcttgagagaaaagaaagagcagtgatggcagaagtcaaattgctggcttgaagagcttcaaaagctaggcagagagggctgagggggctggaggtggaggcacagacaacaaaaacttgtattaggatgaaatattttatagactatgggagaggttgactatataggaaatcaattcattagaaggttattgagggggagagaattcaaagcataaaaatttgccttcatcaaatagtataacctcttatgggctgcatagcgggcttaacaatgagtacagctgtagattattttaaaggcaggaagcagcgaatgaaataggaattttaagctagcactcacaaggtcaccattcccaagactcttaacatccatgaggacagagcctggccagtcttcactggtatatctcaagcatagaagaggtaaagaagttactgagtatggaaaaggtagagagaggacaggggcttaaacaggaaagtctaaaaattagagtccacgaagagaatgtggaccactgaacta

SEQ ID NO: 17056 - DNA, 331814 bp, Human; identical to SEQ ID NO: 12008
  misc_feature (1)...(331814): n = A,T,C or G

SEQ ID NO: 17057 - DNA, 154023 bp, Human
attacaggtgtgagccaccacgcctggcccagcaatttacttttttttactctctgtttctacttacctgtgaaggtggttaataacaactactaaatggatttgctgagtgaaattaagtgtttcacatagtgtctgacttctaaaaagtgctgttcttaaatttgttatacacatatgtattggtcatgtgtggttttttgtttatttgatttgttttactttagttttttatatactgtgccttactctgtttctctctctctcttttttcttggcagtgtgttttggacacatagatatcactgattattcttttctaccttgctttgatttcaagttttaatttttttctttttttttttttttgaggtggagtctcactctgtcgcccagactagagtgcagttgtgtgatctcagctcactgcaagctctgtctcccaggttcacaccatcctcctgcctcagcctcctgagcagctgggacaacaggtgcctgtcaccatgcccagctaattttttatatttttagtagagacagggttttaccatgttacccaagatggcctcgatctactgacctcgtgatccgcccgcctcggccttccaaagtgctgggattacaggcgtgagccaccgcacccagcctcaagttttaatttttatggaaacaaacctagttctcaatcagtgacacatcagattaagcttggagattttaaagaagtgctgattattaggtctcagatgttttgctgtttggtctaggctggaacttggacattagcagtcctctagaagtacttcaggaaatgctaatttgcaatttagtatgaaaaccactggactaatgaatatggaatgtaaaggatttggtggcgttttcccatactcctatcagattgcagtgaaccctaaccagtaaatttctgtgtcctctagtcctgttaagattctttgaatatactgttgattctcctgaaggactattaaaaaggaccttgggaaaaaagacttgtcaaagtggaaacgtgagctcacttgacagatttgatggttttggagaaatatggtataatttaaaccctttccaaagaagttacccgaaagttttaaattttatatttaaatcacttaaaaaattatcttaaaagccatttataacgctctgatacaatgatgtgttgactgtgcattgtcttgaattctttgtaaaaatctaatactagtttccttatgtttaggtattaaattttcacagtatatataaggcagcaattgataggcctttcacagattcttctgtaagttaaaaatgacaaccaagaagcttacttatttttctggaatgttatataatatatggcatgtttcctggcataactgcttgtacaatagtgtgaatttcttaagggaagtaaaactgtaaatacacatttagctttttatttctctcatttttataatcctctgttattaactgtaaagactggtgattttagtgtacatattaaaattgtaataatttcttattcatctttttttgttgttttttggagacagagttttgttcttgttgcccaggcaggctggagtgcaatggcaccatctcggctcactgcaaagtctgcctcccaggtacaagcgattctcctgtctcagcctcccaagtagcccagattactggcaggcatcaccacacccagctgtattttatattagagatggggtttcaccactgttagtcaggctagttgcaaactcctgatctcaggtgatccacccgccttggcctctcaaagtgccgagattacaggcatgcaccaccatgcccagactcttactggtctttttaatatgtaagacagtggtaccttttttccttttaggttatgaaatggtctctgcaagatgttttgtccttgaattggaaatttttaaggctgatatatgctggtacttcatcttctatatgtggactataatttcttcccttaggataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccaggtaggagtaagactgtgttgttttgagtactgtgaaatacaaaattgtgaaacatgtcctgaatgatttgtaaagtaatcataaaatatgtggttattttaagttacacgtgaaaaaagtgactgtgggctaagtgtggtagctcatacttgtaatcccagcattttcagaggctgaagagagaattgctttagcccaggagttcaacagcagcttgggcaacatggtgaaaccctgtctcccatacaaaaattagctgggcatggtagcacatgcagatagtcccatctacctgggaggctgacgcaagagcatcacctgagcctgggaggtcaagactgcagtgagctatgatcgaggcactgcactccagtctgggtgatagaatgagaccctgtctcaaaaaaaaaaagaaaagaaaaaaaagtgactctggcatttagtgaaaggaaaccttgattactgtacatggttgagaatgtagccctgtgtttttctgtatctaaggtcccatgtgaatctgagggcaaaagtattaaattagtccctgtaaccttagttataagcacagacttcaggcagctatttatattcaaaccccactttataagattatcttatgactctaactgctataatacctaagcctcagttttcatatctataaaacaaggataagtgaaataatatttctaaaaggtttaacatagatttaatatcaaagttctgtgctgacctatttggaaataattacttcttttactatactgttagatttttttgtaagatacatgaagcttctaatgttagtaatttgcctttactttttcttggcttttttcctagggtgattcattaattgcattgagctaatgttttcagggttttggctttttaattcccatttgtgtgtttttttttcctttttctaagattcattcttttgctttctttaggttttgtttgctgttcattttctagttccttgaagtagtattttgttgatatttggatttatgtttatgatatattggtctagttttcgtgcaatatatttggttgttgatgtgagggtaatgctgacctcatagaatggcctagaaagaaagtattccctttgcttccatctggtggaaaaaaacggtagagaattgatatatttgagagaatttaccactgagcctttctgggcattgtgctttctgtttcagaagattgttatttattgactgtttatttagaaaatattgccaattcaaatgatctgtttcttttctgagttttggcagattatgtctttaaaggaatttctggtaggtgtagagctgttcatagtattcctttattatccttcaatgcagcagccccaacccttttaggaccagcaactgcttttgtggaagacaatttttccatcgatggggggatgtaaaatggttttgggatgaaactgttccacctcagaacatcaggcattagttagattctcataaggagcatgcaccctagatccctcacattgattcagtttacaatagggttcaggctcctgtgacattctaatgtgtctgctcatgtggcaggagttggggctcaggtgctaatgctggctcacctgacactcaccttctgctgtgcagcctggttcttaacaggacacggactggtaccgtctgtgacctgaggcttggggatcccttaatgagtatggcatctgtattatatgtcccttgtttcaattctgtaattaataatttgtgtcttcttttttcttagtctggctagaggtttattgatgttttcaaagaaccagtgtgtatggttttgctgatttttctgttaatttcttgtcattttcattcctgctgtagtttttttctgcttactttggaatttgtacttcttgatagttttttttttttaatggaagctttgattattgatttaagagtttctttttaatatatgcattcaatggtataaatttttgtcttagttgtgcttttgctgtattccacaaattttaagttggattttcactttgtacaaattttatttttatttctcttgagctttctttctctctgtcttttatttttctgttttagactgagtcttgctgtgttacccaggctgcagtgcagtggcttgatcttggcttactgaaaccgctgcctgctgggttcaagcaattctcctgcctcagcctcctgaatagctgggatcacaggtgtgcgacaccacacctaatttttgtatttttagtagagatggggtttcaccatgttggtcaggctgttctcgaactcctgacccttgtgatccacctgcctcagcctcccaaagtgctgggattacaggcatgagccactgtgaccagccctttctctttctttctaaataactcacgttatttagaagtgtgttagtaacgaaatattttaggattttacaactgtcttttagtgagttctggtttaatgctattgtggcctgaaagcatgtgttttattatttttattttaaatttattaaggtgagctttatggccactgggcgggttatcttggtgaatgttcccagtgcacttaggaagaaggtatactcactgttgtgggggaaataatctagagatatcagttagatccagttgatggatgacgctgtttagttttttatgtttctactgatatagtctgctgaatctgtccatttctcatggaaaagtgttgaactctcaaactatcttaatggatcaatctagtcctgcttgcatttatatcactttttgcctcacatattatggggccatattgttaggagcatatacattaaagatatttccagctttttgaattgaccacatatataatgttgttgtttattcctgataattttccttcactgaagttcactttgtgaagttagtatagctaattttcctttgttttgattagtattagcttggtatgtttttcttcattcctttaattctaatctacatctttatatttaaagtgggtttcctatggacagcatatagttgacttttgttttttgatctactctgataatcttttaataggtatatttaggccattgatattgaaggtgattattgatatagttgtgttagtaactacactatttgttattattctccatttgttacccttattgtttgttactgtgtccattttttctgccttttgtggttgtaattgaacattctatatatttttttcttttctaagcttattaatcataggcttttattttttatttttaaattttttagtgattgccctagaatttgcaatatgcatttataccaaatccgtaagtccactttccaaagtggagtacatgtactatcataacaaaatatctgtaattgtttcctcctgttcttgtatcattgctgtctttcatttcatttttacgtaagctgtaatcattgaatacgttgttgttaatgctattttaatttattttattattttttgagacaggcatcactgtcaacccaggctagaatgcagtaacatgattttagcttacagtagtgttgaactcctgggatcaagtgttgttcccacctcagcctccaaggtagctaggactacaggcatgcaccaacatatctggcttttttttttttttttttttaacttttgtagaggctctcactatgtttcccaggctagtctcaaactcctggactcaagcaaccctcccacttgagccctcccaagtcactggtattacagacaaaagccactgtgcccagctgctaattttattttaaagaaaccattatgtcttagatcatttaagataaaaagaagagtttttatgttaccttcatgcattacttacagaatgcttttcttttgaagatgtttctgttgtatatcatttttctactctcagaaaaacttgcagagcagatacattgacaacaaattctcttaacttttgtctgagcaagtttctatttctccactttttaagtatacttttgcagaatacagaattctagataggtagttgttttctctcaacacttatagatattttattccagtctcttgcttatatgatttcttagaccaaacccagtgtaattctaatcattgctttgcttataggtaagatgtttgcctgtagcatgtttcaaactttttatttttcatcttctgcaatttgaatgtatttctagatgtactcttttttttgtttttgttttttttttggcatttatctagcttggaattctctgagcttcctgaatctcttgtttattgtatggcactaatttggggacttttttagttataattgcttcttttttttttttttttttggaggcggagtctcgctctgtcacccaggctggagtgcagtggtgtgatctcggctcactgcaacctccacctcccaggttgaagcgattctccggcctcagcctcctgagtagctgggattacaggcacgtgtcaccacgcctggctaatttttgtatttttagtagagacagggtttcaccatgttggtcaggctggtctcaagctcctgacttcatgatccgcccacctcatcctcccaaagtgctgagattacagccatcgtgccaggccaattttttttttttaattttcagcctatttttctctgctcttcagtgttcaaagtctaattttttaacgagtgcatcattaaaatgcacaggaatgaaggcattcttcattcctgttgcagtgtttttgatctatactgtattaccttgaatcttttttagaatttctctctctttgcttacattaactaccttctcatgtcatctactttattcattagagcccttagtgcattaatggtagttatatttccatctgataaatctttttatttggagacaggctatcactgtgtttcccaggctggagtgcggtggcgggatcttggctcaccacagtctctccctcgtgtgctgaagctattctcccatgtcagcctcccaagtagctgagactacaggcatgtgctaccacgcctggctgatttttgtgtttttttttttttttttttgtagagatggggttttaccatgttgcccagccaagtcttgaactcctggattcaagctacccacctgcaatcgcctcccaaagtgctggcattacaggcttgagtcactgcgtccggcctccatctgttaaatctaacattcctgttacatctgagtatgaatttgatgcttgctctgtctcttcaaacagtttttttgtcttttagtatgcattgtaattttttcttcagagatgcacattaagtactatgtagaaaggaactttggcagatgggctctagtaatgtactactggtaaggtattcgggtaggggaagcaatctgtaatcttacgattaagtctcaatgtcgtagtgagcctgtggcctttgggctgtggcttagatggaacatgatgggtatagggagctggaattggagtttttagttctaccatgtagaatgctgtagcaggctagagttgagtattttttttcctttaggtctcttagtcattaaaaaacctcagtagtataaactagtttctcttgagggctttcttttaacagaacagaatgtccttatgtatttcaaaatggctactttgcatctttccctccgagaagctcaagggacttttttcttatcttttcagggaaaggttaaaaaaaaaattgttcattcccataaaatttggcttcttagtagttttttttttttttgagagggagtctcgctgcgtttcccaggctgtggtgcagtggtgcgatgtcggctcactgcaaccaccgcctcccaggttcaagcaattctctgcctcagcttcctgagtagctgggaatacaagcaccaccacccctagcttatttttgtatttttagtagagatggagttttaccatcttggccaggctgctcttgaactcctgacgtcatgatccacccacttcagcctcccaaagtgttgggattacacaagtgagccaccacgcccagcctcttagtggtttttaacttgcattgcatacttcccaccatgagccttcaataattctttaattacagtttaggttatcataccttgggactggttgccacagaggtttaagatctactcagattgtctatttctttataacttgttcttggcgtagattgtatgcctctgggaatttgtccttttatccaggtcatgcagtttgctgagatacagtggtttataggatgcactgataatccttaacttttttgtataaaattcattaatgcctcttttatttttaatattaattatttgactcttctctttttcttagtcaatctagctaaaggtttagcagctctttatttttttcaggaacagaattttgatttcattggtttttcttagttgtttttctagtctctattttgcttacatctgtgctcgcttttgctttaatgtgtcacttaatgaaggcatatgttctgagaaatgcattgtcaggtgatttcactgtcttgcaaacatcatagtgtgcttacacaaacctggatggtataacctactacacatgtaggccagttattgccctaggctactaacctgttagcatgagttgaatatggtaggcaattgtaatacaatggtaagttctaaacagaaaaaatttagtaaaaatggactattgcaatattatgagatgaccattgtatatttagttcatcttgaatgaaatgttttgtggagcatggatgtattttgttattcttttagttctttaaggtgcaaatttggttgttgatttgagatctttttttaaagtactttataaggtttcctcagcactggttctgctctatcccataaatttggcattttttcattttcatttgcctcacatattatatagtttctataggatttctcctctttgatggatgggccatttaagatgtattgtttaaattctacttatttatgaatttttcagtttttcttctgctattgctttctttttctatttttgaggcggagtctcgctctgttgcccaggctggagtgcagtggtgtcatctcagctcactggaagctccgcctcctgggttcacgccattctcctgccttagcctcccaagtagctgggactacagatgcatgccaccacgcccggctaattttgtttttgtatttttagtagacaacggggtatcaccgtgttagccaggatggtcttgatctcccgacctcatgatctgcctgcctcggcctcccaaagtgctgggattacaggcgtgagcccccacgcccggcctcttctgctattgatttctactttaattgtatcctgatctgaaaagaaactttttatgagttaagtcttcctatatttgttaagatttgttttgtggcattacgtatcctgatgcatgttccatgtgcccttgcaaagaatgtgtattctgctactgttgtgtatgtagagcaggaatccctagtccccaggtcggaccagtaccacactgtggcctgttaggaagcaggtcgtacagcagaaggtgagcatcaggctggtgagcgagcattaccatctgagccccaactcctgtcagatcaatggcagcattagattctcataggagcatgaaccttactgtgaactatgcatgtgagggatgtaggttgcgtgctccttatgagaaatctagtatctcatgatcacaggtttcatcctgaaccctcccacccctcaactggctccatccatggaaaaattattaattattgttgttaatctcttactgtgcctgatttatgaactttaactttatcatagatatgtatggataggcttgactgtgactgtggtgggtccatttccacaatggtttcctcacatggcggttgggtagaggcctgtttcttaaccatgcggatcccctcgtagggctgcctgagtgacttcagacatggcagttaacctctgccagagaaattgacctaaaagagagggaagaaaaagccatgatacctttcatgacctagactcacaaatcacattgtcatttccaaagtatccctatctgtacgttctaggccagaaacacacctaagggttatgttcatatgacatcattaatctgaaagtttacttacattattattacctttccattttagagaatataactattttctcactggccagaatggggttggttaattcaagcttagagactgttgaatcagagataggtaagattcagtggtcttctattttgttcttccttttcagtagaccatagtggggctcttcccattgtttcagtgaaacaatggtgaaatgtttcactctcttctttggaggccaccattaggttttattattcccaactatggcataatatcctgataggaaatcctgatttcctatatcctgataggaaatcaaactttctgcttcaagccttgtaaataatgtgttaaagttatgctgaagctcatcttcccacactttctgtgactttccacactttccgtgattttccacctgcatctgcagtggattttgagctagttttgagcctgctgcccatatccactgtaggcagaattgtattggaatgaaatcattaatcgcagttatcttgtctatatgtttctggagtattccgtttttcttacccaggtagcttctgcagttttttaagcaagcaactaattttagccacttctcagttataggcagatgcagtaatctgttgctaagtatcacatctgacttggaagttgaaacccacgtgcatgtgctttttgtttctcttgctttttaaatttctatttgtttggctacagacagtaaacgtcacttggtttatacataatgtatgcataatatacaggtattgggtttgacaaatgaaagactgtaaccagcagtataatgaacatgtaaaatacaaaaatttatttgcactgcccttgtatatttaagtcttccattttcagttcctggcaactgctgatctgctcttcatttgtatgttttgcctttttctttttcttttgtttccttaactagagatagggtctccctatgttgtccaggctggtctcaaactcctgggtttaatcagtcctcccatcttcacctcccaaaatgctggtattacggatgtgagctaccataccgcatagtttgtcttttctaaatcatgctgacttaatctttcgagattttgcattatgcatttagtattcttccatattgttacatgcaacaaaagttttttcctgtcaattgctgagtagtattttattgcataaatgtactagtttgtccatttgcctgttgaaggacagttgggtgactgaaagactgaaaaagaaataaataactataatttcagtttctgagtacagacttgtaaccaccagtataatggttctgagtacagaaactgatattacagttttaaaatcttgcaataaagaaaacataggaaagttctattaaacatttaagaaatgaggtcaattctatacagtcctcttccagacatacttttcaatttcatcttcctaaaacataattggtatttgtaaggaagacatttatgtgttgcttaagttaaatattttaatctctttaattatgaggtgttaattcttgatgttttgaggaatccagcttcattgccttttcttatttgtctctctcaagggaaactgaggaagaagaagagtaacagcaataggaacctgtaatccctagttaggaatttttgtgtctaaactattggttattattaaggaacgaagagtttttttggaacagattgtgaatctataattataatctataatctaagtttaaaaaagtaggtttgtacagaatttatgtagtatatagtcaaactaaattattagaacctaaattgatgaagacactgtaaacacaaaggtgcatgtgagggtgaagattagtgttatctttgataatgtagtttgggaatatagccttaaaaggaatagtttatcttgtttagttagtcattacttcagtatcctatccttaaggagataattcataaggtttattatgaatgtatttattaacagtaaacatgacaaaaacatatcctctaatttttacttagtcaactcatgcagtaatgtgttgccattaaatttgtttttttttttttttttgagacatagtctcactctttcacccaggctggagtgcagtggcgtgatctcggctcactgcaagctccgcctcccgggtttaagccattctcccgcctcagcctccgaaatagttgggactacaggcgcccgccaccatatccgtttttgtttttgtaattttagtagagacagggtttcaccatgttagctaggatggtctcaatctcctgacctcatgatctgcccgccttgtcctcccaaagagctgaaattacaggtgtgagccaccacacccggccgccattagttaatttttaagattcttaattggccgggtgcggtggctcacgcctgtaatcccagcactttgggaagcggaggtgggtggatcacctgaggtcaggagttccagaccagcctgaacaatacggtgaaaccctgtctctactaaaaatacaaaaaattagccgggtgtggtggcgggtgcctgtaatcacagctactcaggaggctgaggcaggagaattgcttgaacccaggaggcagaggttagttacagtgagccgagattgcaccactgcactccagcccgggtgagacagagtgagactccatcccccaccccaaaaaagattcttaatcatgagggaaaatacttctgtattaaccaaattaaattttaaaaagataaacattgtgaccctagttttattaaatatttgggcatatatatggatacttaaaaatagatatttttccttaatctgtggtttaaatttggaatatttaatttttaattaagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggtgcatttgtttggatttgttttattaatggatgcagtaaactagaaaagcaaaactacttccagcattgcaactagtagtaaatgagaaaaagaaaagagtagattgtagtgtctcaagtcttactattttaatagcctgaacattttagtcctagctgaacactttgcagctcattgtacttaatgcaggcatttcttatggattttaaatattggaaggtaatgacaatatgaatacagtttcagattaatgatgctttatgaacccttcctgtgtttctagcctagacaaataggtaggtattttgttttgaatgtttacaaacatttctctttgataagaactttataccagagttctggagaacttttctcacttgtggaatgtccatttgctacagcagagaccttattgcagaaggttgtattgcttctttctctgttttgtttagcggttgctgatttctgttagagtgtatttttcataaggactagagaactgaaactgttagtaaatccttagtggcagacagaaaagatttttttttttgtatatataaaagcaacaaaaaggatagaatcagtttacctttaatagattatatgtattgaggcatctttttaaaaacgaaaagagatatttgggaattttgctgtttcttagtacagggattaagggacaggtgaaagaaagttatttctggggagtagtgggtttgtcagtagacatagttgcagaaagctgaactttttacaaaagtaaggaatgtaccaggtgagtgtgtggtgccctttgcatcactttttaatgtgggagtgtacttaagatggcatagtggctttctgtattgccttttgatatgggaatgtacgtatgacagtaggtttagaggcccacacctgagacgtgatctttaggaaaaggtgagataaatgttttgttgagatctaatttcttttgtctttgtgaagaggagtaaaacaaaacacttgccacagtgtgtcctttcactaataaatatgagcccccaaagagcgttttcctactaataaaaggtatacatttaattgataattgtataggttagttttagtattctagagaagctattaaaagaattccctgccattgctatatctcatttgacagtgcctaaaaaaattcagtatatagacacaatagatgtctcttagttttccaatgtagataatttgcctacttctttttagaagtctatatggtgaatataatataggcagaatttctcactttttcatagtaacagtaactatggtaggtaacttatttatagtgttcctttactatgaaaccagtaaagcctctttttgttttataataatccttaggcctcgatgggtggttcctgttttgccaaaaggggaattagaagtgcttttagaagctgctattgatcttagtgtaaaaggtgagtgtggatgtacattttctataatacgtgctcctatatatacttacaccttgttcttaaaggcttttcatccctctgttataaaggtactgtttattcctagtttataatgtgtcacaaaccttcctggtaaggattattttacatatatacatgcatattatatatacttattacacacacacacacacacatatatatatatacacacacacagacaaatatacatacttccctatagtaaaggttcatagaaatctttagatagcctttagggatacctggagccatttaagtattatgtataattttatgtgtacaaccatatttctaaggtgagaatatatattttttaaatttttaaaaagattgttatccagaagttagaaaatattttccagaatatgaggaggggatatagctcagggttagagcatcagactgcggaccaagaaaatattttccagaatatgatagttctaaagtctgctatatgaagtaatgtgcattaaagcatattttacagtttacaaagtgctgcatagagggtttattgtatgacatcatatatatttggtgacctttttacacttaagtcacatgtgattgagaaatatgttaatttgtgattgagaagtatgttaatttgtaaataattttgccaattatttttatttattttattttatttttttgagatagattcttactttgtcacccaggctggagtcagtggcgtgatatcagctcactgcaacctccgcctcctaggttcaagtgattctctagcctcagccccccaagtagctgggattacagcaatgagccaccacacccggccagccccatctatttgttttttacatgcaaatcactatttcactaatattgagtgtatatgtttagtaaactgtctagcttacatatttagcttttttttcttcttaacacagagttgaagcgtttttcttaaaaagaaaaacgtcttaaaagatgaagccttaatataaaaaaaaaaagcaacctatgaagaaaatttgatatttttactctcagccacaagtaaaagctttgggtttgaatgaagcattttggatgattttgttgtaataataggtgcaataaaattcatggatgagccatttttgtaatattttgtattattttatttttattttattttattatattttattttattttattttttttttttttgagacagagtttcactctgtctcccaggctggagtgcagtagggcgatcttggctcactgcaagcttcgcctcctggttcatgccattctcctgcctcagcctcccggtagctgggactacaggcgcccaccaccatgcctggctaattttttgtatttttagtagagacggggtttcacagtgttagccaggatggtctttatctcctgacctcatgatccgcccacctcggcctcccaaagtgctgggattacaggcgtgagccagcgcccccggtgaatactgtgtatttttttaaggacttgaaagctgtaagaagggtcagaagtatttaatttttgtgtcattcagcaggaacttaactgtcagtgttgttagacaaatttttaattcctttggtatcctgtaaagtgtttctgttgccgagtctgactctgtggtggtattgataatttcatttaactaataactatcctactgtcatttaacgactgttatgttgttttactgatcttaccaatatgtgatctagtgacctctgaaaatattttaccagattgaaaatatttctcctcatttaaatttcttttgttaattgcatatttattaattgagcaaatgtcaaggacttctgtactaggtatgttctagggtctaacactacaaaatgaacaaaaactggaaatggtatttcatttcatagcattgatattcagtggatgtatgtcatttgcagggacttttcctctgttattctgagatcgtgattactgtaagataaaactagtttaaatgatagagtagtatgtatataattcaaatcaaaatatatctccttgtacatatttaatatgttttgagttgctttaagagttacaggttttctggctgggtgcagtgatcctgtaatccctgtaatcccagcactgtgggaggccaaggtgggaagatcacctgaggtcaggtgtttgagaccagcctggccaatatggcaaaaccctgtctgtacaaaaactacaaaaagtagccaggcatggtggtgcatgcctataatcccagctacttgaaggctgaggcaggagaattttttaaacctgggaagtggagattgcagtgagctgaggttgtgccactgtacttcagtctgggaaatagagcaagactcttcaacagaaaacacttgtaagttttattttttgatagaggcacatggatcttgcttttcttaaatcaggtaaaggtaaaaagaaaaaagaaacttaagatttgcctcttaaatttgatgataaatgggcaatttaccgggaaaaatcagattttttaattgtcactttttaattttcacagattttttactgtatttcagtaattaaaattctatgaaatggttcaattccctgtctactagtgaacattctttttctgatgtcatattttcaagctgtttcattgagttacattacttgatttgatgtagtttatacaactgtttctaaaatttcctgaatattatatttccttcctttttctgaaatcccatgttttttcacctttttaacattttataatgtcatgtctcatttcaaaagccacaacactatttgtgaattggagaccataatagtttctagcaatttactatgtttaatcataattggccaaataattttttttaaacattctttgtttggctcgttttttaggccttgatgttaaaagtgaagcatgccaacgtttttttcgagatggactaacaatatctttcactaaaattcttatggatgaggctgtgagtggctggaagtttgaaattcatgtgagtcttgtatttcatttctgggactcagatttacatggtgattcctgtggatttgtttttgaaaaatacttctgtgcgtaacatattaacatatcaagtctgctgatatatactgcataattgaaggttagcatggtctttaagaatgagcttgcggttttgatttagtaaacctttgtttaacctgtcccctgaaatttcaacaaccttgtaaccttacacacaacacagtgtatttcatcaaatgcaagatagtattgattggaagaggcactactattttgtagcacttgaggtcaaaaatacttaagcagactctcaatgtagctgggataacaaaggatataatttcagtgcaaatgtaaatggtaaagaaactcactatgcacaaatgtaaagcaaagaaactattttccagagtataatagttctaaagtcagttatgtaatgtgcagagaatgaaagaaagaagattggtagagaaagaagaccccctgtcttggaaatttagaccagaaaccagtattcacacaattttgtgatacgaattcatacttagagttttgatgccaaaaaagtcaaatagaatttaatacattctcagattagcagtatcttcaagtgacaggtaaaaggaaacacaagtaatctcaggtaatattgcaaatctagtacctaggtatatattgcagtctgccaactatcttgattctattataagataccttcatatttcagagattttaaaaatgacaaaaactaaagtatctttactgaattactgtacatacttcaggcctctggttcttttttagaaaatgcagttaaccaaaagttatgaatcaaatatatactttttgatgacctcaacctaaaaaatacaacttagacattttccacaaatgaccatggcatgcatatgccagcagctctgaattgacctataacttttttgtaggggtggaaattgaaattttgaaaatatgtgacttttgagttgagatgttgataacaaaactttaaaggtttcctctaaagtacaaattccagagagaaaagtggcaatttgtgtgtcctgtagacataaagcagaaatagacaaactgtggtacctactttatttgttacatttctcaaatagcttttgaaattaagtgcaaatttatgaaataaatattaatttatctttaccaatgtattactttgatcccaatattagtgaaattatgcagaattaagatgaccagtgcagaaaaatggaaagagattattaataaaaattaaatgtgtttgaaattgcaatgtgttcttattataaactgtatcatatcctatccatgtaacagagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagatgaattatttgctcgttcttcagatcctcgatcaccaaaagtgcgttggtttgttattttcaagattaaatattaatttttttatttgcatttgccacagaccattagtgatgtgaacctgtctttaaataatgatcaagtcaatacatagtcttgttttatgtggatttctgtttaaagacctattatttaatatgtataaccttgaactcatggtcaataaccatataactcatgcctgaacagggtttattatgtattgattggttgaatatgctccttggagcatagtgtttgtgtttctgtgaggagaagtcagtatttgctaattcattgttcacagctacttcagagactgtaattactgcaaataagcatgggctgttctttgtttgtactgtgtgtatatatttattaaagcagcagaatgcttacatatatttacagactgtataacctcagtgagatttaaaaattgtaccattttgctttcatgacataccattaggcgtttcctgtaatgcctaattttcttaggagaagatggttcagtgttcaacagctaaatcttggatcatgtaagtaatctttgtagttgtacctcaaagggaagttagatctgctttatacttgccagaattaacaatttttctcaaggaagcgggatagaagacagcaaaatctaattacacatcaaaaagccagaaaagaaaaaaacagccaaaaccactgcactagcagtcaaagctatggaaaagtcacccaattttgtatattttcactttaatgtgtcagtatctttaatattactgtagtggctatttcatatctcaaagtcagtttgatcatattaaattcaattaatatttagcgcatgaaaaaaaaacttaaccagcaacagaaaaagaaaatagaacgtggctttagcaagtatactgcatatgcacatgtgcgtgtgctcacacacacacacacacacacaaactcgcagaatccaaaaagataaaataatacagaattcctttaaatagtataaaatttttgtgaacagacataatttacttttttctttcccattggttcacattggataaatcctattactgctttttcttgtgttacctccacaggtaggaggacttaattagtgtattgaatagaaatagtgaaaggaggcattcttgattgttcctgatcttagataaacagctttcagtctttcatcatagagtatgatgttagccaagagctttttacataaagtctttattatgttaatgtcaattatttctgttcctcatttgtttagtggttttatcattgtggtggtaaattttgtcaaagctttttcggcattgatggccatgatcatgtgatttttttcctttcattctcttcagattgtgtgtcgtattgatcaatatttgtatgttgaagtgtctttcattccaggaaaaaaataacttggtcatgtatataatctctttaatatgttttaaattttgttgctattatagtattgcagaattttgcatcaatatttataagggagattagtgtgtagggttttttttttttgtaatttctttgtcttgttttgatgttcagggtaatgctgtcttcatagatgagtttggatatgttctttcctcctcagttttttggaagactgtgaggatgattggtcttaattcttcaagtatttggtagaattcccccagtgaagtgattgggttttgtttgggcttttctttatgggggtatttttgattgctgattctgtctgattagttatgggcctattcaggttttctatttcttcatggttgcgtcttgggtagattgtatatttctataaagttgtcctcctatctaggttatccagttttttaggatgcagtggttcttagtactctcagatggttttttatttctataatatacatagtaatgtctcctgttttgtttctgctattagttatttgagtcttctctctttttcttagtcaaactggctagaggtctggcaatttctttattttttcaagaaccaaattttggttttgttgtttttctgctctgtttgctaatctcttggcatttatattcttctgctatctttgggtttattttgttaccctttttgtagttattttttgtttgtttgtttttgtttttgagacagtcttgctctgtcgcccaagctggagtgcagcggcatgatctcagctcattgcaacctctgcctcccatcctgtgcctcagcctccatagctgctggggttaacaggtgctcaccacaatacccggctgatttatgtatttttagtagaaaagaggtttcaccatggtggtcaggctggtctcaaactcctgacctcaggtgatctgcccacctcagcctcccaaagtgctgggattacaggcgtgggccattgctcccagcttctttttgtagttctttaaggtataaattttcggttgttgattggagatcttttttaaaaaatcctctgtactatgaagttctctcttcgcacagcttttgccgcatctcataagtttgatatgttttcatttttatttgcctcaaatattatactttctgttggagttctcctccttgatcgatgggtcgtttaagatgtgttgtttaatttctccttatttatggatttttcagtttttatttttttttattttttgagatggagtttcgctttttcacccaggctagagtgcagtggtgtgatctaggctcactgcaacctccacctcctgggttcaggcaattctcatgcctcagcctccggagtagctaggattacaggtgtgtggcaccacgcccagctaattttttctatttttagtagagatggggtttgaccatgtcggccaggttggtcttgaactcctgagctcaagtgatccacctgccttggcctcccaatgcacctggctgatttttcagtttttcttctgctgttgattcctagtttccttgcatcctgatctggaaagatagtttgtatgagctcagtcttaaatatgttaagatttgttttgtttgttatgtaatgtatcctgatggatgttctaagtgcacttgacgagaatgtttattctgctacttttgtgtagagtgttccataaatgtttattaggtcaacttgttctctagtgttgtgcaaggcctttttttccttatttttttttttggagacagggctttgctttgtcacccaggctggagtatagtggtgccatctcagctcactgcaatctctgcctcccaggctcaagctgttctcctgctgtgtagctgggattacaggcacccgccaccatgcttggctcagttttgtatctttagtggagacagagtttcaccatgttggccagtctggtcttgaacttctgatgacaagtgatcctcccacctcggcttattgacattttgtctgattgtttactgattattggaaatatggtattgaagtgtctgactaattttgtataactttctctctaggtctcataatgtttgcttcacacagtcagcagttctgaagtttggtgtatgcatatttataattgcagtgaattcacccttttatgatcatataacatccttttttgcctcttgtgagaggatgctacctaaaatttattttgcttcatattagcaaaacgttctcttttagttactgtttgtgtggattttttttttttttttttttttgagacagagtcgctctgttgcacaggctggagtgcagtggtgcaatcttggctcactgcaaactctgcttcccagattcaagtgattctcatgtctcggcctcccaagtagctgggagtgtgcaccacgatgtatgtaccaccatgccctgctaatttttgtatttttagtagagacgggcttttgtcatgttggccaggctggtctcaaactcttgacctcaggtaatctacccacgtcggcctcccagatgttttgtattcttagctttcaagttgtgtgcatccttatatttaagtgagtcttttgtagacagtttatcttggattctgtttttgttttttaaatctattctgccaatctgtatcatttggttgggaagttgaacctactttatattcagagtaattagtgataaagaggatttaccactgccattttgttgttttctgatgtcttacagctttttttctgtataattttcttacctactgactttatcttcataatttcaattcttcagattgtcttttacagacatgttgtgattcttctcatttccttttaggcatattccataaacatgtttttcctggttaccatggagattacataggggcataccttggagatagtattgcaggttgagttccagaccactgcaataaagcaattaccacattgaagggagttgcacaagttttttgtttctcaatatatatataattttcactattcttagtctgttaagtatgtggtaacattacatctttaaaaaatgtactcaccttaattttaaaatgcttcattgctaaaaaatgtgacattttacaaatttcacttcttaaaaaaaaactatctgcaaaattcagtaaagcaaagcgtaataaaatgaagtatgcctgtatattattataatagctgtaacagtctattttaaacccataccaacttgatttcagttgcatacataatgtcctttacacctcacctgctgcaatttatgttattgatatcacaaatgatatatttttatatgtaatacagacataagttttttaattctttggcctctcaaattctgtaagagaataaaaagtggagttattagacaattacagtaatactgagttttacaaatgtttgtatgtttttctttaccacagatttggtaatttttttttaatacattgaattatcacctagggcccttgtatttcaacttgcacgccatttagcatttttgtagtctagtggtaatagactctagcagcttttgttggtctagaaatgtcttaatttcaaggactgttttgccaagtaccaaattattatttgatagtattttcctctcagtacttcctaatgagcactcagctgttagctatttttgagggttttgttgttgttgttgctgctgttgttttgttttcattatgtgaggagttacttttcttactaatttctagattctttctttttataacgttttttggtggtggtctttgggggtgtgccttccctagaggtactgagccttttctatttgtatatatccatgtctttcctcaaatatggcacagttttggccactattttggccactatttctgcatgtgagacctctgtttctttatcttctgcttcttggacgttcataatgtttgcatttttccaagtggtggtattccctaagtctctcaggctattcacttttgacttctttttttctccacttactctgattttaaatgaccttttctcaagtcgtgattgtcagtcctgcctattgatgtcttctgttgagcccatcttgtttccgtattttcatctgcagaatttacgtttggtttttttgtttgtttgagacagagttttgctcttgttgcccaggctggagtgcaatggcgcgatctcgacttaccacaacctccatctcctaggtttaagtgattcccccgcctcaggattccacgtagctgggactacagacacgcacaaccatgcctcactaattttttgtgtgtttagtagagatggggtttcaccatgttggccagcatggtgtcagtctcctgaccttgtgatccgcctgcctcgacctcccaaagtgctgggattacaggcatgaaccaccacacctggccacccggctacttgtatttttagtagagatggggtcttcttctccatgtttggtcaggctggtcttgaactcctgacctcaggtcatctgcctgccttggcctcccaaagtgctgggatgataggattgaaccaccacacctggccctgtttctttattattttttttctctgttgacatgttcattttatttgtatatcatttttctaattttctttagcctcctttttcattagttcattaggcgtatttgactttttcttaaattattttattttattttatttttgagacagagccttactctgtctctcaggctggagggcagtggtgcgatcttggctgactgcaacctctgcctccctggttcaagcgattctcttcctcagctccccctggccccgagtagctgggattacagacgtgcaccaccatgcccagctagtttttgtatttttagtagagatggggtttcagcatactggccaggctggtcttgaactcctgatctcaggcgatccgcccgccgcggcctcccaaagtgctgtgattaaaggtgtgagacactgcgctgatattttaaaatgtttgtcaagtgagtctggctgtgtttctccaaggacagtttctgtccttggacagaaaaaaaaaaagatttattttatcttgtctactttttgtaggctgtgtcatctttttttttttttttgagacaaagccttgctctgtcacccagcctggagtgcaatggcaccatgtctgcccactgcaacctctgcctcctgggttcaagcaattctcctgtctcaccctcccaagtagctgggattacaggctcccaccactatgcccagttaattttttgtatttttatattattattattattattttaagaccagatttccctcttgttgcccaggctggagtgtaatggcgtgatcttggctcactgcaacttctgcctcccaggttcaagcgattctcctgcctcagcctcccgagtagctgagtttacaggcacccaccaccatgccagctaatttttgtatatttagccaggggtttcaccatgttgaccaggcatgtcttgaacttctgacctcaggggatccacccacctcagcctcccaaagtgctaggatgacaggcatgagccaccgtgactggcctcctgagtcattttgagcatttgaaaaagcacttatattccccagtctttgtgaactggcttggtacaggggaattccctttattaatcagctcagcttgcaggcttaaagcctgctttaaccttttctaggtatttgtctttcttgagactttccgtgagtcttttttacccatgtatttcacatggttctggttattccattccatgatggttgctgtaaaaatttcccaattcctccatgagcctcacctctgtttatttttgctgccttacctgtcatgtgcattcttcattcagtagttcgcctcagtagtctacaggtttgtaattcccttggagacttcacaaattgtcttcccatggcttctagtcggagttttaagccactgttggccccttgcccttcaggttgagtatgcagagactaatcccacaggcagcctgcagacaaatttagaatgttgtaaatctagccctcttgattcctccagttcatacagaactggtgaccagatcactggttctgcaaactgtaccttggtaggaagggagtgggcaaggataagtgaaataacacaaaattgcctgttccctttgaatatggctttttcttgaactgggcattttcttgatagctgtatacttttgactgattttcagaattgcagtgaagttttttctttgaacagaaacaaggctttggagtgttttagtccacaatcttgctgatgtcactccatgaactgattttttaaataataaaaaggtaggaaaatataatattatagtaaaatcattcaggaatatatttaccaaagcttttaaaattcagtttttcatcgtatcaaacgtaggattagagttatacaagtgtattctttaaaagttattttttatttcacattttccacatgtcctgaatatgtttttctgttcaaactggagaaattatttctctcaagattggtagtatggtcagacatgatggctcatgcctataatcccagcactttgggagtccgaggtgggtgtatcacctcaggtcaggagttcgagaccagcctggccaacatggtgaaaccccatctctactaaaaatacaaaaattagctgggtgtattggcaggtgcctgtaatcccagctattcaggaggctgaggccagaggattgcttgaacctgggaggcaaaggttgcagtgagctgagatcatgccactgtactccagcctgggtgacagagcaagactccgtctccaaaaaaaaaaaaaaaaaaaagaggaggaagaaaagattggtagtaaaacatcctttgttctctactccctctttttgatttttctcctaaaacttgactctagaaaatgatataaaaatctttcattttaccttatttcttaattcttagtttattcattcttttcataacttctgaagtcgttaattcatattgcatcttaacgtttagagatgtttttagatatacaacctttacctgattcttactcgtaccagatacatgagatataaacaataccagttgtgtccccatgaactatgatataatttctgcctgtgctgtgtccagctgaaagatatagaaaacaaaatacaatataaaaggtttaaatctctgtaagtatatatagtaaacatgtcttgtactctttttaaagataatttagtataattttttaattaaattttccatttctagtatgcttcacacaaatgcgtttcaaatagtaactttttttctgaaaggggggaattaatttttattattaactgtattacagggttggctagtggatctcatcaataaatttggcacattaaatgggttccagattttgcatgatcgtttttttaatggatcagcattaaatattcaaataattgcagctcttattaagtaagttatgttttcatgtttgttaaataatttcatgtttgttcaaataattgcagctcttattaagttatgttttcatattctgtgcattatacaaattactattttatttacttaaaaatcattgttcatttttttcagtgtgggttgtgtctcactgtaaaatgaggacctgtttttgtgtggtcttaaatgttgaaagtaattggcaagtttagttcttttaaaaaacatgaatgttacagaggttttgtgtccttcgtatttcagaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcaggtaagatattttccaccttaaattatttgtgtgaattctgatataacatttactccaaatttctctcatttatggttgtaaatttcctcttttagtggaaagatgaatgcactgaatgaaataaataaggttataacatttactccaaatttttctcatagattgttgcaaatttcctcttttaatggaaagatgaatgcactgaatgaaataaataaggttatatctagtgtatcatattatactcatcggcatagtaatcctgaggaggaagaatggctgacagctgagcgaatggcagtaagcctcttaaatcttttattgtgaataagacactgcttatggaaaattacattattaccaattattgttagaagcaacaatagcaaaactaaaattgaaagatttatgactaattgtaagatctttttataataataataaaaggtttaataaatgattagttgtttgaaactgttgaggtaacttaattgtttctcaggtaaatttattatttttgaatgtagctttgatgtaaatagatggcttggttgaaatgaaatagtaagatgtgattttcggaggggttgagtggatctgcagtctggtgaatgaactaacgtagtgatcacttcctaattccatttgaagattaataaatagggattataactaatgggataattgagtagtgctttatcatgattttaagaatattaagattaatttcttttttttttttttgagacaaagtctcactccatcacccagtctggagtgcagtgacacgatctccactcactgtaacgtccgtatcctgggttcaagcaattatctgcctcagcctcccaggtagcagggattacaggcgcctgcaaccacgcctggctaatttttatgtttttagtagagatggggtttcaccattttggccaggctggtcttgaactcatgacctcatgatccacctgcctcagcctcccaaagtgtaagattaatttcttaataatttcattttaaaatcactatgtatgtcattttgacaggtaatgaaactgtttaccatagaaattttcatacattttagtttcaaaataaatagcaaatacttcaccaaagtattaaaaagtctttttttgagtgtatgtggtttgcatagtggagatcatttctgtagaataagctttaccataaaataaccttcaggttgctagtggaaaggattagaatgtgaaaaaagatatgctaaggacatttgggtggtcttaatagtgtttaccttagacccatgctcatactcagtgctggtggtcaggttttatgtatgcaatttgcctgctttgtggaatgttaaacagaattactcagtatattcactagtccttgaattattactggttcttgagagacaccaacattgaaagtatttagcaaaatttgacattgttgtggcacttttattgtattttacagaagaatctaagattgggaatataaaactggttgttttcaatggatagtgtgagaagtgtactgttgtatcacatatgggaatctttatttgcagaagtaaaattctgtaaaattatttatgttaatgtatactaattgcagattacaacaccaaggtaattcattatattagtgaattataatttgtgaatctagtacacctatggaaagattttatatgccaaattttgtgaaataagttattttagtgtttaattttgaattaacacaacacttaaatgttacactactgtgctgtaatttgtgaatgtatacataatttggacttttgaattcctacttaatattatttagaagttggagacatgtttttatttcgctttttaaaaaaatttctttttagtttcagcattgaatttttgtattacatttaggaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggtaagaaagtgagatgatagctattttctaagaaagataccaaaaaggagaaaatttttggtaacccttatataatggccagcaatttagtattgcctgacttttactaatgcatgtgctgttcatgtagagaaatcttaccaagaatttttaaacaaaaaataacatttttctgtctttgtatatatattcatggtagcagcttataggtagtttttttggttttttttgttttgttttgttttgtttttagatggaatcttgctctccctcccagactcgggtgcattggtgcaatctcagctcactgcaagctctgcctcccaggttcacaccattctctgccttaccctcccgagtagctgggactacaagcgcccaccaccaggcctggctaattttttgtacttttagaagagacagggtttcaccctgttagccaggatggtcttgatctcctgacctcgtgatccatcctccttagccccccaaagtgctgggattgcaggtgtgagccactgcgcttggccatacatggttttaaatgaaagatctatatagcaaaataattatgattaaaggaacaattattgaaagaggataaagaatctatatttggaggttttcacctatgtaatgcatagaagaaacaaatgtcacgagttccattacagtgactttaaaaaacatacgattattatagaagattatgactttccataataaaaaaccctggtttcagatatactaatgcatatgtttttatattatcttaatggcaggtttctactcctgggtcacttggggagtattgttaggcactggctcataaagcttgttttttgccttttttttaagagaaacaacaaaatacttaatcttgcttttattgagcacttaagcttggagttttgaaacaatctaatattttgacttctttttctcttagttttatttgtaaataccttctagtaagttttcatattaatttccgaagtttactatttgtacccaaaaaaactgagttgccaggtattaaatgacagttctaaagcatttcaaatattaagaattctgttaattactcaaatgaagtaggaatgtttattaagtaatggagattcttgtagtagaactatttttttgttattaaaatttaagtatactataattttttttttgcttttatttattctacttttgttttttcaacaggcaggaaaacatgaagccattgtgaagaatgtacatgatctgctagcaaagttggcttgggatttttctcctggacaacttgatcatctttttgattgctttaaggtagtagcttgaatagtaaagtattgccaaatagtaaatattgccagttaattctaagtaaagtttaattcgttagatttcttttgcttatagctagtgtgcttaactaacattttcatggaagaatctctgatgaaaaagaattggtcattgttgtttcttccaatcagagtttaacagtaatttgttgtaatagttttcatcacaaatgcagaatcttaatgttttttcacttacattatttctttgaattcatttccactggtaattttcattttgactttggttaaaataacctgtagaaatgcagagaataattggaaaatgaggcataaaacattctggttctatggagttatgtatatggcatatagaaatgaaattcaaaaaacaagaggtttctaatatcataatgtcacttttaaagacattttggcacaatggtctcgctggtttttaaggttgatgaatttatggatcaagaatataaatccatatgtcattattcaggaataaatatttcagtaaatagtaattagatttttggtgggagctttacttgctaattacaagagagaataggttggcattgttcttttaaaatgtagattcttacgttctatcacccaactattctatttctgaatctatgccctgggtaaactcctgaatatgttcactaaggaatgttttcaacagtatcttagcaggattgttttattagtcccgaaatgaaggaaacaacttaaatgtctatatattatgaaaggataagtaaactgtggactcctttatatggaacactttgtgacaatgaaagttaacacattgtaacagtttggcacatagatggatcttgccattatggagaatatagaaaaaaggaagaaaatgatgtacaagaagtcagaagtgacctggataatagtttcacaactgttacactttgaattctgactacaccccagatgtgttaaatcagaattaccatgtaaagggactagacttttaatcatgtcagcataataagaatttatttgagatgactatatgttttaatctgttggatgtatatcagaggtaggcaaggacatcaatattgagaagttatatttgatactctttatttcctattgtttttagtcctgagataacttctgaaacagtgatgcaccaagacagccataataatagatggaggatctggtgtcaatttctctcttttttttttctccctctcctttttaattcataaattctcaagatgacttcaagataattaaaataaaaaatctattatctgactgggaacggtgtcttaggcctgtaaccccagcactttgggagactgaggagggtggctcacatgaggtcaggagttcgagaccaccttggacaacatgatggaaccccatctctattaaaaatacaaacagttctctgggcatggtggtgcatgcctgtaatcccagttactctggagaatgtcttggacctcgggggcagaggttgcagtgagtcaagatcacaccactgcactccagcctgggtaacagagggagactgtcacaaaagaaaaaaaaaatctgtcatttctgtattgctgtttggcttacctattgtttatcaaaagtctgttattcagtgactagcattgcatttttgaggtgttggtaaatctggcagttcttacacagcatgccagtgtgtcttcaaaggtctttgttaaggtgcttttaaggaggcaatgagtatacgccaattatcagttcttcgtgggctgcagctggatgattccaagtttatctttcttctcagttacatgtagttaatgtgcttgctcaaactctaggtgataaagatttgaattctaagtaagcctttgtcttctgaggtgttggtactaattttcagtgcttgccaacgtttatttttggcataatttttcatttttgaaagtcccatggttatgagattctctttgtggtcatcaattttaatatttctagatactgagattgaacattgttacaggtctttgagctgttctcacttccttcttagaatatgtctatttttcctgtccagtagttgtcctaatttgtttcctaggagtttttgtgtatctaaatgcttattgttcaaaccgtatcacaaatagtttctcacaggttttattaacagtttgtttgaatcaggatctaactacattcctcactgtctagttttctatcttttaatcactcctctttgattctgtagttgcctccttacatttttttgttcttgtaataatattcatcatttgctattttgttagtagtttctgtattccttttgttatttcagtgggaattttgtggacaccagagggaattaaaagcaggtgttacagttgtcttcctaagaaattctgtatttatcattttaaagtgctgtacagttactaggttaaggtgatgtagtcctttctcctattattggacatttaagtggatttcagttctttagttctagtgtgtccagaatttattccttcctgtgggttcttggtcttgctgacttgaagaatgaagccacagaccctcctggtgagtgttacagctcataaaggtagtgcaaacccaaagagtgagcagcagcaagtgttattgtgaagagcgaaagaacaaagcttccacagggtggaaggggacccaagccagttgtgctgctggcttgagtagccagcttttattcctgtatttggtcccacccacatcctgctgattgatccattttacagagcactgactggtgtgtttacagtcctttagctagacaaagagtgctgattggtatgattttacagagtgctgattgttgtgtttacaatcctttagctagacacagagtgcagattggtgcatttgcaaacctttagctagacacaaaagttctccaggtccccatctgaactagaagctcagctgacttcacctctcactaataactactaataaaatactacatatagcttcctctgtattgctgggcatttagaacacttgttttactttaataaattaattttttatactaagaagattgtagattcacgtaccatgttaagaagtaatgcagaaaatcccatatattctttaccctgttactcttagtgttaacatctttaaaaatcactgcaaccaagattttgatcactaccaagattttgacattgtttccatcaagatactgaacatctgtgtcatcacaaggattcctcatggtgcccttttattgcaacacccgcttgccttctgccccaacttccttcttaacccctggcaactaaccagaccgccagtcggctcaatttctaaaggtcttttgcttttactttaaacatgtactaactggaattgaacataatatggacttttgaggttagtttttttttcattctatttaattgtttgcagtctcactagaatgatgtatgtatctatcaggttgagtatcccttatctgaaatgcttagtaccagaagtattttggaatttttttttttggagcatttgcctcatactgactacttgagcatctctgcattaaaaatctgaaatccagaatgtttttattgctgttgttttttgagatggagtctcactctgttgcccaggctggagggcagtggtgcgatatcagctcactgcaagctctgcctcctgagttcacaccgttcatctgcctcagcctcccaagtagctgagtagctgggactacaggtgcctgccaccacacccggctaacttttttgtattttttttcagtaaagacaggatttcactgtgttagccaggatggtcttgatctcctgaccttgtcatctgatctgcctgcctcagcctcccaaagtgctgggattacaggtgtgagccaccatgcctggcccagactgttttaaggagcatatcttttgagcatcatgtcaccatgcagaaagtttcagattttggagtatttaaatttcagatcttcacattaggcatactgtatctgacatttgcttcctttattgacgagtagtactcatggtatgaactactcaccatgaatggacatctgtattatatccaggttggggctattataaactgctgtgaaccttggtgggcagggtttttggcttttttatgtttttattttgtgttttaatgcaatgcttatttctctaggtgagatgaaatgtggaaatgttgcagtcttcctaatgctgtgaaccttggtgggcagggtttttggcttttttatgtttttattttgtgttttaatgcaatgcttatttctctaggtgagatgaaatgtggaaatgttgcagtcttcctaatgcaccttattgtagcattttctcattttctgtatcagtaccccatgttctttgtcctgtgtccaagaaaattaaggaacgtggacacaaaggtgggattggagtgaaaatttaataagtgaaagaaaaaagctctcttcagcagagaggagtccgagtggattgctgggttatagctgaatttaacagcttttataagaagctcttctcatctctgtagcagtttgaataacttctattatcagtaaagctgtctgtgcaactcctcttatcttaagcagttgtggatatgtctctaggcaagcacagagtgccacttctcttcttgatataactgagggtttgttttcgataagcccctcacctccctgtgtaagttctcaccatttgtatgcctgaaaaactttttcctgggagctgactaattatacaaagttgcttacctatgtgcaggtgcagcctgaggttttccaaactgatttttcctttgcttctccctcattccctgcttcaggagtggaaaccctgactgctgttgggaagattgggcattgatctttctggttaattcctgctggagacaggcattgtgtggggaacagaagctaggattcctccaggagatggtttaaggcactcagatgaaagaagtgtttatgcctggttccatttgcattaccatttggagcttgatagcttctaagtgaaatgaaacaatttgggttactagtggacatatgttaaaatgagacaagaagtggggaaagacagcattaaaatcctgaggctgttgacatgccctgataactggtggctataactatgcctgttaagattttgggtgcatggggctaggctttgttgagcttccttggtcttactttcccaaaatggaaacgtctggattataggttacctggcagcatttgtaggataatcgccctgaactagaacattgttccagatttttacgttacatatccctttctgtttcctgtgagctgcagccagagatggctggttagtttacaggaataagcaatgttagtttaaaatgtaggcaggaatgtaaaaactactaacgaaactagaagtcaatgacagatatgtgataagtttggaacataatttcccttttttcagtgctcatttctgttaaaaacaaattccagtcctcatttctgttaaaaacaaataagattgagttgtttgcaaaatagactttagttttaaagttggtctgagatttgcataaaatgcaggaagaataattatttttacacaggccttttagataggctttgatggaactttcttccacaaggactctcagatgggactttgaagctgagcccagccacgggtttgtaccctcagatacctgtgacttaggtaaacttttcttttcttgaggttccaagagcatggtgttcctagggctgtgagaaagtgaaatttgttactcaccgcaggttaggaagcttatatggaagctgtgtagacaaggtgtgaggccacttttcccaaagggcttttattggctctgcaagtcaagactgactccttcagtggaaacaaaccctccagtcaaaaccttggtaaaacaaccagtttttcaaattgtgtgcaaaataaaatggattcttactgcactgacgcaaacaaccatattataagtcaagaatacttacaacaagtatctgaattttaaaggaaccaggcagaaagaaacaaacatgctctaaaccttgttcacaagagtataccttactcagttgttagtctgtagctagctcaagacaagtttccttgactctgaaaaacaaaataaggatcagcactgttgtaagcataaaccaaaaagattgctttagttttctattagttcagtccattctgttaactattgttctgcttgatatttgtaaacatttcagcttttcgtaagtcctgtacatttttctgttatgagaaacctgcatttgagagcacctgttaaagttccatagctgattataaactatttttttgaagaagattcaagcaagacaacaattgtctgtaaagacaaaatgtccaaggtggttacagtcaagaacatgattgacaaatgtgattatttccatgacttaaaataactcaacataacaaccttaattgcaattaacagcacatactctgggcctagaatcttggatatcccatacggttatcccatcagcctttattattatatggaaatcctgttgaagagagaaagttaaaatttcacccttgcattagtttactattaatttatttagcctcagtttttaatgaaacattgtaggcactcctattcaattttaaccagtttgaccatgaggtgagatttttgcaaacctgttataaccctttacaagttttgctaaagagcagattgggatcttaggaataccttgttgtgcttttatttcaatatttaatttacagaaaaaaacaaataccctttttaatttagttaatatgttcatacacagtttcctttgtaagattaagttttgcaatctttttcagtttgcttaaaccttccagtttatctaatttaagacagtcctttattcttaggcacaatgtacatttccttgctttcttataatcttttactaaaaacatattttactgtttttatataccttgcatgtagatctatttccagagtttcaattagatgtcaaaacggtaactctaggaatttttttttttttttttttgagacagagtctcgctctgttgaccaggctggagtatagtggcctgatcttggctcactgcaagctccacctccctggttcacattattcttctgcctcggcctcccgagtagctgggactacaggcgcccaccaccacacccggctaagtttttgtatttttagtagagacagggtttcaccatgttagccaggatggtcttgatctcctgacctcgtgatccgcctgcctcagcctaccaaagtgctgggattacaggcgtgagccactgtgcctggcccagaatgtttttatttttaaagatgaaagtcatgtgaactgaaaggtaccacaagcttttgctttttctttaaaagtatttaagtgcttatttacttaggccaattaattagaactctttttatagacatcacatacatatcacatacatgactacacagacagaagaagatccaacagcttagagtggagcccttttaagagcagtctaggaatacagtctcctgtgcctagtaaacaagcatagctggaagacaaagacagattagaaggacttaccacctctaattacaggggttgtatgaagaaaacagaaatttctccccaaatgagatgtgttgcaccttatctgttttctcaaggagtcctgggccaccagaagtcattctagggtctttcatgcatgcaccaagagtggcaagacagagtgaaaaaagttgactgaagaagaaccttttgcagaaaaacaagatctatgaaaagaaaaacaccagggccttttaaatacacccatagcttagagacccactttcaattaagttgagtgctctttaaaaaaattctttttcattaattaaaactttacagagaatgtaaatagtgattcttacttcttttaccagtttgcttcacttcctgttcacagtcatattcgggttcccagttttctctgggagaaaatggctggacttaggcaagggcaggttttcaactggacaggagatccctttagcagcgaagcttgatatttgaggaggcaatttgtctgttagccagaacctttccttggaggacagcagttcttctattttgtgtggggtggtaacagttaaattaggctgggcatggtggctcacacctgtaattccagcactttgggaggctgagacaggggcagatcacctgaggttaggagttcaagaccagcgtggccaatatagtgaaacctcatttctactaaaaatacaaaaaaatgagccgggcatggtggcacatgtctgtaatcccagctactcgagaagctgagacatgagaatggcttcaaccctgcaggccgaggttgcagtgagccgcactgcggcactccagtctgggcgacagagccagaccatgcatcaaaaaaaaaaaacagaaagaaaaaaaagttactccccatggttaacccattgacctctagcactagcaaggccacactgtaactgcttgcaggtgggctgaccatcctttagccaccaagttaagttccttgcttaagtaacccactggctgttgagccagacctcaagccttagttaaaaattctagggccattcctttctttcctgatacatagagactggatgctttccctgtgggaagactgagggctggtgttttaagtaaggcttattttagctggttaaaggctttttgagtctcagggtcccaagttgtgggggtgagttttaactgtttgagtttcttttatgaggtaatataaagggagagccatttccctgtactcaggtattcacagtctacaaaatctggtaatacctatgaatccccttaactagtaaagaaaatagactcaatcctttccttacctacttctctggtcctttctgttgagactagacctagtgactttactgaagtctgacagagctgagtgttagatttttagaccctatatccactttaagctaagagattgaggatagcctcagtgccttcctgagacatccttaattagggcacagaggagagggtcatttatacactgcaaagtttttacttgagggtgagaaaaactagatttttcaacagagtgtttcattaatttccttcccattttaggagctgcctgagtaataaaccagcagagaaggaggtgtgtttcactaaagcttttctcatcctttccaaaaatgctgaaggattttcatctagtttttgatctatcttggaaaccttagagcagttaataggtttggctctaatcccctgcaagtccttcagcatacacatttgtaaaagtttccatctccattttctgatgttatcatcatagtcccatttagagttctttaaggtcactggtacttttctcatggctttcccttccctggaacatccttcatggagaatttaaatacttggcttacatcctggaaggcctttatatgtgagtgaaattggggctttcccagagtgaactttagggtctgaggattaaaggagaaccagtctgcaatcaaggggattgcaggtgtgaggatggggtattatatatctagaaaagagacaagagaagaggcatccctcagtctcttcagtgacccagagtggagaggaagacagtgagagcagcacccccacccactgccaactgttttccctctttggttactgtgtcccagcaccatgttgaatgtgccacccccaaaccgtgataccagaggagcatagcagtggggttagtcatgcttacccatgtggccttagtgctctgctggtgataaccctttgacctcctagacttgtgtggtctgtgtgactccttgatggatgggtgtgtatagtatgctggtaagagttttagatttacttttttcatgtgaatattcagttgtccaaggagcatttgttaaaagattgttgggaatattgttcagcatctttgtcgaaaataagtcaatcatagatggaagtgtttacaagctttatgttctgtttcattgtttggatatatctgtcgtgaaaccagaattgcattgcattgatttgcagctttatagaacatttacaaattatgaagcgacagttcttcaattgtgttatcttttaagattgttttggctattctaggtcccttgaacttccatattggttttagcattagcttgttgatttttgcaaagacattagctggaattttgataaaccttattcagtttgtattgtactaccatcttaacagcattagtcttccaatcagggaacatacaatgtctttccatttatttagggatgtctttccgtttatttgggtctatcttacttttgttcagcaattttttttttttagttttcagttcaactgtgctaaagtgataccaaaagaattttttgtttttgttgtgaatataaatggaagttttcctaatttcattttggattttttaacatctaatgtaaagaaacatgtatcttgtatgtagaaatacagttgatatttgtttattgatcttgcatactgaaactctgttacatttctttcttgtagtagtttgttattgactcttaaatttttctatgtatggcatcatattgtttgcaatacagttagttttacttgttcttttccaattatataacttctccttctggcctgatttccctaacaagaacttctagtacaatgttaaaagtaatggtgagaacagtcatttttgtcttgtttctgattgtagttggcaagctttccatttttcagcataaaatacaatgtaaaaaggagggcttttgtagatgccttttattgggtttaggaagttctcttcaaatcctagtttattgagtatttttatcatgaaaggatattggattttattaactgtcttggtatatggagatgttacatgtgtttatgtcctattttacattagttgatttttgtatgttcagccaggtttatacttctcgaataaattatacttgtcttggtgtataatctttttttatatgtgttgcttcttaaactgcaataaacgatacttgttatgatctataatctttttatttgttgctggattttctttctgttttgtttaggacatttttaggtttttaagaaactgccaaactgttttccagaatgactaaccttattcatttctacccatagtttatgaatatgaataatccagtttctccacattctttctacattttggtattgacactattttttattttttattttttatttattttttttttttgagatcacaggagtctcactcactctttcgcccaagctggagtgtagtggcacaatcttggctcattgcaagctctgcctcccaggttcatgccattctcctgcctcagcttcccaagtagctgggactacaggtgcctgcaaccatgcctggctaattgttttatatttttttagtagtgacggggtttcgccatgttggccagggtggtctcaatctcctgacctcgtgatccgccagcctcagcctcccaaagtgctgggattacaggcgtgaaccaccgtgcccaccccagtgacactattttttaaacttgttttattctgacaggtgtgcagtgaaatcccattaatggttttaatttacattatcctaatgactaatgatgttgaagatctttcatatatttagtttctatgtggagtttttggtgaaatgcctttttatgttttttgttcatttgctaatttaagtttgttattactgagttctttatgtaatctagatgatagtcatttattagaaacacagttagcaaatattttcaaacagtctatagcatatctttttgtccgctttaacaggtgttttaccagttgagtttgtattctgatgaggtccgacttattttttcttagaaatcatgcttttttatgtcaaattctgagcacttattgcctacccataaatcctatttattcttatattgtttctctaaaagttttacttatgtcattcaggtctgatccagttgagtgatgctttcttgcattctttaggtgtgagacttagatctaaacttctttttcttctcccaggtattccagaaccattttgtgaaaggctgtctttcatttttaatttattatgttgctcttgtacctttttcagaaatcagttggtcacatttgtgtgggtttatttatacattttttgttttcttcattgatctttgttcctgtgcctcagaattgtgattactgcaagtacataatgtagtattaaaatcaggtagacagactcatcccagtttatctttttttcaaattatttagttgtttttaaattttgcttaccgtaaaaattttagataatctgatcttcattttagatatctgcttcccagtaataggagatacactgttttaaatagtagtacgtaaattctgtatatcggtttggggagaattttggcatggatttttgagccccagaatactatatacctcttcattgattcagacctttgaattatttattcacacatacaaaccttatacatgtttggttaaatttacagttaaatgtttatgtgtctggttttactttgagtaattgtgaatgtttttgatgctgtgtttatacatttattactactcctgtataggtttgatttttatatgtatattccatgtcctgcaatcgtgttaaagtccatgaggctttttttttctctttgaggatccttgcaattttcttttatatagaaaatcatacccctgcacgtaggaagaattttgcatcttccttctccttgtgtgtgcctgttacttctttttcttgcctcattatgttggttagaattgccagtataaagctcaatagaagtggctagagggagcaatttagtcttgctttgatctcatggtaagaaaactatcagtgtttcattgttaataacgttagcctggagcagtggctcacacctgtaatcccaacactttgtgaagttacggcaggaggattgcctcagcccaagagttagaagctacagtgagccaagatctcaccctgtctgttttagaacagaaaagcaagtacagagggaataatgttatctcccccttttttgtagatgccattaattggtttaagaaaattgcattccatttttgttctgagactctttgtcatgaatggatgttttgccaagtgtttttttctgtatctgttgctgtgatagtgagtttttttttttagacatggtctcactccgtcacccaggtgagagggcagtggcgtgatcacagttcactgcagctttgacttcccgggcccaagctatcctcctccctcagcgtcctgagtagctaggactaagggcacaccctaccacacgaagctaactttttttctaatttttatttttacagaagtggggtttcactgtcatgcccaggcttgtcctcccaaactttcgcctcctgtcactgggattacaggtgtgaacagccatgtacagcccagtttttcttttctacccttttaatgtggtggattacagtgattgttttttgattagttagttaggcctgtatccctggaataaaccatacttaatcatatatcattattattgtgtgtttttgactttccttttctaataattgttaaggaattttgcattcgtatttctgagggatgcagtctgtagttttctttgtaatgttcaggttttgcagtcagaacattacttactttataaaatattgggaagtgtttcttctttttttcctcactgaaactatctggtctggtgattattttggggagttttaacattacaaatttagtttttcataataattgttcttttaaaattgtttatattgattgagttcctgtaatttgtttttaagagatgtgatatattttgtctaggctgtcaaattatatattatttctagtgttccgtattgttttttgatgtcagcacagtctgcagtcatagctgttttattactgatgttagtaatttgtgtattacctttaataagattttgttttactcactgcgctagaagtttaattatacatccttttgaaaagacaagtctttgtttaattaattttctctgttgtttcttttaaagtttatggatttttgttaattctttagtgtgtcctttattctgctttcttcaagcttgtattgctctttttttgtagtttcctaaagtaggagttaagatgattcacttcagcatttcctcttatctgtgtgtttggtgttaggaactcccatcttccactatgtttaaatgttgcatattttatccaaattttgctttttttgacaagcatatatatgcaaacaggcttatgtatatgtatatatatatatgcctatatatatacatatataccagtataatatacatattataaatatatagatatacatgttgcgtgtgtgtgtgtgtgtgtgtgtgtgtatgtattccttccagacagggcctcaatctgttcgcccaggctggagtttagtggtacaatcacactcactgcagtctcagcctcccaggttcaagcaattctcccacctcaggcttcctgagtagctcagactataggtatgaatcactatgtccagctaatttttaaatttttttatagaaataagtctcactgtgttttttaggctgggactcaaacttgcttggccttaaactattgggctcaagtgattctccttccttggcctctcagagtggtggattacagtcatgagccaccatgcttagcctcaattatattaatttctgtgaagatgactctttgagaacatagaactaggacttgaacaacaattaataggaggttttcatgtcatcgtaatgtaattgatttatactttgattcctgtgtaattatatgattttcattcttaaatttcctgaggttggttttgtcactgaagaggtggtctatcttgtgtgttttcttttgtaggaactttgaaaataaggtttatcctgctgttgtgtggagtgttctataaatgtcagttaaatcctgttggttgatactttcgttgatatttttgcaaattttctgtgtagttctgtcgtttgtttagagagggttgttgatgtctctctaattatgattttgtctcttttgcctttgattatcttagtttttgcttcatatattttgcagtatacacattttggtgtatacatgtttagaactgctgtgtcgtgtcttgatgaagtgatcctttttcattgtttagtgacctatgacatttttttcttgtgctgaaatctattttaatctcattaaaatagcttttctactttcctttaatgtttgccggttttatctttttgcattcttttgctttcaacctgttttctttctttttttttttttttttaagagagggagttttgcttttgttgcctatgctggagtgtaatggcgcggtctccgctgactgcaacctccgcctcccaggttcaagcgattttcctgcctcagcctacgaagcagctgggattacagacgcctgccaccatgcccggctgatgtttctttatttttagtagagacaggatttctatattggtcaggctggtctctaactcccaacctcaggtgattcacccacctcagcctcccaaagtgctgagattacagccatgagccaccgcgcccagcctcacctgcctattttgttacacttaataatacaaagaatccctgctaccccttgctatcatatttttatgttctgcttattctcttctgtttttcatttctctgtgtttattttcctgccttctggagggttattggaatattttttaaatttctgtagcacattactgtgtctgtttatgtaactttaaaatctttgataattctaacatctgtcgtttttgtgttggcaccagtcaattcttttttcattcatgttgatgtcttcctgattcttgatatgtcaagtaatactcagtggaaacccagagatattcatatgttgtttgactcaaggaatattgaaacttctgttttccttgatttttgtctggcaacactcaggcaagggaagggagggatacccttggttgttaccacttggaagtagaactccaagttccctatactgtcttccttaacactcgaagggggtgttccttattactgctatgtgggggggaatttctgaccccctgtgtggtccacacttctaacttctaccatggtgggagtgatgttttttgcaacgggcagtgatgaaagttctgattctcttttaggcaccactccagcagaatcaggcaggtgctggctctttgttattgtcaagtggagttagaaatcccagctcactacttggccttctttatcttccatagaaaccccagctcactagttggccttctttatcttcccacagattttggcatgcttggttacagccttaagaactttagggttttcactcaactttttgtggtatgcatggggagtgagtcatagttctttctatagtttttgcttggagtaggacatttattttctaagttttcaatttgcatgtttcctgatccataggctataggggtggctgtggggagggagggtgcttttcttatctgcacctactaatgttggcaggttgctagatcttttagcttcaaatctggaatatatgaaataaaagaaaattctgggaattcactaccttcttgttccttatatttagaagtctctgtgaggtctacattcttctctttacttttcagggactattttcttccctattcttttcagactccaaagttcgtgttatgtataatgtccaggagttttggttgtatttaatgggaagaataatgaaacatctgttttaccttcacaaatcaaaatgatcttaattcttttcagtgagcattttatctcctacatgtagacagcatttgttcatcatttctttgtaagttggaggtttttgttgtttggattttttggtctgtaacataatttctaataaacatttttcacctcttatgtttgctttttgttgtaaaatgtttaatgaggattacttaatcatctgctctctttatgtataacagcatttttgtgtcaggtatcctttgttattttttaattacgtaattttcaagttaaaagtaacaaagtttatattggaaatagaggctctttttcctggagttgcaattactttgtctcgcgagtactattttgtttcctctactaacacctttgttcagatatgctcttggggtgtgtgtgtgtgcgcacacgcccctgtgtgtatgtgatgaatgtagtttattcaaagacttaaagcagtggttaatgtaaacaaacgtaataaattatgtggtatttatatcatttaaatactttctttaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggtatgggagtgtttctttgttcagttttctgactttccttcacaagtaggataacttagttacaagatgattccagttttttctatcattttatttatttatttttgagacagagtctcgctctgtgtcccaggctggagtgcagtggcgcgatctcggcttactgcaagctccgcctctcgggttcatgccattctcctgcctcagcctccccagtagctgggactacaggcgcccgccaccacgcctggctaattttttgtatttttagtagagacgggctttcaccgtgttagccaggattgtatcgacctcctgacttcatgatccacccacctcagccccacaaagtgctgggattacaggcgtcagccaccgcacccagcctgccattttttatttctaaagtaatctcgaggaattggcatactattgtcgtataagcctggctacccgttctccacccttgggttttccagccagattttatatatcattcactaagcatttttgcctcactgagacaaagatgttaataggtagaacatattacattcatattgtaactaaatatgtagtgctaatacagatcataaagatttaaaagcactaagtgactttagatgtataagggtaattacattttatttgctagtaagaagttagtaagattaacagaacatattggcttccctatcagcaaatcacaacagcttcccaatgtttaaccgatgtgccttatgctacaaattttaagtattaaaacttcacaaaactcaatgaaatgcagtagccaccattcagacaaatgttttaaaatcatactaactgtaaatgtgctggtatttgggaactgtgtcttggtacaggtatttctgaatcatggaacattaaatttatagaagcgccttacattttggtgttttctttataacttcaaaataatatatttagagcattttgtttgaactcttttacaattacatcataaatttggtgatgctaggtttagaaggtttcctattttataagtctcaaaataattttgaaggtagaattacattgagtattgatccacttacagtataaatttttttcatgtataaggatcgagatgcacagaagatccagtggatagatcactttatagaagaacttcgcacaaatgacaagtgggtaattcctgctctgaaacaaataagagaaatttgtagtttgtttggtgaagcatctcaaaatttgaggtaagacttttttaatagagaattttcttatttttatctgtatattatgttggaaatggtgtatgaaagcaaattttaaagaaagaaaaccatggtgggaaaacaagaaatttctaagagtttgtttacaacaaaataaggatacttgatgatattcaacttttttgtattttatgacacagataggtaagtgatatatccaatactaaatagcaattaagtatcatagcgacattaccgcctttcaggtcttagttcagaattgtctctgacttccagcagatgtatcagatattatgccatgtgttgtatttatcttactcctcattttactctatcctttccacggttaactctgtcttggctcaatattccttgtagttacaaatagtattatttgttatttatttaattgatttaatctaacatttttaacatttgtaggggggaacacctctttcttgagttttaaaaattagactacaaagtgatttaaattataaaacatgacaagactgtttaaagatttttttactcataatttattttagctagattttctttaattttaaatgtttggtgttatatgttaaattgtggttatttaaataatttattttattttattgtaacatattgaaaattaatgaaataaaaggaaaaataacatggagaaacctgtgttagttgaagaaaattctcagtgcagttaggattcccagtgatgaactccaggcttatctaactagctgtaatcttagaaagattctctcatgggtgctgcggctcatgcctgtaatcctagcactttgcgaggctgaggcaggtggatcacttgaggtcaggagttcaagaccagcctcaccaacatggtgaaaccccgtctctactaaaaatacaagaaattagctgggcgtggtgacgggcacttataatcccagctacttgggaggctgaggcaggagaattgcttgaacctgggaggctgaggttgcagtgagccgaaattgcacccttgtattccagcctgggcaacatgggcaaaactctgtctcaaaaaaaaaaaaagattgtctcatggtgtatggacatttgtcttgtgtatcagatgacgattaatcaagatgctttatagcttagattgatataattatgccccaaagagagtttttgtgttgatagaagcttaaaatgctatttatgttttgtgattttttttcaagttgacttttgactctatttttctaacgttggaaatattacaggaaatttgaaagtttcatgggaataaacactggaaaaaatacttatgaaggacacattttgattatttctctatctatatcgtttgtcttttatcagacttatctatttactatagatagatgcagtacatacacttttttaagactggtgacctcattaccagtagattagtaacgattgtgagttgattggtttcgtcaataatgacaaactaggaaggaaaagagaactatgtattttttgtgataaccccaggtagaagggtgtgaactcattgttccagaatgtacctggatgtctgatattcttcatcatgcaacacatgtgctttgatactaatagatactttttatttttaaataagaatactgaaatggatatttggttggaggcatggattatattttttacagggtttgatattttgttaaggggaggatattgaccacattttgttaagaatgtatagcattaaaaatttttaaagtagtagctagaatttagcttctgtaaactctcttaattatagcaattttcatgtgccttattatactgttaagttcttcttatttcagtcaaactcagcgaagtccccacatattttatcgccatgatttaatcaaccagcttcaacaaaatcatgctttagttactttggtagcagaaaaccttgcaacctacatgaatagcatcagattgtatgctggaggtatgtatgataagctaaaattaactatggggaatcaactttgttttgctctaaatgttaataacctaagaaataacaacatttatttttgaatgagaaaaaatagaagtggatttatacttcatattgcattcacttaaggaatatgatctacttggtatcccaaatcttaggcaacctaaactctaggccacctttcccagtgtctttattaaatgcatgtctacttactcatccttcttcttggtatcttttctttcatacctgggagctctgcctgttagtatctatggtaggttataattctcttgggtctctttggtgtgtactcaagtcattacgcttttgctctttttttgaggggaacggagtctcactctgtggcccaggccaaagtgcagtggtacagtctaagttcattgcagcatctgcttctccggcccaagtgatcctcccacctcagtctcctgagtagctaggaccacaggcacccaccactatgccctgctgtttcatatttttagcagagacagggtttcgccatgttgaccgggctgatcttgaactcctgggctcaagtgttcctcctgccttggcctcccagagtgctgggattacaggctgagccaccatgcccagcttaatttgttattaattttgcctgattctgttattacatatattatagttcttaataattctgaaatattgttatccattgtttaaagagcttattagaaattcattggatttgttatcactagatgtgtcgttggttcttagactatgaaatattttaaaactgtttcttgtattatacttctcaacagtcttttcgtatatgctatgtggagatctatcttggcatgttgaaggttaatttgaatgttatttgtactcttaacagttttaatacattttgtgtgctggagcacacagtaggctttctacatgtatagttgtatgcccctttccccaaaagttcataaaacatctgcgtcccaaatcaaccacttcacaggcccaatttttatgattatagaggagacaaacttttattgtcccatgttgaagccaagatttaccataatgttggactgaaattgctgcttaattgatacgctacattagtatctgtggaattcaatcatatatgttgaaaatgtggatatttgtattattaactgtttgaaaagcatagtagagtcttggtatggttgagtttgtaaaattcctcaagtttttgcttaatgcttccttttaaagtcacataaaataatagaaaacttaagtaacttccagttacctctaattatttcattggcttctgttcctctcacattttacccactctttttacccttgttgtagaactataaaagcaatctgagcatcaggtgctgcctgcatttcaatcctgccagtcaggttcagaagctcgaagacaaaagtggtatgacaggcaagcccatataggcatgtaaccaagcttgctggcccctttctttatcaagagcagctaaaaccagtgaaagcaacataaaatttgcatatcgttctcttaaattctgtatcacctcaagccttgcttgtaccttcttgaaggtacaaaggctctcccagatgccaatgaagaccctccccaaaagtgatcacaactagatacttaactccaatgataattttattcattttgggtggttttgtctgtaattgtaatgttatcgtcaacaattgaagacctaatttccaattcagtcaagaggaaaggcataggtgcattccagcctcactagggtgctctgtttatttgttcaaattctagttgagttcttgactgatgtcttatgatcatgagtcaagaaatgaagaaattccacattctcatgttcatattatttgtttataaagttgaagttggaatgtaggctttatagttaaactgctataaagtttatatagttaaatacacaattagatttatatagtttatatagttgaacctacctccaactgagtgacttgcaaagtacttaagtcttctgtgattaagatttaccaaatttgtaaaacaagaataacagtagtatatacctactttataaatgagttaatactttctagaacatagtatttgccagaatgttacctgtatacagcacatgcttgaacactttctgtaattatacagtcccctgaattcattgattatgttttctagaactaatcatttacctttaatattttccatttctgagtaatgttgctcattctgagtaatgttgctgaataatgtcagtttgttcttaaatatagggacacaatttctctcactaaaacttttatatgattaggattatataaaccaataccaacaaaaactatggtgattgcatcttagaaatttcttcaagcataggatgtaatatgcaaatagatttgaagttcttacagttcactaatgttttcttagtttctgataatcatttcattagtctgtattctgactatatacgatactactagttgtttatttttgtaaaaacatttcaccagtggcatggtcagctaatttcatgttattttagataacaaagtaacattaaaattttacttatggcaaaaatgagtacccttgtctcactacttgaatttagccaggaatacttcctgaatgacatttttcaaaaacctttatgtgcatcaacaaactatcaaccactttgtttatctcattgaaaggatggtatttgtgatgatttacttacaagagtattatatgtcatttttcctgatttctgaataaaatttgtaggatttacactagttacagggcacattactgttcaagaaaatgtctttttctaagaattgtcatttaaatgtcttctgttctttctactttcattatgacacttgattcttttggggacaagttgccgcaggaaaaaagtctcttcacaagtgtcactcagcaacaatgtcagtgctaaatgcagaatctggctttgattcagtcactaattctacctcattttctttgtgttttttttttttttttttttttttttttgaggcaggttcctactgtctgacccaggctgcagtgcagcagtatgatctctgctcactacagcttctgcctcccaggttcaagtgattctcctgtctcagcctcccaagtagctgagattagaggcatgagccaccatgcctggctaatttttgtatttttattagagacaaagtttcatcctgttggtaaggctggtcttgaactcctggcctcaagtaatctgcctgccttggcctcccaaagtgctgggattacagatgtgagctactgtgcctgtccttacctcatttttgcatgccagctatgaagtactattaaatcttcagtgtgggtttttctgatctaaaaaatattttgaactgaagtgattaatttcatgaagtttgtatctctttgacaatgtaggctttgtactggaaagtacaggatgaactttaaacatcctactgtgccagaaattgtaaaaagtttttagaaaatcatattgacatatcaaaaagacataggatttgcctctcagtagtcaaatctgtgacaatttgggcatcaaaataattatacttatgacataactgctttacaatatgagtcctttatgttgattaaaataaatggagaacaatgccaacgaaacataggaaaaaaacaatagatgataaaagaagtagctgaaagtctaataagaaacagattactgactcagtgtcaaagtatcctcccagaagtttatacaaagagaaaaatactaacttttcagtggagaaacgtggcagaaacaccttaaataagtgatctaagttaaaacataattaataaaggacacactgacatggcttctgataatatgtgaaatgaacataggatatttttggggtattttgttcaaatcattgcaaaacctgaatctatggaaaatacagaatgcaaattgagtggtgtaagtggctttattcttaaaatggttaaaataaagaaacacagaaaagataaaaggaaactttaggtaaaagaaagctacttgtagtatatgagccagagttttattctagacttgcagaaaagaaagcataaagtgatgacattattggtacacttcattaagtttctaaatgcaccatggatctgatagcagtcttatttggagtcttaaaacctggtaaatatactgtggttatgaaaaatgttacgtgattgatccttgaacaacacagggttaggggccaccctacaaagtcagacaccccacaaagtcagaaaatccatgtgtaacttttgtaggggacaccctacaaagtcagaaaatccatgtgtaacttttgactccctcagaatttaattactaatagcatactgttaactggaaagtattaatgataaccaaaacagctgattaaaacatattttatatattcatgcatattgtacactatattacaattaagtaagctagaaaaacaagatgtcactgagaatattgtaagaaagaaaataacctctactgtttattaagtggtagtgcatcaccctgaaggccttcatcctggttgtcttcacattgagcaggctgaggacaaggaggaagaggaagtgttggtcttgctgtctcaggggtgtcagttgaggaagaaatggaatgcgaggcaggaaaggcaggcacactcgtgtaactttagggaaatattatttctggctgatgtttttgctttgtcatgtttcaaaaaatgtttctatacaacaggggtcccaaacccctaggccaaggaccatgattggtccctggcctgttaagaactgggccacacagcaggaagtgaacagcaggtgagagagcattagctcctgagtcttgcctcctgtcagatcagtggtggcattagattctgataggagcgggaaccctattgtaaactgcacatgcgagctctctaggttgagtggtcattgcacttgatgcctgatgatcttatgtggaacggtttcatcccaaaaccatccccacccagtctgtggaaaaatttcttccaagaaacttgtccctggtgccaaaaaggttggggactgctgcggtatagtactaatccatcctgcaccatttgctgtagtttcagcacctgtattatggaagtccatgtcataaaagaaggcaaaagcagtctttagtgatcagaatcctctgccagcttgtttaatgtcagtttgttttctgtcagtgcttctactacttcctcattgtctgccactggttcagaagcattcatttccattaagttgtcttgtgtcttaattccttggtgtagtgtctattagctcttgaatttgtccaagattcatatcattaaaccgttaacccatccggtttttgctgtttgcatgatctctttcatgcgattaccttaatgagctctgttgtaaatcctgggaagtcatgtacaacatctggacatagttttgaatgtgttgtttccagcctgagggctttcatcatcttttctgttaaaatgatggcatctgcagtggtgtaatccttccacattttcatgatcttctctctgttagggttctgttacacagtattcacagtcctttctagagagtaccatgtgtaatgagccttaaagttccttatgacttgctgatctagaggctgaattagagacgtgtttggaggcaagcagaccacattgatgcctttgcccagaggcattgtctaatttcaaaaagaacattaaaaggcacccattactggcaaggtacttcctgacttcagggacaaagctctgatggaaccaacccagagaaagggttcttctacttgtcaagccttcttgttgtgcaaccacaagactggcagctggtgtttatcttttcctttcaaggtggagcattaacactttataggaaaagagccatcctgatcattagcctgactgcatctacagttagcatactctttcctgccttaaatcttagtacttgcctgtttcttactaacaaatgtcctctgtgccttttttttcttccagaatagggcactttcatctgcattaaaagtctgttgaggcagagatcttttctcaatagtttttacgaatgccatctgggaactcaactgctgcctcttgcttggcaaaagctgcttctcctgttatcttgatatttttaaagacaaaccactttctgaaattatcacatcatcctaagctggcagttcttcagtttcaaatccttcaccttcctttttgctgggtctgacccgcagactctggccaagcgacggatgagaaaatgtacgcagacacaggttttttttgcctgggcacacggctaggggactgaccgctcacagacacccaggaaggtgctgtaaagagtcacagcagttgcagccctgagaagtgggcatttatttaatacacatttaatgacaaaggctttcagtcaacacaacttgtgggtatttacctggagagagcagtcctgcacgcacatgattaaaggccaggttctgaggcctaagtaaacttaacttacctagatcaattcctttacacttccttgttatctaccttttgctctcaggctctggataagagaatttggctgccttcagccaaattatctttcaaagcttttgcaaaacctcccagccttccaagaaggtttgcatcttttcctataatttcttcttataatttctcccactaccctgaccgaactcctacaccttttgctttaagttgtcatatgactttgatttttcccgttagattagtctataagtgtgccttttttatagcagtcttactcaaaaaaactgcattttcaatacaaaattgaagatatttcacaaaagtgcaaagtttgtttctattgtcatagatgcaatgacagcttcatgaagagtgtgtgtatctgtgtgtgtgtgtgtgtgtgtgtgtgtgtgtgtttacaatcgtccttacactgaattcatttatcgtgaaatggtgggcagtcatggttgcagaactcagtctgcaatgcatatcaaacaattcagctttttcttgtgatatcatgattttcactattttgggggaagcacatcatttaggtcctctggtgtcattcattgtttccattattgcactaaacacaaaaaatacatgagaactgcaagagatttttttttttgagacagagtctcactctgtcgcttaggctggagtgcagtggcacaatctcagctcagtgccacctctaccatctgggttcaagtgattctcctgcgtcagccttctgagtatctgggattacaggcatgctgcaccatgcccagctaatttttgtatttttagtagagacacggtttcaccatgttggtcaggctggtctcaaactcctgacctcatgatcctcccttcttggcctcccaaagtgctgggattatgggattacaggcatgagccaccatgcccagccaagagattactttttaccatgatacataatttactgaagagactaactgctcactcaggagtttagaatcacacagcattttaagtatactcagcaacactggagctcactgaaataaacatattttaagtattcatgacatttcattttttctaaatttttttttttttttttgagactgagtctcactgtcacccaagctggagtgcagtggcaccatgtcagctcactgcaaccttcatctgctgggttcaagcagttctcctgcctcagccttgtgagtagctgggattaggtgcccaccaccatgcccagctaattcttatatttttaatagagatgggctttcactgtgttgaccaggcttgtcttgaactcctaacctcaggtgatgtgtctgccttggccttgcaaagtgctgggattacaggcgttagccactgtacccggccttttcttattttttttttcaatatttctaagctatgttgttcatctgttttctctaattgtcacaaattttctaaaaattttccaatactcatcatttatgttaaaagatccatatatattaatgagtagaccagtgcagttcaagcccatgttgttcaggggtcaactgtacttgttactgggaaataaacataactttaaggaataaaattaggtgatgtgtccagcttaccttcaaatggttcattaaaatgacatatacatataaacagagatacctgtaaaaacaaataggcaacatctaaacagttgatatatctggataaacagtagttcattgtattatttttgcacctcgtctataaatttgaaattacattaaaatgtaaagtcatacacataaaccaaccccatgccacacactccccctcaagaaaaaaaaaatagcttttagttcaaagtgtataggggatgaaaaagtacctcgagtgccagtctgatgtttaaacagatgtttcagtatcagtggtcggaaaaacaagaaaacatatatgcaactgaaagtctttttatattattgtgccagatttttaaagaaaacttgaggttctgagatttggtgcaatctgtcagtctcatggaagtaagctgtacgtttctacaacagttagcaggtgttcctgtatatagaagtaaaaagccacgagtcaaaatatgtgagatttctttcttcactaaatagtgcacattctaaacattctattccatctttattgcaagtcaagattttgcttctaattgaagaacgttttttggcaccaagtgtgaacgttacaaggtccaagagatgtatacctgagaaatacctgtgtctgttgcagaagaaaaacaacatatttcctcccatactatgtttaaaagtttcgggataaaggtctttcattcctgacaacacttggtattggcatgtatttcaactgtcttctgtttaatctcgcaaacagtcattttcaggcatatggtttttatcgtattcttctaatgcttttcttctgttacttttattttgctaggtattgggataagccaccttagggcacttttctttaaaagcatggcttttgtgttggagtaaattcatattttagttgagtgttaccttttgaataagtgtgtgtgtgtgtgtgtgtgtgtatgtgtgtttgagatggaatcttgctctatcacctaggctggagtgcagtggagcaatcttggctcactgcaacctctgcctcccatgttcaagtgatttccctgcctcagcctcctgagtagctgggactacaggcgtgtgccaccacacccggctaatgttatatattttagtagagaccatgttggctaggatggtctcgatcttctgaccttgtgatctgcctgcctctgcctagcaaagtgctaggattacaggcgtgagccaccgtgcctagccaggacagtagctttgaacttaatctttgctgtttaaaatgtatttacaggtcaggcatggtatctcacgcctataatcccagcactttgggaggccaaggcaggaagatcatgaggtcaagagatcaagaccatcctggccaacatgatgaaaccccgtctttactaaaaatacaaaaattatctgggcatggtggtgtgcacctgtagctccagctacttgagaggctgaggcaggagaatcacttgaatccgggagacaaaggttgcagtgagtcaagatcgcaccactgcactccatcctggcaacagagcgagactccatctcaaaaaaaaaaattctttacaaacactgagattttcacccagtagatgatgttaataaagtaaataaaaagcatttaccaattttatattaaaaaataaagatttctgacataggctaggcctggtttccaacacaagtatttataatcataatgacaaggtaggtttttcagagtatctgagactgtttgagccagttcataccctggtgattgagatactcatatgataactttataaaatacagcattttctctcatcttaatttttttgagtgaataaagaagtgatatttttaatgttgaaatactttgcctacaaagaaggaaggaaatattttgcctacaaagaaggaaggaaaatggaaacatgatggtaaaaaaatcgtaggctgtactcacaaattgcgccagtgtgtgtgatgaatgaagggggaattaagactaaaaaaatatttttgataacgtgttcagcaagttatatttttctttgtgtaaaaagtgactgtatttttgtgggagtaaagggtttaaataaacataccataattacaagtttccgttaatgagaatgattattaacttaataatttctttttacctaagtcaataatgttgtggatatacatgtgtataatgcataattttggtttatttgcagatcatgaagactatgatccacaaacagtgaggcttggaagtcgatacagtcatgttcaagaagttcaagaacgactaaacttccttaggtttgttttaaaccatcagtgctattcttttaaggcactgcagtgataaggaatgcagggttattctgtatttattttttctttttgagacaggatctcattctgtcattcaggctcaagtgcagtggggcaatctaggctcactgaagcctcaacctctccaggaggtgatcttcccacttcagcctcctgagtggcttgtgaatattttaacaatgatagagacaaaagcaacctctaactatgtataataacattactttaaatgggataagtaaagttgtctgtcctttaagccaaacctatgttccaaactgaatttactcagtaatacatagcttttaatgacatgtatttttttatgtatgtatagcttgagtattgagagatctcttagaaatgcagtttaccatactattgcaagaaaagtatttgaataagtatactaagaaaagttgccagaactatttatcagtgttttataaaatttactgaattcattgtttctctctattaattctgggattagttttctttttacagagcatgtaattctgtttgctgatcaatcagataatttatgggacaatatttatttgacataaagtctgtttttttttttattcagtcagttcataactattgaggattttacggtctgccagatagatctcatctttattataggatttcagtttgcaaaatattctagtatcaggttttctgacacttgtagtaccttttttttaaccacatagaaaaacaatctgcctcttaatattgagtatctcttccaaagtgagccattgtttttggtaaatgtgttccttaggtttattgggttggaaaaattagttagaatttattcattctattagtaaagtttagaatcagatgaccttccagagttcatattacagtactacagttaatcaaagggggaagctataagagctaatgccggctgtatatatttggccttgtgctaatcactttactcatcatgacagccttgtgaggcaggtgttaactcctcattgggattccatttggggaaaacaaagtgctttgaaatcacacagctggtatgtgatagagaccagattacccatatagaagtttttaaaagtgtctgccctatgacaccagtgaattttcagacatttacactgaaacgttagtttacaaactgctgtgtttcatcttgctggatctcttgttgctcatttataaattaggatgagagagattaggtagatttaatctaggtggtcccttcatgctcagcactcttacagagatattaacaacttaaaattaagatccaggccaggcgtggtggctcacacctgtaatcccagcactttgggaggccgaggtgggcggattacctgaggtcaggagttcaagatcagccaggccaacatggtgaaactgggtctctactaaaaatacaaaaattagctgggtgtggtggcacacgcctgtaatcccagctactcaggaggctgaggcaggagaattgcttgagcccgggaggcagaggttgctgtgagccaagattgtgccactacactccagactggccaacagagtgagagtctgtctgaaaaaaaaaaaaaaaaaaaaaaaaaagatccagaagaagaaaccttctgctattaaataaaaacaccacactctttttggaataaagccactgtcattttgttaactaagtgtgaagttattattcaaattaaaataaacttatttttcctttcattgtcattcacagaaatagtagacagagtgggtggaagagtgctaagagaaagtggaagccaaccaaataaagagactgcttaaagcagactaatcattgttttattgtagtgaactaataaatagtgaaacaactaaaaagctcgaggacatcactgaggacacactaatgattacagagatagacataatttttaattactggtggattttttgtttcatatggctagttatgagtgcaatattttcagaaatgtaagcagtttaagccgctttaaattcatggtgatatttagttatctctgaaagtcatttagtgtaataaccttattttgcaatgatataatttaagggagagctaaatcagtattgggtttcagaaggagagctgaaaatgaggagaagtcttcttacttagggcacatcacccagcaaagttgctggcattttgtagctgcctcatatatatttgttaaacaaatgtgaatacctgacacattttaaattccagatatgtgtttaacaaattattttgaaagaattcatatttttaaagctgtaattaaaatataattgtggtgaagtattatgttgtgcctgtcaaaacttgctttgcaggaaaaaactatgttgaccctaattactgatttatgtttctccaagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggtaagtgagtagtaagaactttcatatgccaacattgtacctgaggttactttttaaaaataattcaagagtcataattttgcctgagaatttcatggctatattctgttttgatgcttgtcctagaaatctaggtgtgcaaggataattgctcttctttaccttcttatattttattcattactggttttttctctcaccctgttgtactaacttagaatctgtcacccttttcagatgtatagaattatagtaggctgggtgcggtgtctcatgcctgtaatcccagcactttgggaggccgaggcaggcagatcacaaggtcaggagacggagaccatcctggctaacacggtgaaaccccgtctctgctaaacatacaaaaacaaaattatccgggcgtggtggtaggttcctttagtcccagctacttgagaggctgaggccaggagaatgatgtgaacctgggaggcagagcttgcagtgagttgagattgcgccactgtactccagcctgaggacagagcgagactccgtctcaaaaaaaaaaaaaaaaaaaaagaattatagtaaccctctacatgctgactacatcttctattctcccctcctttgtgaaagttattctctcttttttatataagatagatcttgaagtttatatgtatttgatgctgacatgaacgatggacagaagactattactaggatatcattatgaatcaatacctttattgatattgttcactttgtatatatttaaatagctggaataaatgttgcatgctcataaagctaactttcccatattaatagtgtaatatatcttgttgccatcttgatatatctaatctgttgtgtcacagcttatatttgggttttattatttacttattctctggacaaactttatgtaaactgagaagttgctacggtgttccattaaaaccagtggtttttgaaacattttaactagtagtaactcctatcaattaaaaaactatatacaggtagtggaagtaagagaggaaagcttgcatttctttgcttagtttcccattattcatttcctttctgtcttcaaactccccaaattttcattcctgaaatactctaaggtgcaaggattctaaacttagtttgaaaaacactgatttattaaatgattggtaaagatttacaaaaattgctggggccagcaggacagctctatgttaaatagtatttctcgcacctttttttttttagcatacttgaattaacccttgaaaacctatcagcttgactaacaagttgacaagttaaatattatcacttgaagtatttgtgtctttcattcttaagcaaacggctttgttcagaaaacttgtattttttattaatctttgaattcttaagatcccttattgtatattaagtatcaatcaacttatctttaagttattgaagattatattaaaaataattaaggatatgatttaaatttaaataccaaattaaactgtatcttgaatggttttaatactgtaatatttttggaaccaggttgtgattcagagtagtgacgagattgctaacagagctatagatcttcttaaagagatatacacaaaccttggcccaagattaaaagccaatcaggtgagaattgaagtgcttaaaaagatccacaacaattgggttaagttgttgggtagtatcttttttaacctgaaaataactagaaaataatctttaactcttgtcaaaaatattttttcagtgtttaatccacttttctcccttgcccaatgctgactaaagaaatgtttctttgataattatccttaggtgattgaaataattttaaatgtaattattcattatcgtacgttgagatggccagaactttgtcttagattggccttttgtctaggcatttgtttttttttgtctttttgagattcctgtctgtcacccaggctggaatgcagtggtgcagccacaactcagctacagcctggaactcccaggctcaagctatctccctgcctctgattataggcgcacaccaccgcaccagctaattttttttttcattcttcttgttagagatgagacctcactatgttgccagagctagtgtctaactcctgggctcatgctatcgtccctcttcagcctcccaaagtgctgggtttacaggcatgagccacatgtgcccgactggacattcactttttttttttttttttgagatggagtttcactcttcttgcccaggttagagttcaatggcgggatcttggctgtctgaacctccgcctcccaggttcaagcaattctcctgcctcagctttccgagtagctgggattacaggcgcctgccacaacacctggctaattttgtatttttttagtagagacggtttcaccatgttggtgaggctgatcttgaacacctgacctcaggtgatccacctgcctcggcctcccaaagagctgggattacaggcgtgagccaccacacctggccaacattcactttttaaaaacaaaattggtttatacttgctagtttcacgtaatcagtttccttttcaggaaacttgtgttttactactgggtaaatatgactatgattgagttacctttaaattgacattttactgctttttattagattgatgtcacatttcatttgtaaacaacctggattatctgtatttgtccattatttataggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattctacctatgtcgaggtttgtgtgaagttgatctctagtgttaatttacaattacttaatattttcttagaaatttacttaggaaagtaataataggttaaaaggaaagtgggggatattcttatttctgaattccaatattctcacctttaaaaacagctatatcttttttaaaaaagatgctttttgatagggtacatttttattttgatttatattttggtaaggtatttcactccttagttaacagtgtctcttttatttttccaagttgttatcattccttaagtgtgatagagttattttgcatttgatggtttttttatttgaacgttcttaaaaataaaattaagaactgcttattaagccagtatgagaaggaatatttttaaatggtgtttgctaaaattcctttaaatttaaaaactaattaccataaaataattagatgatctaatagtcagatattaatataatcataaattatatccaaattctatagcatgtgatacgaataataatcatataactaaatcatataagtataactaaagtcagttacttattaacaatttaatggcaattacagttttggggaaagtttacagaatgagcacaatcacgttttttaaaagtctgattccactttcttaactgaaaaaatgtaaaattgctttttaatactgtttattttgcatcttacctatcagaagagaataaagtaagcaagattataccaagataaatattttggggtatattttgacagaaatgtgcattttagcatttttgttgatatgttcaagccgaaactcatattccgtgtttgaaaatagtcttagtgagttgagttttgtggcatgaaaataactgaagcattattcatgtctgttgtgatctatcataagtaggaagctttttttcagccttcacagagataagattaacaacagaatttgattattgcatttccaagattgtgatgtttgttcactgtttaaaagaagcatggtgttctaaagatcctaaatacaaaataagttgttttaactgtcatcctctgacttaataataaaatattaaattttcagggttttttttagcagtctgctgaatatcattgtggttttttctttttttaaaattctttttatttacttatttatttttcagagcatttcgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctgtaagtaaatacagcttttaaataagtcatgaaacttaaatgttgaggctatattagtaagcctcaacatttattattaacgtattatttagtaaatgtctgttgggcatctaactattatgtacaaacttctgtgttggtatctagattataatcaccttgaataagatagatgtcacagaacttaaaggaaatacaattaaatggttatgttagacagtaatttttaaatgtatttctaaaattaaagcctaaggtgtattttaacctttcaatgtatctagttcccattacttgtagaaatgttttgccttgtctttgctaataaacacactgttattttcagctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtggtgagtaattctctattcaaaatatgaagaaatgtgtagaatagttctttttctgaggagcttcatagatttatagagattcataaatgggtcaaaatgtcaacggtatagtcaactgttaacttctgagtgaatttcttagttgtaggaatttataataaaattatgtaggtagaattaatctgttatagcttacgtatggtattaaatatatagctctagaaggtactactatattttcagtcttttaggatagttttaaagaaaaataggatgtattattttctatgattcttagaaatacatctcatatgtaaaggaacaacagcttctacctttcttagcctttccctcagcctcttaaaaattatgcctacaattataccagtcacttcagcattagggaggtttaagtctctgaaaaaattggattaggaatttaattcctgagggagtgaggtgccttttgtataatcagcatctgagtactatgtgaaactacagtttacaaaaaaatcgaaaaactgttgcaatgaaattactcaaagtatattagaaagcttaatatgtaatgtataaatttgcatgttgaatcaatggatttatcaatgtaaaaatagtcatttggggtggtataaatggtatatccagaaatgtgattgaccaatagaaaccttatttgaaggatagagagtggataaattttcattaacaaaaaactttttgtagcacaatttgcaggtaaatattttgtatattctgtattctagataatgtcagtgcatcccagatacatctctttcctttggcaagttgcagacttaggtagcaacctgaatatgccacctcttagagatggagcaagagtacttatgaaacttatgccaccaggtaagaaaatggtccatccccctattccacagaaaggatgctcataactacatgatggatgaaaaagaaaatattaacaaattctgtttgcaaatctaatatactttgtggaatagtctctaatgttgaacatgtgtctttcatagtgttgctgatgaaaatattttcatggatgggaaaatatttaggagcatgtaattttcatgaaatacttctagaaaactaatacttcagaaagtcagggttctttcaaggctcccagtgatgaacaacagtctcctacctcatccatctatcaaagaaaactcaccctcaaggtttacctttcattactggatataccactttttttctaagcactatgcccatgctatttttgtgtgtcaggttttagacattaagtattgacttgtgaaaatgtatttcttatgcgttaccgcatccttactctctggtcatgtcacagtttttgtttaaatctatatgcattgttcacatttttaacacaatgtgaaaatactacaatctcctaagttactcacacatgattatactagattttaatattgcctttatcatttgcttggttttcttggtgttaattactaaattttctcatactccttccagtaatttcctacaacaattgttcatgtggtcagatctgttatatcatgttttcttggagcatttcatcttcctgctgccttgtgctttgttctctttgacacagctatcattctgggacttctgtatacagcctttcctttggtggtcttctggtgctccttggtcttgcatctttcttgagttaatcttcattttgccgaagcacaccctcctaaaaatcgatacatggaaaacaagatttttttgttaagacattacttttctgaatgcacctaaactctcccacatgcagtagtttattatttggttgttttgtttttttctatttttttacttggagttggttgaacatagagctgaaagtagaacatctgcagtttcatggcaatattggctgctgggaggactgaacctgttgtgtcttaactttctgtctagaagctttgtttttaactctttagttctgaaatctaatgatgaagtgccttggaatggtagttttactttgatttttttgttgtttgttgtgtgtactaagtaatcaacagatcttgttagttgaaagagtagtttcttcagctgtgagaaattggtatttttgtataaatagcatctgattttgaacttactgtcattaaatggcttgtatttcttggcctacaaatgagccattttccagctccaagactaaattggccatttacctgatcactgatttcttttagtgtaacatgttccatagaagataaaatatgggctctctaacatataaataaaatctaccatatgtatatgtctatagatgtgccttggagatactgtggtttccattaccataccaccacaataaagtgtacctctcaataaatcaagtcagacaagtttctttgtatcccggtgcgcataaaagttttttacactagtataaaactaaaagttttatacactatacacataaaagttttttacactataaatgtgcaatggcattatatcttttttaaaaggtatacagcaattaaaaatacattattgctaaaaaatagtaactatcttgtgagccttcagcgaattgtaactttttgccattgaagggtcttgcttcaacatcaactgctgctaactgatcagggtgatggttgctgaagctggggacatctgtgttgatttcttaaaaggagacaacagtgaacttttctgctattgactctcctttctggatagattcccatgtagcttgggatagtattttatagcatctgaccccaagtaaaacttatttcaaaacttgagtcagtcctctcaaactctgctcctgcgttatcaactaagcttatgtagtgtaatattctaaatcctttgttgtcatctcaacagtattcatataatcttttccaggtgtagattttgtctcaagaaaccacttcgtttgctcagccatgtgaagcaagttcatctctgttaaagttttattgtgatattggcagcaattcagtcacatctttaggcttcacttctaattctagttctcttgctgtttccactgtatctgtagttccttccccgactgatgtctcaaagtcatccaacttcttccaaactcccagtaacgttgttatattgaccttttcccatgaatcgtgaatgttcttagtggcatctagaagggaaaatactttccagaaggctttcaacatagtttgcccagattcaacagaggaatcactgtctatggcagcaacagccatacaaaatgtaatcctttttttttttgagacagtttcactatgtcacccaggctggattgcagtggtaccctcttggcttactgcaatctccgccttttaggttcaagtgattgtcctgccttagcctccagagtggctgggattacaggtgtgtgccacgacgtgcagctaatttatcgtatcttttgtaggaatggggtttcactgttttgaccaggctgggtcttaagctcctggcctcaagtgatctgcctgccttggcctacccaagttctgagattatgggtgtaagctaccacacccagctattcttaagtgataaagtgaaactcacaattactccatgggctgcataatggacattgtgtcagcaagcaatgaaaacaccattcatttccacatacatctccgtgagagctcttgggttgccagatacattgtcaatcagcagtaatacattcaaaaaatctttttttctgcatagtaggtctcaacagtggcttacactattcaataggctatcctgtaaacagatgtggtgtcatccagcctttgttattttgcttgtagggcacagacgaagtagatttcgcgtaattcttaaggaccctaggattttcgggaatggtaaataaatattggcttcaaattaaatttacccatgacattagcccctaacaacagagtcagcctgttttataaagcctggaagccaggcattaatctctcctttacagttaagaaaggtctagatggaatcctcttctactacaaggctgttttgtctgtactgaaaatccatttactgtagacaccatcgtcaattatcttagctccatgttctaggtaacttgctatagcttcacttggtgcttcaacttgtacttttatgttttagagatcgcttcttcccttaaacctcatgaactaacctctgctagttttaagcttttcttctgcagctttcttttctctcagcctttatagaattggagaaagttagagcttcactctggtttaggctttggcttttaatggaaggcgtggctgttattgatatatccagacagctaaagctttcttcttcttttcaataattctgtttcattttctaatctttcctatgtgtagtggagcaacacttcattttcttcaagaacttttcctttgcattcacaacttggctaactggtgtaagagatccagctctcagcccatttcagcttttggcatgcttttcttactaagcttaatcactagcttttaatttaaagtgagagatatgtgacttcctttcacaagaacacttagaacattgtagggttattaattggcctaatttaagcattattgtatatcagggatagggcggcctgagaaggaggacagatggggaaagaccagtcagtggagcagtcagaatgcacacagcatttattaagtttgctgtgatatactggtgcaatttattgtgccctgaaacagttacaataggaacatcaaagactgctggttacagatcacctaacagatatgataataatgaaaaactttgaaatactgtgagaattaccaaaatgtgacacaagacacaaaatgaccacattctattgaaaaaatggtgctgatagacttggatgcagggttaccataagccttcaatttgtataaaacacagtatctgcaaaggatagtgaagtagagcacaataaagccaggcttatctatctatctatctatctatgaatgagatcacaccattacctccaattttagttcagttccacaagcttctttttgtttcttttctctttccctatacgaaagttttgtctccaggagtgagaaacctggctgagtattattctttaatatatttacttgtttgattaatcctatagttaccaattatttatcttctctaccaaccttttccttgcctagataacctcctcttcacttagctctggcttcagcctctaatgccaggctgccatgcaacatacaatttaagcagagtactactagaaataagagttactgactttgtgtataatttggatggcccaggtagatgcctcactgtgaccagctcctgttttggaagatattaagtatgcacaaaatgaaaagagaaattgttggcttaacagcattgagataaagcaagtgaatgatagaatattctgaaacagagggactgccatataggtggaacataaaaagcatcagcaggtgatgtggtctgagagcattacaaggatgggaataggtgttccctttttatttcttaaggtagagctgaaagcttttatgtatgtagcactcaagctaatggtttctttctttctatctgaaggttatacttctactctctggctcttcttgcctatgagggatcccatctgccaagcttagcttacacattatactaatattatgaccctctttgccgattggaaatgagctaattggtattatagaaatgtgttgttatacaacaagcaagcttatttctccagcgcctgtaccgagttttgcttggtttcttctgttttgcatggtcgcccctgtccactgaatcttttttttcttctattaaaatataaccaacttttgacattgtaatagttttaaagtcatcatgaataatacagagtgcttccatatacacttccagattcagcaactgttaaaatgttgtcacacctgctgtatcattctttcctccatataattcttctaacatttggagaggaagttacacataacctgtgtttttacctaactgtctcagtgtgtttccttagaacaagaacattctcttatataaccacagaagaatttatcaatatcaggaattacaacacctttgatgatattgacattgttgaaaaagaccagttttgtacaatatttctcaaattgggcttgcatgccttctgactattaccatcaggcaattcactttttaaaagaaattgtggaaaagttaccatacagtttatcatcttaaccattttaaattgtatagttcattagtaataagtgttttcacattgttgtgcaaccagtctccagaatttttttcttcttacaaagctgaaactcagtacccactaaaaacaactcttctatttcttcctgctcccctaccctcaaagtcatcattctactttctctttctgagttttactgctctacgtagctcatgccaatgaaataatacagtatttttctttttgtgaccagcttgtttcgctcagtaatgtcctcacagttcatcatgttttagcatgtggcagaattgttttgtttttaaggctgaataatatagtgcggtttgtgtatactagattttgttgatcccctcatctgttgatggacagtaaagttgttttcagcttttgactaccatgaaccatacttccttgaatatttgtgtagaagttttgttgggggcttatgtttgcattctctaggttttatatctgggactcaaatggctggatgacagtaagtctatgtttaacttattgagagctaccaagtttttccaaagtggctgtaccactttacaatcctcccagtaaggtaggagtgttacagtttctcctcgtcttcaccaatactacttaaatgtttttttgatttggttatccattctactgatgttgaagtgggatgttaatatggttttgtttgcatttctttgatggctaatgatgctgagcaatttttcatttgcttcctagccatttatctatttttgaagaaatgtctgttaacatcctttgctcatttttaattgataatttgtcattttattattcaattatatgtggtcaatgcttgtattatttctctttccagtttttggttttgggttttttttttcctttctgtctgcagtggatgaaggaggatttattgatctgaactctctggataggaaacccttcccttcatattttgtgttggcagttaaggagtcctgattgatcactaatcagtcagttcagttctagttatatattgtaacatttgatctcagcttaatgagatttgtggatataatttttatttatttaagataatactcttcaaaatggcaaatgtgaaacattaataacacatgagttacactttattttagtctgtgtctttttcctttgcagatagaacagctgtagaaaaattacgagctgtttgtttggaccatgcaaaacttggagaaggcaaacttagtccaccccttgactctcttttctttggtccttctgcctcccaagttctatacctaacagaggttggtttttgcctttgcaaaaatgtaatttttatattatacggtaatgtgaagaacactgataagactgtaaagaaagttttttaaatagtcgaatttcttagcaatgatcagaggagaaatagatgttactaagtttttttttaaatcccttttaatatactctccttttttttttttttttccaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacaggtaataaatgttaagaaacttttaaaaatatttagtccttactatttaataaatgtaaactctgtaataattattaattattactatttaataaatgtaaacttttaagtagatgatggaaataattcaacagatagcatattatcttagggatttttttgattaagttgtatttatattaaaaatgtaaagattgactgttgcctatcctactttgagtgaacttcccagtctctttaaatcattttttactttcagttgtttaaagtgtaatgaaaacttcacctgaatcttttgttaagtcataccaaaaagatacataaagacagttcgtcataaaggagaatatataattgccatgcagcaaacctctcttcccacaactgtgaatctctttctcctttgctgttagccttgagcagcatcaccaacagttctcaagaagtgcttagattggatgcaaaagatgaattcagttctaactaaattgagttcactcacttatgttataaaggatggttttactaattactgcttgaagataaaatggttcagggatacagattattacatttagatatatgtgaggtgttaattagggaaatttggatagtgactggattatctgtatattctagactgattaattttattttgggtatgagtcatgctgtcattattgacctaagataaaatgtctcaggtttgcttcaaaataattctggggtaatataattctgggtttgtttcttggggagtcagtgaaacaagtttaaacatttgttaataattattgaagctagataatgggtatttgaggatgtattatattcttttatctgcttttatatattttttgaaatgtttcattcaaaaaaaggacaaaaagaagaaagtggtcttgtacatgtcaatttagatattaatttacaaagctctgtctccatcctgagtaagttttattgctttatattgtgggcttcatgcatatttacataaaaaaaggtagggttcttattatggtccttgttatgggagtttactgaaatacaaacaagatattttttgtatgtttttacatatttctttctgtatgcatgtttaagaagtgtgctaccaaaggacacagagatacataataatctctaatcatattctggtaaggagcttaaggaaaattagtctttaaaatatgtttaatgtacgactgtctacaatacgtacaagaggttaccttttgagaaattggaaaacgcaaagaaaattctgaggggtttctctcatagatttaaaagctttttatgctattaagtaagatgttgtagtactttctacacattccacacttattaatccttgattactataattcctttccatggagaagttatgaatagagaatatttggttctgccagtattagagtaaacacagttatttttgcattttggagcactcctaatccttcttttgctactgagttgaattagagagttaatatattaccagtaatgttaacaagacaattttggtgtaagaacaagtgacacaagactttgctgacatgaaaaactctagttggattagcaaaattcaatttgcagttttaaagcattgtgtaactttttattcaacaagtaattgatattatgtatgtacttagtacctagtataaaacagataattgctagagatgcatgtagacctcacataatttctaaatttattggatattaatggtcaaaatatattgagctgtttcttgtatgccagtcactatgctttatctcctttaatcacgaagacagctatatttgttgagcctctgctattactttctatttagtaagtgaaaattgagacctggagccatgaagtagcttggtccaaaatgataaccgtcagctgagatttttttttttttttttttttttttttgagacggagtctcactctgtcacccaggctggagtgcaggggcgccatcttggctcactgcaagctctgcctcttgggttcaagtgatgctcctgccccagcctcccaagtagctgggactcccggcgcgtgccaccaaacgcggctaatttttgtattttcactagagacaggtttcactatgctgggcaggctggtctcaaactcctaacctcaggtgatccacccacctcggccttccaaagtgctgggattacaggcatgagccaccacgcccggccagctgaaatttttaattccatgaggccactgacttggaaactatatttttaccacctttgcaatactagtttttttgtgtgtgaaattttatgtagtatcacttggcaaattgtttgtgaaaactttattgaaaaatgaaaataatatgtacataacagttaaattttaaaattcgttggttgaagttggaaacagtggctggaagtatttgatttgttcagtcttaacgctttgaccgcctgacagttgcagtaacatctcccccaggctctcgaatctcttaaaatatctgttttaatatggtctttttaaactttttttaaactttaggccaggtgtggtggctgatgcctataatcccagcattttgggaggcctaggggtgaagatcacttgaggtcaagagtccaagaccagcctggtcagcatggcgaaaccctgtctctcctaaaaatacaaaaattagccgggcgtggtgatgtgtgcctgtattcccagttactggggaggctgaggcaggagaattgcttgaacccaggagggagaggttgtagtgagtcgagatttcaccactgcactccagcctgggtgacagattgagactctgtctcaaattttaagaaaataaaataaaactttactgtgtaaataacagcggtagagaggataataggttaagctgcgagaagctttagcctgtctgtgaaatgagcattagaatgcaggtggcataatcagccttgggcaaaataagtagcttcctaaagactaagtctgtagattttaaaggactgtttaatggtatcctcagttttctccattgtattatggtaggcctagtcacctgtggcaaagggggaccaggagaagtttctacccagagacatgttgtatcatttatcccctgcaaatgagcccaagtgcagaaataatagaattcatctcaaattggagtttccagggtgttactacgtgtgtagtttatttcactttgagtaatattcgatattcaaggcatggtaattccacattttgttaattcgtttgttgatgggcatttggattgtttctagttttggctgatgatgggagtaaaactgttaggaaactcatcaacatatcatagagcttctgtggatatatggttttatatctcttgggtaaacacctccgtacgtctatcactttgaaagacagctccataatgttggcaatgtgaaataatttttatgcaaacccccataaactccacaggggtaagtgaaggaataacatgccgaggaagtggtgatggatgaggagtaaaaatttttttaatgtaaaaattttagggattatggtatatacagttttttcatttgacgtaaaatgattcacttttttcagattaaccaagttactcatgatcaagcagtggtgctacaaagtgcccttcagagcattcctaatccctcatccgagtgcgtacttagaaatgagtccatacttcttgctcaggaaatatctaatgaggttagtatgaaagttagacagttctgggatcttgaatgatctctacttaacacgtaaataaattaagctatgagaatttgaggctaaatattgtagacccaaaacactttagtctctatctcaatttatttaaaatttcataaagttatgtttgacctgatagctgctgataatattaatattagagctttagaaattttgaaatttttaaataagctttctgagttataatttacattgcacaaactagatcaaataagttttagtatatgtttaaactgctcacacaagcaaggaataggacgtttataatggctccagaagttttcttgtgatgtttattctcttaaattttacataaatggaatcatatacgttgtactcttttgggtctggcttatatccatcagcaaaattttgaaagttattcatgttgttatatatgtgtgtagtttatttcactttgggtaatagtccatgtatggttactccacatgttgctaattcattcgtgtgttgatggacatttggattattcacaacagtctagttttgactgttgtgaataaaatttttgggtaactcatcaagtcatagtgcttctgtggacatacatttttatatctcttgggtgaacacctctgcatagcatggctaagtaatttgactgttgttatttttaaaattttatgaaaaataggataaagccatatcagacttgaacctgaagcatacttggtgggtattgctgtgtcttccgttcatatgggaagccatattttttgacttaatgttaagatattaaaaaaatgagaacaagggaactttggtccttaaaggcaggtctgatgcatgtttacttttacttccatttccacttctttcactaagagaaatattttgttttcctgattattcactttaatgttctgccagcacttttaattatttatttcttttctgcaggcttcaagatatatgcctgatatttgtgtaattagggctatacagaaaattatctgggcatcagcatgtggggcattaggactagtttttagcccaaatgaagaaataactaaaatttatcagatggtaagaattattacagaaatagatttttaagaaaatgttgcttcattgtacatgtgattaaattttcatcatttctgtcaccttatagaccaagtcgcttgtatctaatggtttaaaatttattgctacctataaataaaatgagaatatattgttttattttggaaataaaatactctagaagcctgctatgaggcagctttcttttcctacttttttaaaaagacttctcattgactcaaatatagttatactgtaatgaatccacctctccctattttctttagttcttcttgattttgtcctgtgtaaatttttggtaattgtctctttgggaattatggcatttaaattttacctggcgtcgggcacagtggctcacacctgttaatcccagcattctaggaggccaaggtgggcggatcgcctgaggtcagtagttcaaaaccagcctggtcaacatggtgaaaccacatctctccggcaggtggggggcgggggaagggggcaaattagccacacatggtggcgcatgcctgtcatcccagctacatgggtggctgaggcatgagaatcacttgaacctgggaggcagatgttgcagtgagtggaaatcctctgcactcaagcctggtgacagagcaagactctgtctcaatcaatcaatcaatccattttacgtggttcttttagaacactcaacagcaggaagagtgtctaacatttaggtattatcaccagccttgtggtacattaagcaagctatttacagaaataagactgtttagctctttgttgtctgtggtgtttacctacccatatagaaccctgatggtctccattaaaatatacattagtgtatttaaatatacattagtatagttaaaatgagaaagtgtgtcatggcattatacaacttccgttttaggaatagttgaatggttattctgttccaaacgtacaagtcttagttacattttgatggatagtgacagattaaaaattattagctacctagttatattttaggttgcagaagtcttccataggcttcctgaacatttgtattatgatcaatttttgaatgaaatgacttgtaggtaggctctacaatagaactactcaaagacccaaactgcagtgccaaagtgattctgtagtagcagttatgattgaggcagatcagtcacatccagaagaacatgaaaagtgaggagtacctatcactgaatgtgcttcttaaatcccccttggagtatatcccaaagagcctctctagccgcaagtgaagagtctgaggccgcatggtctttaccaagtaggcaattgtaaatgttaaccagagggtttgtgaatttcttcttgaatatgtctctaggtaacttgctcctgattctaattttgcagaccaccaatggaagcaataagctggaggtggaagatgaacaagtttgctgtgaagcactggaagtgatgaccttatgttttgctttacttccaacagcgttggatgcacttagtaaagaaaaagcctggcagaccttcatcattgacttattattgcactgtccaagcaagtatgtgatttttatgtgtaatttgaaggaaggcttaccttaccgttccaagcagaaatgaatgacttctgaagaaaatttttttccagaagtgaaggaaggaacccttttacttgcccatgtaataccttgaagtgtagaagcatttttttaaaaacatttccagttaacctgaatttttttctctgcaagatgccagcattgatttttttcttttacttttttttattgtagtaaatcatgtaattatatacataacacaaaattagccattttaacctcttttttaagttagctttattcagtggcattaattgcacaatattgtgcagttatgactggtgtatattgaatgattgcaatattgtgcagtcactcctgctttatctcaaaaatattttatcaccctcaaaatattttatcaccctcaacaaattctttttaactaatgactcccattttcactaccctccaatctctgataacttaaaatattcatttagtttctatgcatttcctattttaggtatgtcacataagtgaaatcacacaaatttgtgcctttgtgtctagtttgttagcttagcataatgttttaaaggttcatctatgttgtagcatggtcagaacttgattcattttcaggggatactctctcatatgtgtatactagatgttgtttatacatcggtctgttgatagacacctggattatttctaccttttagctcttgattactgttattgtgaatattactatgagcacagatctctgagttcttattctcagagctattgagtatatttgtagaaatggatgtgctgggtcatagggtaagttgtgtttaactttttgaagatctgctgaacttttttaacattggcttcaccactttacactcccaacctcaccttacacaggctttagtttctccaaatcctctcccacactattttcacttttgttaatggccatcctaacgtatgtaagatgtaacctcattgtggtttgtatttacatttccttatgactattgtagtgatattgagcattggctcttgtgatattactggccacttgtatatctgctttagagaaatgtatcttccagtttttatagcattattgaatttgattatttttgtagtgagtttctgtatatattctggatattaattcctttccagactaatgatttacaaacattttctcctattcttcaggatttatttccactctgctgataatgttattttatgcacagaagtttttaattttcatgaagtttaatttatgtcttttttggtttcctgtgtttccatcatcctcagtatagaaatcattggcaaatccagagcaaaagctattttctcctacattgttttctaagaattttttatttttatagttcttaattttagatctttcatccaattggagttgatttttgtgaatgatgtgaaactaagtgtccaactccattcttttgaatgtggatatccagctttcccatcatgatgaacatggtcttaccccattgagtggtctaggcaccttgttgaagatacaaggggttgtttctaggctctaaattatattcctttggtctatatgcctgtccttaggccaatgccacactcctgattagtacatcagggaatataagtccttcagctttgttggggtttttagtttgtttgtgttttggttttgcctaggtttttatttgtttttgaggttatttggaccttctaggttctataaaaatccatataaattttaagctggatattgcattgaatctctctcaaaagagtgattgcctcttaacagtattaagtcttccaagacatgaacatgggatgtcttttcatttacttagattctgtttacttcttcaacactcttatttcttctctgcgaaattatttctaagtactgtagtgctaactctttttgctgctcttgtggatggaattgttttcttaattttgttttgggatattcattgctagtatatcaaaacaactaatttttttatattgattttatttatcctgcaattttgttaaatttctttatgaattagaggtttttttacagtaagatcatgccacttgcaaataacatagttttactttttctttcctttttggaccaaatttatctcttcccttttttgcctatatgctctactgccttgattagtagtagtaagagcaggcgtacttatcttgttcctgattgaggaaaagcttttagtctttcacgatttagtgatgttgttattcctgatccagacccctagagagggttcctggacctgggtcaagtccacagagtaaaataagagcaagtttatagagaagtaaggaaccaaaagcacggctactccataggcagagcagccctgagagttgctagttggttatttttgtggtgatttcttgattacatgcgaaacaaagtttatttgtgctaaacaagtggattattcatgggttttctgggaaaggggtgggaatctgctgctccccactcccaacccacctgatggtttctcccttttttgaactatataggataaagtctggatggttgccacggtatttgtaaagtgatatgacgctggtgggagtgtcttttcgcaagctaatgcattatatttagcgtacaaagagccagcttctttactgcatcctgttttatcagcagggtctttgtgacctgcattttgtgtggacttcctgtgggagtcgctctggttcgaatacctgtgaccatgttagctattagtttttcatatacggcctttatgctgttgagaaacttctcttgtattccaagttttcaaaatcagttttattatgaaaaggtgtttacattagtttggataatttttttgactcaattgagatagccttaagccttattttctttattgtatttctgatgatactgttactggaaaagattcctgatccagatcctaagagaggactcttcggtctcatgtaagaaagaattcagggtgagaccataaagtaaaggcaagtttattaagaaagtagaggaataggccgggcacagtggctcacacctgtaatcctagcactctgggaggccgaggcaggcagatcaccagaggtcaggagttcaagaccagcctgaccaacctggtgaaaccccatctctagtaaaatagaaaaattagccaggcatgatggcaggtgcctgtaatcccagctacttgggaggctgagacgggagattgtttgaaacctggaagacggtggtgcagtgagctgagattgcaccactgcactccagcctgggcggctaagtgagactctgtcaggaaggggtgggggaggggcaggggaaaagaaagtagaggaataagaaaatggctactccaaaggcagagcagccctgagggctgctggttacccatttatgtggttatttgttgattatatgcaaaacaagggttgggttattcatgctttccatttttataccatatagggtaaacttcctgacattgccatggcatttgtaaactgtcatggcgctggtgagactgcagcagtgaggatgaccagaagtcactctcattgccgtattggttttggtggggtttagctggctttcttactgcaacctgtttcatcagcaaggtctttatgatctgtatcttgtaccaacctctgtctcgtcctttgacttagaatgcctaaccctctgggaatgcagcccagtagatctcagccttattttacctagcccctattcaagatggaattgttctggttcagaggcttctgacaatatattaggaatcaattcatatgtttaaacacccttacgttcttgataaatcccacacttcatcgtggtaccttgtacttttaatatgctgctggatttcttgctagtattttattgaggatttttgcatgtatattgttgtcaatgaaaagaatcaaactctatagaatatttgaagagatttattctgagccaaatatgagtgcccatggcccgtgacacagccctcaggaggtcctgagaacatgtgcccaaggtggtcggggtgcagcttggttttacacattttagggaggcattagacatcaatcagatacatgtacaaaatacactggtttggtccagaaaggcgggacaactcaaaagcgggtgatgggggcttccagggtataggtaaatttaaacattttctggttgacaattggttttatgcaaagacctgggatcatagaaagcacatgttcaggttaagataaaagattgtggagaccaaggttcttgtgaagtctttttacagtggctgcccttagagacaataaatgacaaatgttttttattcagatcttgaaaaggtgctggaccttcagttaatctctttaggattgacagggcttggaagaaaaacacttggctatattaatagagattcttaacagatgcaggttttctcccacaaaggaaagctttgcagagctgtttcaagatatggctaagaaacatgttttggggtaaaatattttgattttcttccttgtatcgtaatgttatgccagagtcagactgaaaagtaagtcacgatatatagggttaaataaaagccatctgatgaggatttatgatttgtagggaatgactccccagaccctttagacaggaatttgggcaacataaaaagtcagatcttcgtcctcattgttaaaaggtattgtgttggtctctactttccccttccctccttcccttcctttctccttccctttttcttcccttttgcttcccttctccttcccttccccttcccttcccctttcccttccctcccccttcccctccctctctccctccctccttccttccttccgtccttccttctttcgaaaaaatatttgtctagctttgttaggtgaatagtattggtcttataagttaagaagtacaggttgagtatcctttatttgaaatgcttgggacttagaagtgttttggattttagaatgtttgcatatcttggtgatgagaaaccagtctaaacaggaaattcatttatttttcatctatcttcatgaaggtaattttgtgtattcgttttgtgcgtgaaacaaagattgcgttaagactgagggatggagtttttcacttgtgtcagccctcaagtttcaggttagagaacacctctaatttttgttattagcgatggtcaacctgtactgtcttgttttaaaataaatgattttggaaaagggaaaaatttgttttaatttgaacatttggtagatttcaacagttgaacactctggtcctggtgaaacagctacattgtctggtgtatacaccctggaggtcatggtcatacaccaggaagatataagacatggacacacccaaggtgttcaggagcggaggtttaatagacagaagaggagagaaagagaagcagctgtctctatagacagaggggtctccaaggggaaaggactggctggcagccgatgtgctggattttctagcccagtttgaggaggctgtgtctgatttacatagggttcacagattggtttgatcagctatgacatttacatagtgtgtgaggaaggttggttgccccaccctaatttttttttttttttttttttgagaaggggcgttgctctgtcccccaggctggagtgcagtggtgggatctcggctcactgcaacctccacctctcaggttcaaggaattctgcctcagcctcctgagtaactgggaatacaggcgcgtgccaccacaccaaactaattttgtatttttagtagaaatggggtttcaccatgttggtcaggccattatggaactcctgacctagtgatcctcccgcctcccaaagttgctgggattacaggggtgagccacgacatccagaggccccaccctaaggttattttgcatattgggctgtgccagttgatcggagccatcttgtctgctcattattgtacacatggctggcagagaagggacaatggagctgccatcttgaacatgtctagtccctgttcctgccggccttcacctgtgcaagcttccagcttgcttgtctatgtctgcaactcgactttacaggccgccatttgttggtaaatgatttggggctgctagtcatgaaaaagagccttatggaggactcccacacccttactctctgcctgagtaatttcttcttaactcctgtatcactggggttttctttttaatagatgtgagcttgtgaaatgagtttggtgtttgtccctttttcttggagtagaacttctaaaatctttggaatctccaaagtgttgtctctttatatgctagtgttgactggaaagaggaagacatgattatgagagacaggactagctggatttcctaggctgactaagaattcctaagtctatctggggaaggtgactgcgcccacctttaaacatggggcttgtaactcagctcacacctgaccaatcaggtaataaagagaagtcattaaaataccaattaggctaaaagcaggaggtaaagaaatagtcaagtcatctatcgcctgagagtacactggggagggacaatgatcgggatataaactcaggcatttgaatcggcagtggcaaacccctttgagtcccctcccgttgtataggagctctgttttcactctgttaaataatcttgcaactgcacacctttctggtctgtgtttgttctggctcaagctgaggtttccctcgccttccaccactgctgaatgccgccattgcagacccaccattgacttccacccctccagatctggcagggtatccactgcacttctgatccagggaggcgcccattgccgctcccgatcaggctagaggcttgctactgttcctgcgtggctaagtgcctgggtttgtcctaatcgagctgaaaactagtggctgggttccacggttctcttctgtgacccatggcttctaatagacttataacactcactgcatggcccaaggttccattccttagaaactgtgaagccaagaaccccaggtgagagaatggaaggcttgctgccatctttggagcagcctgccaccatcttggcagctctaagaacaaagacccaccgctaacagagagttgggatgctcagccccacggggcagtttctaggaaagaagagtgagtggctgaaggtcaagttgaccgccggtgaccagaatattatttaatcatgcctatttaatgacgtgtccttagacagacaagaagacaggcttcagagagcttctagatagctgaacatgtagtttcctggagggtggtgtgcacataaaagcagacatcaagaaactttaatgccaaatgtaaggtagtttgttttgttttgaaaggagtttctgcatttaagtgtgtcaagaattttcacatattaaaaatactccaactgaacctaaaaactagactttataaacattataacttagatgtttatactggaacaggaattaaaagaaattaaagagtgtgtaagcaaaaactcagttgtatgtaagaaaacccaatttcccctgaggaagagaaagagctggagtactttaaaaagtaactgcctgtttttctgtggctagtgagccttatttcttctccttttcaaggcattgtgaagaccctggttctctagctgtgcagctgcaaggtcactagacagataaacttaaatcgcaaaacatgtttttccttggaaagtaagaaatgatgtaatgcatgtctcagttaattgaaaaactgcctttgtttctcacttctgtaatgcttccccatgcacagatctccccccaccccaagaaatgcttaaaaggtaacttaactctttgttcaaggctcagtcctttggatgtcaatccgactgggccggagtacctaagtaataaatatcctcctgaaccccattggtttctctgattccttacaaaatcccgcaacaatacctaaacgattccatgattcattaatattgcacaagaagttttattctagagtgataatggtttcttcatgttaactgggtaagaacaaggtatttaaaaacaaaggaaaatcgatatgtcagcatgaatcctaagtgtatgtttggtttgcgggaatgatcttcagtggaatttttgtcagaaatatttattctaaaaaataagtcttttgatttagaattttctgtctctgaggtattttgtatcttcataaagacaaaggcagtatctcagtttctgtgtatctatttgagggaggctgcttcatacccttttagactcggcattctaggaggaagaaataagaaaaacaaacatcatttcagacttttctgtcatccaaaagtaataaaacacaattgtggtcttttatatatcactggctgtagataaaaattagagcttccaagaacagtctagtgctcaccagtatgcttttatatttgggtgtatatgtgcataaaataatgacatttgggcaaagaagctttgtcgttacttattttaaagttacagtgcttaaaaatgccttgtaatattaaataaggagcttggatatttctagtcctgcttccaagtgttagctatgggtgaacttgtttcaggctatgaggctggattagggcgtcttgtagctaatgatgtattctgctcagcccagtactagtgtcatgagcagacagactgacaatcaaaactgatagattttcttctgcacatacttttaacacagattctatcccttgtgcgaagccccagattttcttcagctgttcacactctcattggcctgttccaactcaatcttcacattacagtgcacaagggctttggattcctcaagcacaacaggattgtaggaggcaagctccttaatttgaaccataaccttctgagtgaaaggtgtcgtccaaaacgcctgagagaccaggcatttggtacacgcctccaaacaccaaaggtattggaagccacgccttttcattagcccaaaccacatcacaaagaggcagtatggatgtgacgagtccaatggctgggccattgactgatgaaataataggcttcttaccctaaatgagagtattcacaaagttttcgctagtgtccactcttttaatgctttccctttttctatcatttcttaaatgcttcacaaagaacacaaaatcaaggccacagcaaagacactgtcagctacgctgagtagcaggagcttgctgtcattggcagcagccctattcagagtaccctgaatttctttcattacttctgtatttagggagttattctctgttgatctagttaatagcaggatctgagtgaagccatctttcttcctcaccacagtatctcagtatctgtcggcactttgttagctttgtgctgaaacgcaccctcttgacaaaaggctggtttcttctgtcatcaataagctttctttttttcttttttttctttttttttttttttttgagatggagtttctggagtttcactcttgtttcccaggatggagtgcaatggtgcaatcttggctcaccgcaatctctgcctcacgggttccagctattctcctccctcagcctcccgggtagttgggattacaggcatgtgacaccatgcccagctaattttgtatttttagtagagacggagtttctgcatgttggtcaggagggtcttgaactcccgacctcaggtgatctacctgcctcagtctcccaaagtgctgggattacaggagagagccaccacacccagcctgtcatcaacaacctttcttttcccacctctcactcttggtacggatgtttgcatgtttgttgctccatgggctattaatggatcgattaatagcaatgtactttcttccttgttagctgagcctgtggccctggcagcagtcactgggccagacatctgaggcattagtgggtagatctggggtctgttctccatcccagcctttttttccctggggtctgataaagctctgcctggcttctctgctgccaccttgagcaccactgtgtcctgctgatgtggctcaacagggtccagtttttcaggttcctgaaagccacccactgtgttcctggtgttactggggctctgaggtgcaagcaaattcaactgatagttgaatttactagctccatattctttggattggagagagattaagctgtgtttctccccaaagttctggctggcagcagacaactggctgtttttggacttgtggtctttgctaatcgctagcatcttaaaagagctcttagaaaagttggttttggtaaggctggagatttcttttttggcattgtttgaagaagttctacctattctggccagtatgttgtctttctgtttttcagtgtgggatgtgttaaaatcgtgaatatattgcccacagttcatgaggtgtggccctggttcccaagtgtcatccttgttgtcatagcctttccaccaaaccaaataatctgtcttccctttcttgtcttgtcaacagtcgtttcaacctcaaactcctgggaaaccatggatgggtggacagggttggggcaggtgctgtgccaggtggccaacactttgtttcagttgtgtccccacatagccaccacttctgcctccactgctccaccaggcgctgggcacgtatgagcctctcctgcttttgtggccactggtggggaagaagttgtgtggagaaactgcctttggctctccacacttactccctggtgggccagctcgggcttggggccatggtcccatgatgcagggctaggcagatgcctcaggtaagagcagctggatccccagctcctggtctcgggtgtcatgcagaaagcgtcctacctgcttgttactattcccttttgtggttgctgtgacaattacatttaagaaagttataacacttttaaagtcacactagtttaccttcagtagcatacaaaagccccactccttaatagctcagaccccgtcatgtcagttattaagttcacagaattacaccttgatgcattttatgtccaaaaacataagctggtgatagccttttaatataatactgttgtaaatcatgtagagaacaaatagtggagttgcacattgttaaaagctttgatagctttcataattggccatatatttatctttaccttaatctttattcagacagctgtatagtgtcctttcatttcaccctgaagtactccataaagcatttctcgaagggtaatctagtggtaacaaacttctccagcttttatctgggaatgtcataatttctccctcacactgatgcagcttgtttggacataagatttctgtttgacagtttatcattacagcacttgcaatatgttagcccactgctttctggcctctgaggtgtctgataagaaacgtgctggtgattgggaggccggggcgggtggatcacaatgtcaggagttcgaggccagtctggccaacatggtgtaaccctggtctctactaagaatacaaaaattgccaggcttagtggcaggcacctgtaatcccagctactcgggaggctgaggcaggagaatcacttgaaaccggaaggcgaaggttgcagtgagccaagatcgcaccactgcactctagcctgggagaaagagcataactccatctcaaaaaaaaaaaaaaagaaatcctctgattatcaatgcgggtctttagttcatgactagtgacttctcttgctgctttcaagattctccttgtctttgttttagacagtttaattagcatgtatctttgtgtgtgtttgagtttatcttacttggaatttcttgagcttcttggtgtttatttatttcctaaaatttgtgacattcttgacaactgtttcgttagatactctgtttctttctctcttctctttgaacttccaaaatgtgtaagtttgtctgcttgatggtgtcccacaggttcctgggctgtgttcacttttctttattattttttctttctcttactgacttgataattttaactgccttttctttaggtatgctttttccccccttctgtctgctcaaatctgaatagaaaaatgagaaaggaaaatgctctggcccttttaatccctggaaagttgcttcagcaggaggaggaagctcctgcaaaatggttggggaatgtaacaatgactgcccacctttgtcgggaccatcttaatcagaagcggcaatcagtgcacaagtcctcctgagatttggaggacagggttctttctgtccatcctggctcttgcaggctgctccagaagtgtttgcaaggcagcatatcacagtggtagttgatggagcgtaggtggctgctgttgagccaagctatgaaattgatcaaatttaattgtagtttactatccaagtcttcttttgaaagctgtaaaccttgagatagactgtagggttccaaaataattgtatcacacaattctgccaactgcacctattgtctagttggagagacagattcatggtgctctgtagttcattgttgccctcttcccagaaccctgtatcctcttccttctaacctctgtgtctttacacctaaagtgagacttgcataaatttcatataggtgaatccattttttaaaaatgcattttgccagtctgtgccttttcacacagagcatacatttcaagttattacaagcaagtaatggtttactccgacatttacctacttattttctgcctgttctctatattatttgatcctcattatatacttgatcctcactatatatttgatcctcactatatatttgatcctcactatattattacttgatgctcattttaaaaatttgttttttaaaaaaaaatgtgcttattcccttttctgtatattttatattttttattaattatatttgggacttcagttaatattctaaacttaaaatagcctactttgagtaatactaacttgtttgaataatatgaagtttagtttcaacagtatataaatatgctgcttttgtacttttccatccttcctaatctatgttattgtctcagattatatctgtacacagtgtccattaaaatggatttgtaattgttttatgtaatagctgcctaccagaagtacaatagtaatagttacttttcccagttgttataatagtaatagcagctttctttacaatgttaattcttcctgtggcttaaaattactgtccaatgtcctttcattttaacttgatggcttccttctagcaatccttgtagagcaggggtagtaacgcattccgttagcttttctgtatctaggcatttttgcttgaagtatttttgcttgaagtatcattttgccagattcagatttcgtgtttgatagcttttttctattaacattttgttatcgctttctggcttctgtattttccatgctttctgagctgtttgttgttaatcagtacacccttctacataacaaatggcttccattctgaggtgtctgttgtcagtcaagactcccttctgcatgacaaattgcttctccctttctgtttttacagttgtcttggttcttgactgactataattttcttggtgtggctggctgtttttgactatgttcttgttggagatttttacccttcttgagtttggacattcagatatttcatcaagtttgggaattttcagctatttatgtcttcagatattctttctgcctcttctccttctgcacttatgggacacccatattgcatgcattggtctgcttcatggcgttctgtgtacttgttaggtttttcccactttttcaaattcttctttttttctgttctcacactgggttatttcaattttcatttcttcagacttaatctttacctgctgttatatactcctttaatgaactgttcatttgcatcattgtgcttttttatctctagatattccatattttcttctataatttgtctcattgatactctcgtgttcttttatcatttgtctgctgtttttttctttaggcttaactctttttttttttttttttttttttttttttttttttttttttttttgagacagagtctctctctgtcacccaggctggagtgcaagggcgcggtctctgctcactgcaagctattcctcccgtgttcaagcgattctcctgcctcagcctcttgagtaggtgggattacaggcatacaccaccacgccttgctaatttttgtattttttgtagagacggggtttcactgtgttacccaggatggtctcgatctcctgacctcgtgatccacctgcttcggcctaccaaactgctgggattataggcatgagccaccatgcccagccaaaactttggtttttttatagtctttgtgtataaagttcaggacattttcagtttctgtttttcacttcacattggtcatattttcctgtttgtttttgtgtgttttgttgtttttttgtagaaaactatatttgaaatgttgcagtgtgttaactctggaagtcttcatttctccaaggtgtcctcttagttattgaaggcttagcttgcattgcaacagtgttttaattgagtgtaatataaaaactatcagtttttacaactggatctgtattaacacacccctttaatacttagggagactgtttacaattctgcctcagccttcagttttttctcacattgaagctatagttaagcctgagggctaacacttagagttttacatgttttttgagaatgtttcctgtcatgagcatgtgcatgattttctaaattctttagtatatttaactgctttcaaatattctgatttctccaaaagaaagatctctccagcttttgccctctttttcaggttgtctgttttatgggttaatcatatactttgctcccagcaacttaaatatttgtgactaatgcctggcattttcaaccatgagtgagttctgagttaggcaaaacagagatatgtgtgtttcaccaattctttatgtaactcctagacagactagaaataaaacacaataaattagcacctaaggtcttctttactccttctagaatcaggggtcagggcctcacattgagaatgtggattgcattttcgaaggcttcagctgtgcctgggaggtggtatggtaacaccacaagactttcctaccattttaaaaattatctctcttggctcagtgtttgcttggttgatataaattgttgatttccagggtcctgtcagttttgggttgatgtgctgtttctttggagggtttgaaagtgtctgtcctgtagctttgctttcagtttaatttatgaagcactgattgttttccgatctcagagttcatttttatttaggagatttacacttttgtgccttaaaaattttccttaaaataattaagtagtatattaacctcctaatttgggttcctagatgttaggtttttgttttagtggatatggtatgaaactttttctttgctttgtttttaagtaagattatcgattccatataaaatgcatgaggcaggatttgtttgttataaagtacagtttggttttatataggagagtcacaaaatacttcgttgccagggtgactttcaagtaaatgtctaaatgaacaaacaagggaataattatgtaagtatgcagcaggatcaacaagtatgaagatccctggcataagcctacttagcttgttagaaaaatagcaaggtcggtgtggctgaggcaggatgaaaaaggagaacaattatagatgaagagctcgtagagataacggacagtccatgtgatagctttatataggtcatgttttatataggtcaatagatattactttagattttactctaagcctggttcataactggaagtgggattggtaaggttgttactggcatctagtggtgagaggctggaagtctgctaaatatccttaaatctagagtctcagacacctttaggaatttaacacagttggactgtctctccagaaaattgtgaagaaaaggcatacatgtggaattctttgatactatagtttgaagatttctgagcccaacctgtgggtttcataaataggagggacttttataagcccttgaaaagttcagttgattaaagtttgagtggggtggaggagagagagagagaggggagagagaagagaagacagaagagagagagaaaaagagattctgggtttgtcttccaaaattaatgactcagtaagtatggaatggaatctgaggatctgtatgtcttcgaggttctcaaatgatgttaatgctgttggtctgataatcacgtttgagaatcattgatacaatcagacatatctttagccatgttgcatttccatgagttgcttgctccaatgcacggttcattgaaagtgattctggggaggctaaaaaagatatacagaagcttaattcatagcacctttgtatagtatctagagggtgtttccaggcatttccgagagaggttgttaaaaatatgtcctgcaaaataagaggcttatattttattgattgatgcttacctttgacatgatccaccccgacccctgattcacagtaaatattagaagatctaagaaatcatacattaacaaacttgaacaataaatagtaagtagtaatattcctagcctactaggtaacaatttgaggattagctccctgacaagtattttaaactcattcattctgtgttgctagccaaatgctaaaatgggggttaccttgtattttactattgatgtatatacctcctattaaagatagatcagtgttggaattattttgttgttgttcataagatacattttgtttttatttcagaactgttcgtcagttggcacaggagcagttctttttaatgtgcaccagatgttgcatgggacacaggcctctgcttttcttcattactttactctttaccatactgggggtgagaagttttcaaatgaacttatcaatataatgcattcttaacatgagagacattcagaaagttactacgatagcttttattgtatttagaacaggcataattaataaatgcagtattataattttttactatttgtagattggctttttgtttttttacagttcttgggaaaaatacactacgtcttggaaaaatatatagtaggtctatagatgtactatatatttattttatgtatatagtacgtctgtaggaaaaatatagtacatctttgtcattgatatgaaatattgccaattttaatttttctgggtttaaaaaaattatatggactctgagtgtagacttgtgaattcatgttgttttaatttaatatttcagagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggtaagttgaatagtatttagtttattatgtcatgaccaaatcagctgtcttattaaaaggaggtttgtagtcttttatttagtctctatttttatttgacaacttaggagaataaattctcaaaatgcctctgagaataaatacaaacaaaatgtgtacttttcactagtgaattggtaacttagattcatagaaacaaacatagctagttttgttcaatgtgttttacttttcttgaaacttggaatgctgataattctgtttctttcactttggtgcttcttggccttttttggggaaattatcacatttgaagactttttaaaaaatcgaatttgagagattcgtatttacattgaaccatctgatatcttacttcacaaagttctatgagagtatatttctaaagtgtatggctttgggcttcaggttagctgcttctagtagattataaagcttacttacggagcacggtttttgaaccctggtattgacgttgtgtacccagataattccttttggggaggagctttgctgtgcattgtaggatgttaagcagcatttcgggcctcttccactcagtgctgtagtaacctcctttcctcgtggttgtaaatcccaaatatgtttgtgtaagcaaaattgcttgcatttactgttctagagagttctcaaaaagaaataggaaaccacttgaacagtttggggaagttgtatagaagatctcatttccttccagctctctgttctcctaactccttgtccttttctatctccatgttgtgagttgggcctataatatttttccttttgcaggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagtaagtacttttttttttctttttttgagatggagtcttgctctgtggcccagactggagtgcagtggtgccgtctcagctcaccgcagcctccacctcccgggttcaagtgattctcgtgcctcagccacccaaatagctgggattacaggcatgtgtcaccacacctggctaatttttctatttttggtagagacctggctaatttttgtatttttggtagagacctggtttcaccatgttggccaggctggtgttgacctcctgacctcaagtgatccgttcacctccgcctcctaaagtgggtgagccgccgcacccagcctctttaaggtaagttctgaattttgttactgaacttcttatcatgacctcataaatgttagcaaatctgtctgattgacctctgtataatgtctttgagacataatcttgatattttttcttttttcttgtcccacttctcttttaaaaaggatctctgaagaggttacagtaactttaaaacgtgtgcctcactttaagagattttgtaaagtaattacaaatcagagttacaataaagtggtatgaaaagtcagtaagcagcattgaggtgattttcatgttgaataaatctcaatttttcttgactagatttctaaatgagagaaatttctgtcttgcaaaacttcattttttatacactatttcttggtgagcttctttatatgtcatgcaattcaagaaaaagaatataactttgatgcattctgttcctgtttgaaatgaatttgtttctgtttatatctgattaaagaaataaatttatttagaatgtcacttttctttggtataaaattgtttaaatcacttcaaaaaatctaatctggaaaactgattacatttattaattgtactcgggtttttttgtggggttttgttttgagatataatgagatatttaattatgtcagataattactaaagtattccctttgaagaaacatattgttcctaacctatattttctactaataacatgtaatgtctttttctaacttactaggaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactagtgagtattttaaattataaagctgttttgttcattaataatacttcactgtaaaattttatttggtgttttagaaaaaattaacttgtgatggactttttttgatccaatgagtttaacattttttagctgtcagttatacaattaaaaccactttagtcagagaacattaattcagaaaaatttttagctgtgtcttttaaatgctccttatagtttgtttagatgagttttatttaatcatatgtgaaataaaaccaaaacttcagagtaacaggaaggcaaatttaatgccataaaaagtttatatttaaaatgtatgtattgaaaagattttcataatcctaacactgaagttgcttaatgttattttagttgaattctaaggaaggtatggttttaaagatcacagtgtgagaagagaatatttgagtgtattttactaagttctaaatgcctacatcagtcccacaaagtgagtacctatgttcagatcttacatagaactgaaactcagagtgggaggtggtataagtaaaataacagataataatataaaatttagttcatttcaaggaaaaacccaaggcttaaaaatataattaataacagcattcattataaatctttaataaatatgaatttatctttgcttatgtctttctctgggtgaggacgttttcaatcacattgtaggagtttctagctaaactccctgcttagaaggtcagatgtttttttgtcgctttgaatctgcatagagagaagagtttcttcttttgagacgaagtctcactcttgttccccagtctggaatgcgatggcgccatctcagctcactgcaacctccgcctcccgggttcaagcagttctcttacctcagccacccaagtaggtgggattacaggcgactgtcaccacacctggctaatttttgtatttttagagagacagggtttcaccatgttggccaggctggtctagaactcctgacctcaggtgatccacccatcttggcctcccaaagcgctgagattacatgtgtgagtaactacttgagattacatgtgtgagtcactcttttttaaaaagtttcttttttaaaaacgcttcttttgttaatttatttagctaatgtatttatgtggtaagtgtagtttcaaaagagtttattttttagaaacacttgtttatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagagagactccgtctcaaaaaaaaaaaaaaaaaaaaaaaaaagaaacacttgtttattttactaaagtttatacctggtaaatatgtattttcaaatacaaaagaggatacatgttaacagttattaacttcctacaggttttatgtttccagtccagagattatctctgtctatgcatttatatgtatgtatagctattcgttttgtacaaatgagaatgtacaaaatacaatattgttaattttgttttgtactttgtgacacacctgtcagcacatgaaggtctgtataattctgttttttagctacataacttgcagttcaatgtgctccagtttatgtaattcatctctgatggtgattgatgtttaagttgttttggttttatgcaagtaagagagggatttatagttctcacagtgatttgaaatacaccatcccattgactttatctcacaataaaactggatattggtaaagcaattatcactatttactaaggaaggaaacagatatttacgtgaaggttatacttttttaagaatcagaaccacgacttgacaaagtcaagtttgtaatgtatacatactttcattataaataaaacaaagtggtcctatatgcaattaaaagtgagaaaaccatagtattttgtttatatagagttctgaccacagtgaattcaatacacttaggtacagaagtttatttttttgttgttgtttttgtttttgagagggagtcttggccttgttgccaggctggagtgcagtggcacgatatcggctcactgcaacctccacctcccgagttcaagcagttctcctgcctcagccttcctagtagcagggactacaggtgcatgccaccacacccagctaatttttgtatttttagtacagacatggtttcaccatgttggccaggctggtctcaaactgctgaccccgtgatctgcccgccttggcctcccaaagtgctgcaattacagtcgtgagccaccatgcccggctagaagtttttaattagtaaaataataatggttaacactaagcctgtgtttaacacatggaaatttaatgctataccatcttgtttttttgagacagagtctgtctctgtcgcccaggctggagtcactgcaacctttgtctcatgggttcaagcgattctcctgactcagcctcccaagtagctggaatgacaggcacatgccaccgtgttcagctaacttttgtattttcactagagacagggtttcaccatgttggtcaggctggtcttgaactcctgaactcaggtgatctgcctgccttggcttcccaaactgctgggatgacaggcatgaggcacggcactggccaatattacatcatcttatatgactcttaaaactgttacagaagcagtatcattaaaaacatcaacttaacaaggtctgtagttaaaatctgtatggtggcttatgttgttggtgtcaaaatttaaagtactgtttcaaagtggctgtggtggtgaaggaggtgttgctattattaatttgttagcctgaaaatggtgaacagaatcactgttttcatagtataagcatcttttctcttttcaactcagcttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgaggtaaattttaatactgttttctttgaagagtctgatagcagatgctgttgttctccctcagattactatactttcatgggatgttatggggactacattttgatgatacagacagaatctctgagatactatgtctggcatacttgtagtactcactatgtaatagacttaaaactccagttgataattaaacactgtttttttgtttgtctccaaagcacagttaatataatcgcattttgtgtgacatggtaaatgtaatttggtatttgaaaaatgatgaatctatttatttttaataattacattttcattgccttgttttttaaaatctgttatttcatttctttcactttttatattgtctgtgtttcataagctgtacttatttttaggattctctatttttctcaaattagagctctttctgctaaggaaacaaatttgtttctcagctaatgcttcacggacctgttaacaatattagttaacagttgcagtcaggctgcctatgaaatgtatccagttgaaaataaagcagtaaaaaagttaggttttagtggcagatcacatatttaagatgcaggtcttaaatacatgtatatggaaaatttgaagttttggtcatattttggctgggcatgtggctcacgcctataatcccagcactttgggaggtcaaggcgggcagatcacctgaggtggggagtttgagaccaccctgaccaacatagcgaaaccccgattttactaaaaacacaaaaattagccaggcgtggtggcacatgcctgtaatcccagctactcaggaggctgaggccagagaatcacttgaactcaggaggcagaagttgcagtgagctgagattgtgccactgtactgcagcctgggtgacagagtgagactccatctgaaaagaaaaaaaaatttcggtcatgtttatacttagactgtttatcttttacttttttgcatatatgttgataggaactaaatgcagaaacaaaaattgtaactgcaggaaatggttctccaatttctacatatcttcccttcagtgatcagaaatagtttgagtttcagattgtagtgtatcatttatggagattacaaacacttgctgccgcctttcaagatctaataaatcacaccatccaggcattcctatctgggtaactatacttacagtagaatctccatgtgggttgttgaccaataccaggttaagagccactactgaaaggaaattggaaattaagtcctacttttatagcccatgttacccatagggtgttgaatttaaaacagatagggatggcaaatcatactgacaagaagtaagtgaggccaacagaacataaactttcagattaggtcacccacctttgtgcttggttgcttgtgctttatgttgtctcagcactgtactatggcatgcatgtgtctgcctactttttctatgcaatgagcttctccagggcaggaactgggtattatttatttctgtatcacaaataccagatacagagcaaagcatatagaaacatgttagatatttgtaaagtagctgtattttgctctgtagctacaatgagattatgacctatggagcttctgtatatgctcccgtaccttccacagctactcttaataactttatttattgttaataattgtgataacattatgtaaattacttcatgaatctggaaaatgcattatgctcacaagaaaatactgagtcctaggaagaccaagtaacttattcccctgaagttacttacggcagagcactcatttgtctttactgctgtatacttgaccaaactttactatattacactacctctaatgtatttttttaactattcttttatgataacttatctgtgaaatcttttatcataacccatctgtgaaatgagcactaatattaaaaattaagtgctttggaagtaagaaatataaaaaagtgcataacatttcatttactaacttctggtatttgtttcagcttctttcgttatactgttaaagttagattagctcatcaataatgtcttttggtctctagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggtaaattatgggtgggtgatcatttaagtttcataaaaacctcaatacagtaaacttctaaaatgtagcttagaatacataattagttttatatttaatatttaaactgtactaatattctaattatccttcttggtcatagttttgttttattttcccaatagaatgttttattatcccaatagaaagaagtaaaatttgtcacagtaaagaaaggcactgtgttctttaatctcttaagatgtaatttacttcttcattttggaagacatcaattatataaaagcagccaggcacggtggctcacgcctgtaatcccagcccttttggaggccaaggctggcggatcacctgaggtcaggagttcaagaccagcctgaccaacatggagaaaccccatctctaccaaaactacaaaatttgccgggtgtggtggcgcatgcctgtaatctcagctactcggaaggctgaggcaggagaatcgcttgaacccaggaggtagaggttgcagtgagccaagattgtgccattgcactccagcctgagcaacaagaggaaactcaatcttaataaaaaatgatataaaagcaaaatactaaaacagtcatccccttgcttaaacagctctctgctgaagcaaatgtcaaatatattgttttatctatatagatttttttatatatccctaacatttttctttaagaagatgatcatggtacattatcacatataataaaaattactttataatcttgggaaacatggcaaaactttgtctctacaaaaaaatgcaaaaattaagcatggtaatatgaacctgtagtctcagctcctttagtgagtggaatatcatttcattcactaacttttgttcttagtttctttcaacttctttcattataagttagattagtgcattaatgatatcttttggtctctggagcagtgttgatccctgaggtgatgtatcataatcaccttgaagaccagcattactcataaagaaatgaacattttcaccactagaaaggaagtcccccttcctagtctggcaacaaaaaatatatgtgtattattatatatctttatatactgtatatattatatataattataactttatatttttatatatataggtatatttttctttacaaatttgtaaagtgatgattccctaacatcctccaaaagtgaccaataaaatttggcctctttttaggtttggaaaacctcaattaggccagctgcagtggctcacactagtagccccatcactttgggaggccaaggcaaacagatcacttgagcccatgagttcaagaccaccctgggcaacatggcaataccccatctctactaaaaatgcaaaaacttagctgggcgtggtggcctgtgccagtagtcccagctacctgggacgctgaggcaggaggatcacctcaaccgtaatggagccactggcctccagcctcagcaacagagggagaccctatctcaaaaaaaaaaacaaagaaagagctcagttacatcttgaacttgtcttttttgtttgtttgtttcacctattttatcaaggcctactttgtgttatacatgctactaaacactgtagcacaactttttactatatactgtaatacatgctcttcctaatgtgtagaaaaatgctgctgcccctcataagaatttagagttctttcaacaagatacttccttgatagctcagagataggaaaggaaagggctcttctgatttctgagctgctttttctgttgcacttatggcagccacccttatatgtattagcatatcactttgattccttttgaaagtcacaaacttacagtacactgactccccattatatctctcagtataaatttctgtattctgtagctgagctgtaagcctagattataagtacgatatgcatatataattcttcttttcctctttcagttatgtaacttcacacgtgccttgctcccctttttacctgtttcaactgtttttttctttccctagcgtatgctttctttacctcgacttttttctgcaatctagtcaacaattctgttcctgttcttccaatttactataacacttttagatttgtcttcaaatctttcacttaataatatatgtgtgataactgaatacacagttacataattatatacattatagaggaatttcatacacacatatatagatatatatcgttttgcttctttataatctgtatttaaatgtattaagctataatgtgtttgtacttaaatatgtatgtttttgtcctctcagtgattctctccaaataagtgtggagctcacaatttgtcctaaaacatttgtgttacacaaactgtagacacatatgttcctattacatttttttcttttgtggtaaagttctcataaaattcaacattttaaccatttaatagtgtacaattcagtgctttttggtacattcagaatttttgtgaaaatatcactaccatttggttccaggacattttcctcaccaaaaaaagaggttccctgctcattaaagaatcattcagcccacttttctcttcttcctaccccgacaacaaaaaattacttttctctctatataggtttgcatatttttgatatttcttgtaatttaatcacagcatatatggcctttctgtctagcttctaatgttaaatatggtgtgtttaaggtatgtccattttgtaacatgtatcggcactttgttcattttatggctgaattatatttcattgtatgactagaccatgttttatttatccattgattaactttggatggtttccgtctttgagctattgtgaatagtgcctctgtgaaaattcatgaacaagtttgtgtgtggatccatgtttcatttctttttggagtagacctagaaatgcggttactgggtcatgtggtaattctatgtctaattttttgtggagccaccaaattggtttccaaagcccctgtagaattttacattttcttttttttttttttttccttgagaagtagtctcactctgttacccaggctggagtacagtggtgcaatctcagttcacagcagcctttacatcccgggttcaagcaaccgtcctgcctcagcctccctgcctcagctcctgagtagctgggactgcaggagtgctccatcagcactccaccacagctgatttttgtattttcagtagagacagggtttttagtagagatgagatttggccatattggccaggctggtctcaaactccagacctcggatgatctgccgaccttggcctcccaaagtgctggtattataggtgtgagccactggccctggcccagacatttacattttctgtcagcaaattatgaaggttacagtttctctacatctgtcaacacttgctgtttccttacttttagtatatccatcttgaaatatgtgaagtgtatcttattttgaatttgatttgcatttccctaatgactgttagtactattgagcattttgcatgtacttattagcaatttctgtacttttttgaggaaatgtctgttgaagtacttttctcattttttgattgccttttgttgttgcattgtaagacttctttgtatcttttttgcgtatttgtgatattaggcccttaaagataaattatttagaaatattttctcccatctgtggattatcctctcagtatatttatagtacactttatgcttaagaggttttttctttttttttttttttcacagtatcactctgtcacccaggctggattgcagtggtgcaatcttggctcactgcaacctctgcctcccagattcaagcaattcttctgcctcagcctcccaagtggctaagactaccggcctgtgccaccccacccagctaatttttgtgtttttagtagagacggagttttaccacattggccaggctggtcttgaactcctgacctcagatgattcgcctgccttggcctcccaaagtgctgggattacaggcgtgagccacagcacccaggcaagagttttaaattttgatgaaatcatacttatctttttttttcttttcattttcaggctcctcctgtgatttactatttctatcgtggcagaatgtgcataacataaaaattcacccttttaatagattttagttgtccaggtgactggcattatatacctttacgccactatatccgaaggttttgcatctttttttgtttgtttgtttgtttgtttggagacggagtctcgctctcttgctgtgctgcagtgcagtaacgtgatctcagttcactgcaacctccacctcccgggttcaagcaattttcctgcctcagcctaccgagtagctgggattacaggtgcctgccaccacgcccagctaatttttgtatttttagtagagacagggtttcaccatgttggccagggtggtctagaactcctaacttcaggtgatctacctcgctctgcctctcaaagtgctgggattacaggctgagccaccgtgccctgccagtttttcttcttttaaattgaaactttatattcattaataatagctccctcatatccccatattgattttgaggtgctgatttggaaactttgttgaattattttatcatagtgatgtatacttgtgtgtaatcgttaggatttcaatttggatgctttttgtttcttatttctttaatgattgtctaggagaattactgtgtcaaatagaagtggtaaaagtgcatatctttgagttgttcctggtcttagaggaaaagctcttagtctttcatcattaaaaccttgtcttagacaagcttgtccaacctgccttatttcattgttatgttttgttttcttttaggctaaaagcagcctgaagccatgggtttttagtttctgtgtctagtgataagattaaacgagggtgaggaaggaactttactggcctatcaagaaacagaaactcagaacccatgagtgtattctctcccttggacaatcctgccttagaccatatttaaatattgactcagtatgaatcaaagctaaacataataaataaaattttataagtttaaagggaaaatttatgacattggatttggcagtgatttgtttgattacatcaaaagtacaggcagcagaagaaaaagtagataaagaataaaagtcatattctgatatccagtgaaaatatctcttagtagttactgggatatacatttattctcatgagaaaggaaacttgtgaagaaatttctaaattctgtcaaaagttttggcagaaaggtagttaaacacagggacacatgtaattgcaagaaagaatacaagcaggaaatggtatatgtagtagtcttatttttctttcctagtttgtttaaatttctatgagtattgaaaataaaaataacattaaggggtaattatgcatggttttagtatgtttgacaattatatatggagaaaagtaaatgcttattatttggctgtgaagcttctgtatcttaatggaagtggtaaaatattaacactgtgataatgtaattcataaagcaattgtatataatttatacatatattctgtatatgtatttacatacatatatatttgtgtgtgtttatgtaaaattacacagacatagacagctaaacgtacatacagaaataagtacaagtaaaacctagagaaatgtaatttaagattttggcttgtaccaataatagtatcccaattgtgatactgtgttacatagttttgcaagatgctattgctggggaaattggataaaagatatctttattaaaatacagaaacagagaaaacagcatctctgttatttcttaaaactccatgtgattctacaattatctcaacttttttaaaaaaaaaatccaagcttggaaaaagaaaataggaaatcactaaccaagaaaagttgaaagaaccatcccaagtaactctggaagacagtgtattgagtaggtactgtaaagctaaataaaaagaactgtacagaagtactaatctctgcaattctatttccaagtgttaccaattctggaactactttagatgtttattagaggtgaacaaatctagcacagataataacagccaggattgtaatttttgtaaagataagttacaggtaagggaaggtaggtggcttgagtgaacagtggtatgtagttgtagtcatgtttattttaaactacatacgtggtgtgatatgtatgtatgcttcttggtggttgtgtttttgttggtttgtttgtttgtttgtttgttttgagacagagtcttgctctgtagcctggtctggaatgcagtggtgcaatcttggctcactgcaacctccacctcacaggttcaagcgattctcctgcttcagcctcccaaatagctgggatcgcaggcaaccatcaccatgcccagctaatttttttttgttatttttagtagagatggggtttcaccatgttggccagttggtctcggactcctgacatcaagtgatctgcccccatcagccccctaaagtgctgtgattacagcttgagctgagccaccatgcgtcttgtatatatgttttaagtttagacacatacatacagataggcgtagcaatagagatatgtgtgtgtgagcattgatgtggtatatacacatatatttccaagttctgtgcactgagaatgtctaaaaataatgaccccaataatgtaggtgtctaacggttggtacctagagcttaatttgtacatagttatctaggcagttggtatctagagcttaatttgtacataggtatctagcagttggtatctagagtttaatttgtaagtaccattttctgatgaaaaggaaccagacctgcctggaaagttggtgtgttcccaggcaggagcagacgactatgagcatattggcctagatgcaagccattaaggaaattgtcaaaaaagaaaagaaataataccaagtcagcataggagccaactgaaaagctctcgtgtttaatattgaaacaattttaggaaaaagataaataataatagtattagattataatacttagcataaaataaatgctcatactgatagaagcaaataactgaataaataaatgaaggaaatagagtaacaccattagagcatcacagtaataactgatgcaagaaagattcactgattaccaaaattagtggggaatagttgaacggtaaacagtatattttcttttcttttcttttcttttcttttcttttcttttcttttcttttctatttgaaatggagtttcactcttgttgcccaggctgaaatgcaatggtgtgatctcgactcaccacaacctccacttcccaggttcaagcgattctcctgcatcagcctcccaggtagctgggattataggcgtctgccaccacgcccagctaattttttgtgtttttagtagagacagggtttcaccatgttggtgaggctggtctcgaactccagaccctgggtgatccaccagcctcggcctcccaaagcgctgggattacaggcatgagccaccatgccaggccagtaaacggtatattttcatataggaattattaacctgttttgtaccttaaaactaggggagcagccaggtatggtggcttatgcctgtaatcccagcactttgggaggccaaggtgcgcggatcacttgagcccaggagttgaacactagcctggctaacatggtgaaacctccatctctcctaaaaatacagaaattagctgggcatggtgatgcatacctgtagtcccagctactcaggaagctaagggaagaggattgcttgaacccaataagttgaggctgtggtgagctgtgattatatcactgcactccagcctggacaatagggcaagatcctatcttaaaaaaaaaacaaaaatgaaaaagaaaaaaaaaggaaagaaaaaaatacagtggagaaaatagtaaattaaacccaaaacaagcaaagatttttcagaagtactagaaaccaatgaagttggaaaaaaaaaaaaaaaaaaagaagtgatagagaaagaaactttagagtagtgctaaaaatgaaaacaatgtgtttttacttcttgtcagcttgaagtaatttggacttaatttgcctcctttggtgaaacaattttttaaaaatatacagataaagtacattaaactatggcttcaacacattaggcatcagacaaaaaaggaatattattcttgagataggaaacaaatgagagccctgcagtagccttagttagtctacagtgtagggtgggacagtgaatcagaccaatggaattcctgacttaaggaaacattgtggagaatccaaggagactaaaggatctaaggtttgtaatagtgcatcagagagctgcattaattctagtaatttttatttctccttgaatattcaagagagaactaagcactacatgtaaatcgggaaacaaattggggtaaggaaagaaacacatgaaagaattagagggagcagtctaaattctcacagaacaggaaaaatagctgttcctcccagccacattagaaaaactgttagttcacagggtatagagtatctagaagagccttgttcggtaccaaggaatacttattcctatactatgcactgtttttggctacctaaagtgtgaacaggaaaatcaaactacgtctcaaaccaagctagagaaagtttaaaagagtacagaatatcaagcattgaataaggtaaaattcaaaatatctctatctagtcaaagattatcaggcatgcaaagaagcaggaacatatgacctaccatgtgaagaatcaacaaataggtggacctgacctagaactgactcagatgttaaacgataaaaacttttaaaagtttttgtaatgtatattcatatgttcaaaaagttagagataagcaaaattacaacaaagctctgcagatgaagacttaaaagagatgaaaaatacgctaaggctgggcgcggtcatggctcatgcctctaatcacagcactttgggcggctgagaccggtggatcacctgaggtcaggagtttgagaccaacctggccaacatggttaaacccatatctacaaaaaatagaaaactagccaggtgtggtggtgcatgcttgtaatctcagctacttgggaggctgaggcaggagaatcgattgaagccaggaggtggagtttgcaatgagccgaaaccacgccattgtactccagcttgggcaatgagtgaaagtccatctcaaaaagaaaagaaaaagacgctaaatgagattaacagctgataacacactgcagaagaaaagatctattaaatgtattcattataaaacacaagggtaaaatgattttctaaaacaaaagagtatcactgagctgtgggacaaccttagatgatctaattaatttccccaaaacaggagaaggaaatcaaaaaaaaaaaaaaaggcattagaagatatgatggcctaaaactaaataaaaagtttttattaagattcttcaagaactactttgcttgatagcaaaatatgacaaacatttaaaaatactgaaactacagaccacatttctggtgttagatgcacggtttctaaaaataattttggaagttgaagtgaacaatgttaaagacaatacctgatgacaaaggagaatatattttaggaaagcttagttggtttaaatcaattaatatacttacattaaacaaactaaaaaggaaacttatatgatgacttcagtagatgtaagaaaacatttgacaaaatagattttcctgataaacatcagcacaactaataatgaaagaaaacctgataaaaggcatctgcagacagcctacagctatcatgttgaatgcaaattcattattgtgagtggaaaaaaaaagacaggaatggtggatatcgtgtgattgtattagtattaaaattatagaaaatggaaatattctaattggcagaaagcacaaagtggttgcttgagatgggaagaatgggatggcaggggcaaaatggagaggttaaaaaggaaaatcatttgagtgttggatacattcattatcttgactgaggtgattttacaaggggtgtgtgtatgtgtgttgttataatttatcgtttatgcttctgtttactgtatatgaacactctttaccgaaacaaacaaaaaaaccaacaacattgaaaactaattgcagcttctgaatgctgaacactgaaaaaaaactgcagagatcaaagaaggtaaaaattgatagaaaaaaactcacaacgatttttttttcccacaagaccatgcagataccatactatccctttaatgaaagatgaaatattgctaacatgtcagttcttcccaaattgatttataaacctatgttttctatcaggatatttacatatattaatttaccaattattagcatgaaaggaaagaggacaaggaaagctaaaacaatttgggaaaggaaatgatccaaattggagaacttccactgcgtgatttcaagactgccattaaagccacaaaaattaaaacatggcattaataaaaggataggcacaaagattaataccatgtgtagctttggaaaataatgtatactaatatgactaatgtcccagatcatttaatgaaaagacttcgcatttttcccatcttggggagagaatgcaaagtcttcacttttagtgatttgggacaactggacattcatatcctttcccctaaagtgaacctcaacctgtgccttatacaaatttaatgcaaaatgaaactcagacctagaatgtgagaatattgaagaaaaaccttttgtcactttgaattgttatcaaacaatatttagatgataattcataaatgttgatacgtgtgacttcatcaaaaggaaagccatatactcttccaaagacgacattaggaaaatgaaaaggcatagcatgggaaaaatatttgcaaaatacatacaaaataaagaattttcctagctcaatattaaaaagtacataattaaaattcttaaaatatttgaaaacttaaccaaagaagataaatggtataaaactgtgttcaacatcattattcattaggggtttttatgttaaaaccacaacagatacaactacacccctgtttttttctggtgctggtttggatcaggagtacatgatactcagccgttactgataaaattttccaaagttgtgatcctttgggaaactgccagtttcttacaaacttattcataaacttaatgtacaactaagcaggctgactcctggatatttatcaaaatgaactgaggactaagatagagcctgtctgtaggtatttatagcagctttatcagcagtgctaaattgcttgtgtcccagcaattttgggaacaacttttgtcccttgaatggctaatagataagtaaattctggtacattcatatggtgaaatacaacacggcaaagaaaaaggattaagctattgacacactgagctgagttaaaggttcacattcattgtgctaaaggaaagcctcaaatctacatctaacatatagaagcctgacaaagatgctgcaagaaaattatagaccagtaatccattatgaacatggatgcaaaattccacaacaaaatactagcaaacccaatttagcagcatgttaaaagaatattatatcatgaccaagtggggtttattctaagaatatgtgcatgattcaacaagtgaaactaatcagtgtaatacaccactttaataaatgagcaaaaaatagcacattgtcatctcaattgagatggaggaaacatttaacagaactgcctttcatgataaaaacatgcagtgaatacagaacagaaggaaactgcctcagcttaataaaagccatgtataaaaaactctgagcaagcatatttgtaatataaagcttttactctaagataacgaacaaggcaaagctgcccacttataccaccgctgtttaatataatactggcagtcctacccagcacagttaggcaagaaaaaagaagaggcatccacattggaaaaggagcagaaaaattatctctgtttacacatgctgtgatgttacatgtataaatttctgaagatactcctacgaaaactgttggagtaaataattgaattaggcaaagtagcagaatgcaaagtctcacaaatatcagttgcatttctatacaataacagtaaacagtcccaaaaagaaagtatgaaaacatttatatagccatcaaaaaataaaatacttaggtattaatttaaccaaggtggtgaaagatttatattgctctgccatataagatgtgcttgcttccggttccctgtccaccatgattaagtttcctaaggcctatcagtcttgcttccttacagccatgtggaaccgagtcacttaaacttttctgtataaattacccagtttcagtacttaacagcagtgtgaagacagactaatatgaccaaaagatttgaataaatgttttttcaagaaacatacaaatggctaagaggtacatataaaaatgttcaatattactaatcataaaggcaatgcacaacaaaactgtattgaaataccattttagatgtattataatgaccattataaaaatagtaattgctggtgaggctgtgaaaaaattgaaacccttgtgtactaagggtgggattgtaaaatggtacagccactgttgaaaacatatagtgcttcctcaaaaagttaaaagtagaagtacagccgggtgtggtggctcatgcttgtaatctcagcactttgggaggtggaggcggacaatcacctgaggtcgagttcgagaccagccggaaaccccatctctactaaaaatgcaaaaattagctgggcgtggtggcatacacctataatctcagctattcaggaggctggggcaggagaatcacttgaacttgggaaacagaggttgcagtgagccaagattgcaccactgctctctggctttgatgacacagcaagactctgtctcaaaaataaatcaataaaagtagaattaccatatgctccagcaatttctcttatttccctggtgggtataaacccaaaggaattgaaagcagggtctcaaaagaggtagtgtacactcggtagttagtgacattcacagttgataaatgtaaaaatatttttagtttgtatcatctgataaattgataaatctatatacatattatgaaatgttattcaccattgaaggaaattctgtaatatgctacaacatagatgagccttgaggactttatgctaagtgaaatgatccaagtacaaaaacacaaattctgtatgatcccacttacatgaggttgtatttataggtaccaaatgaatgctgattttcagaggttgtcaataagaagtttttaggggttgtttaatgggtataatttcagttttgcaagatgaagagaggtctgagatggaatggtgtaatggtagtacagcagccatcatgaatgttcttaattccactaaactttacacttaaatgatttaaaaagtaaatgttgtgttgtatttattttaccacagtaatattaattaaaaacaaaagaataaagccacattccagttcatcagtattcttaaagggtggccttaaagttgaatgaatactccagatgtggtaccagatttctctttatgtattagtgaagcctaacacattagcattttacccctttattagttacattgtcctgttgacttgtactgacaaactaaaatctcctggttttataaagaatcctacttgttctgtgctcctctctctttaatttgctgtcatacttctaaattatcgattacatttttcctgattaaatttaatgtcttttttaaaaaggataaaaagtaaattatgtaaactctaccacaataataaaaaggatggaaacactaaatctatatgctttcctgtatgtaatattctagaaaaggctacttcagatttatgaagaacagatcagtggttgccaggaattaatagcaggagattcatttggcttacaaagtgctactattaggaaatttaggaaggtacttaagagattgtttgatactccaattgtggtggttacacagctggctgccatttgtaaaactcacatcctatggcttcaacagagtagcttctattgtatgtgaattttattgtatgtattaatatttaaaatttatttttaaatttataacaatttttttaattgtgaaagttcaccgcaaagaaaaacacagtgtaccaccttagcaagttcaaaatattcccataccttttgctaaaaatgacattttctgatgcttattattaggaaaatattgttagatgttctcaatagcttccagaataacctctttcagcagcattagttctcattttgtatacttatcattggtattttcttaggattggttcaccttttatgcctatttagattactgaaaatatgtttactctagaacggggaaacctttcacttttcacttggaaaaattgctttgatgaacaatggtaactaagtggtaggatcttttcactatatcaccagaaataagcagaataaagttttaacgcagtagttatagcatccacataagcattaggttctttctcatgtaaatgtcattttttacttgaattgaaagtgcttgaatatactgtgctttatgaagcaaacattattctaaacctactatccagcttagtcacaccatttataactttttgacactgtagtatcattattactgtaagcacttcgattgtgttgcatctgcaaacaatgtgcgtttctcctttctatgtggcttaaactctcagcttatgtttgtcattgttatttttgttgttataaaatatggatattctaggcatgtattacataactcattttgtttcctttccttcttaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccaaggctgcccacataggtaagtgctaattatgtttttaatgtatacttcgtgttgttttttttttaataatagtgtaaatctttcattagtacttatataaaagcagagtgtaccaaaagcctaggactatgaatgaattaaattcatatgcatactacactattctgatttttttcttcccaggaacatttggttagtacttcattacttcctcaattcattcttgtttgctttgtcttatcctgtgtcttaaaatggcattttccataaatctacacttattctttaaatagacattttctttttatgttctaactagcaatcagaatatttagatggaacttccaaagataattggcaagactggagtagtaacccattattcatggtttcagtttccacctcatcgttcactttagaaggccgaagcaggtggatcacgaggtcaggagattgagacgatcctggccaacatggtgaaaccccatctctacaaaaatgcaaaaattagctgagtgtggtggcatgtgcctgtaatcccagctactcttcaaaaaaaaaaattaagtggaagactccagaaataaacaatttataagttttaaactgtgccccattctaaataatgtgatcaaatttggggctctcctgctttgtccttctcaggatgtaaatcatccctttttccagcatatccatactgtctctgtgcctgttatctacttagttgctgtctcagttgtcagattgattgtcaaagatatcacacaacttagttcaaatacctcttattttacttagtaatattctggtaattcagatgcgccaaagaaaaggctaaaagcggctgctaatctattcctgtgcatcatttataaattaaacataatcacacttaagtatgtatgtttaggaagaaaacagaatatacatagtatacagagttcaatgctatctgaggttttagccatctcttggattttgaaacatctccgaaggaagtaacatttaaatgacttaaattactctcaattcttactattcttgagaagtgttacatatgcttgcacatcaaaccacttagcaagatttgacaagacaggaaacagtaaaaatatcagtagcataaataaaatatttattctaactaaacttgttattagcatccaagacttctatattataaggcattgggggttgttttgttttgttctgttttttgagatagagtctcactctgtcacccaggttggaatgcaaggacacaatcacagctcattgcagcctcaaccttccaagctcaagtagtcctctcacctcagcttcctaagtagctagcactgcagtcacatgccataacacccagctaaatttcgtatttcttgtagaattagggtttcaccatgtttcccaggctggactcgaactccaggttcaagctttcctcctgcctcagcctcccaaagtgctgggattacaggcatgagccactacaccttgccagagtatcacttttaattgtaggatcttttaattattttattctctaagatagccttatacttctctatggggtggttcctgatcaaaagcaacttgcataagtcatttataaatgtaatttcatttttgtgactgtcttgtttttcctgaataaatcaaaagtttccaactgtgagaaactggccagtggtggtagctcacacctacaatcccagcactttgggacaccagcactggcagatcacttgatgtcaggagttcaagaccagcttgaccagtatagtaaaaccccatttctactaaaaatacaaaaaacttatctgggcatggtggcaggcttctgtaatcccagctactcaggaggctgaggcagtaaaattgcttgaagccgggaggcagaagttgcagtgagctgagatcgcaccactatgctctagactgtgcaagagagtgagatactgtttagacattttgaaaatattggttagatgaatggatttgatggttgacgtgcctgccccatctcattttctgagtttgtagaaaattaccataatctgtgatgctgactcagtcccacattatttactctctactccacttatttatttatttatttatttaagacagggtctcactatgtttccctggctgaagtatagtgattattcaaaagtgtgatcatagcacacaacagcttcaaactcctggcctcaagtgaccctctcctacatcagccttttgagtagctggcactacagacaaatgccaccccacacctggctctctgcttatgtttacgactttatagacaagaacaccagaggcatttaagcatgataagtgtttgaacttacacattaggaaagtgtttatgacagaaattgagggacacttaaaaataaagttcattaatggtttagtataggctttttttagagcttgattaattcttatttttacctcgtcatgaattactgtttaaacagataatatgtatcatagtgtgatagaacataaagaacttaagaggtaaggccaaacaagctggttttcaaagcatcattccacctaataaactgtatcaaattattctttttgacttccctactcaaccccattgtcttagctttaaagtagggatggatatgtacctctaacagggcttttatcaaggtaaagatgagctataatctgtgtaaggaatctaatacagtgcccagtacaaaataagcaactgataaaagatattacttattaataacattgtatgattaatatacttgacatgatgtgttaaatactgcatatgtgtttttcatcaagttcacagttaaggaaaagatgtattcattattacttttgaaacggagtcttgttctgtctcccagacactcgagtgcagtggtgcaatctcagctcactgcaacttctgcctcctgggttcaagtgattcacctgcctcagcctcccaagtagctgggattacaggcatgtgccaccatacctggctaatttttatatatatatatttttagtagagatgggatttcaccatgatgggcaagctggtcatgaactcctgacttgtggcgatccgcctgctttggcctcccaaagtgctgagattacaggcatgagccacggcacccagaaggataagatttagaaaccaggctgggcacgatggctcacacatgtaatcctagcatttggggaggatgaggcagaaggatcacttgaccccaggagttgaaggacagcatagtcaagagcaagaacccatctctacaaaaaacaaaacaaaaaacaaaaaaaacttgcctgggcatgttggtacccacttgtaggcctagccactagggaggctgaggtgggaggatcaccaaaggcagcagtccccaaccttccagcacaagggaccagttttatggaagatcatttttttcacagactgaggatggggggtagttttggggtgattcaggtgtcttacatttactgtgccctttatttctgttattattacattataatatataatgaaataattatacatctcaccataatgaccataatgtagaatcagtgggagccctgagcttgttttcctgcagctatatggtcccatctggaggcagtgggagacagtaacagattatcacgctttagattcttacaaggagtgcacaacctacatcactcacatgtgtagttcatagtagggttcttgctcttttgagaatcgaatgctgtccctgatctgacaagagatgaagctctggtggtaatgcaagccatggggagtggtttaaatacagatgaagcttcaccagcttgcctaccactcactggctgctgtgcagcccagttcccaataggacacatatcagtactggctggggatccctggcataagcccaggagttcaaggctacagtgagctgattgtgccactgcacgccagcctgagaaaaaccctgtctctaaaagattaaaaaaaaaaaaactaaacctatagaatacattcttttaatttgtttcattaataatatctttaggtatgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggtatttttttttacttttgaaaaataatgattgcattgaacagaataggaggacattggagttgtttatgctcatcttcaaaattaacttctgctttatctctgctgttacagtggtagcagagaggtggtcaacatgataactggtttaaagcaaaataacattgagaaaatacagtgcgtggcagactaggaaaaacagaacatttttattgggtgaataattttgaaagtcatagaatcttacaagtttttccatctctgccctgaaatcaattgcaattgaatgcttcaatcttgaagagttggtagtagaaaacattattttcttactctagtttcctcttgaagtagggaagcttgctaattttattgggttacatcagattttcacaaccacgtgtagtttcactaacagatctcatttttttgaattttttttttatttcagacggagtcttgcactgtcatccaggttggagtgcaatggtgtgatctcggctcactgcaacctctgcctcctggttcaagcaattctcccacctcagcctcccaactagctgagattacaggcacctgccagcacgccaggctaattttttgtgtttttagtagaggcagggtttcactatgttggccaggcttgtcctgaactcctgacctcatgatctgtctgccttggcctcccaaagtgctgggaatacaggcgtgagccactgcacccagcccagatttcattttttgggcctagccagctaatttttatctctggcacttagtttgggagatggaatgataacatgtcttttaagatattatatattaaaaaatgtatgtgttttccttgaccttcaaaacccctcaccttcaagctgcctacatggttttgaacttatgcaccacttagattgtggtttgtttataaagccatactgcctgttacccacacttctgacagttgggactatttcttctcaccctttctgctactcttaatccacatgttttaaaataattatacataggtagtacctttttataagacagtgaggattaaattcattaatatgtgtgcagcacttagtgtattacctggtttttaagtgctataaatattagctgctattaaaattgcttatcatatgtcttcagtttactcacagcaaattctgttcattagcataaaagaaaacatcagaggagtaacacagtcaagtaatagtggccatatggaactacatagccatcagtgtctttatcagtaatgttttccagtttgcaagaaatgaaggacctttcatatccacagcttctgcaaacaccatttcctctaaacatgtatgaaaaatatttgaaaacaaaaaataacagtactaccataaaaagtaatataaattcaaaagccattacagtgtaataaccatctacatagcatacttaatacattgtattaagtaggttatgtagagatggtttaaactatacaggaggatgtctgtagatgatatgtaaatactgctccattttaaatcagaaacttgagcagacacagattttgatatttatgggggtcctagagccagtcccctacagataccaaaggatgagtatatttatatatttttagctttggtaagtaaggattctttaagtcagttatgacataattaccctgatggtatttatttttatttactcatctgcttataaataaatttaaatagactgtaaactttaaaattaacatgaaattgttttagtttctgttctagttacaagagaacatttgtttatattctctgtttattataggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacttttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccaggtaagctttgaaagtagcttcttctaataaagaatagtttttatttggcttctaggataccttacagggcatcaaatgtgtttcacctttttcttcagttttcttttattttttcatagaatctttaacctcattttatatgaatgtgttggcttttttggtatagttattttaaaatgaaaaaattatgatatctgtacctttgaacagtgattcttaatatatggaaatatagaaaagcatttgttgtagtaattactattttttactcaagaattagtttgaaatatgggttagggaaggggtaagataatcactaagaataactaagattttttaacatagagtttgaagataaaaatgtttttaaccatatatatactttttatttaaagggcaggattatttgttgcctgaagcagaagaaattactatgattagtattcagcttgctgctagattcctctttaccactggatttcacaccaagaaaatagttcgtggtcctgccagtgactggtacatggttttggatttcattcttatagtacttatagttgtttggttctttattttttcctgttttattttttcctaaccatgaaaatatcatttcaaatttaaaatatagaataaaaatcttggcagtagtcatgagataaattaaatgtgcctttatttaaaaactggctcctagtcctgtgaatttgtatcatatctgagtctatttcatcatttaattattttatttttactagatgaaattctcacttatagttaaaaaggtagatgatttttaggtcaggtgtggtggcttatacctgtaatcccaacacttcaagaggccaaggtggcaggacttgaggccaggaatttaagaccagcttgggcaacatagtgaaacctcgtctcaacaaaaagttaaattacctcagtgtggtgactcacacctgtagtcctagcactttaggatccacctaatccaccacaggctgggatgggtagatcactttaggcctggagtttgaggctagcctaggcaacatagcaagatatcttgtatacaaaaaaaaaaaaaattaaaataattagctagtagcttgttcacgtagagccagctacttgggaggctgaggcagtagtatcatttgagcccaggagtttgaagctgaagttagctgtaattgcaccactacatttatttcagcttggtcagtagagactctgcctctttaaaaattaaaaaaagacaattttaaaatagctgtatagttttaagttactattaattataaaagtacggaatacattataatgccttgatttaacaactcttagcattgctcacgttgaaagatattaaagaaatgttacttcactggggagagtttgatcatggatttgcagagagctacatatatttcgtatttcattcctttttttgactctgtgggactaaagtcacacagctttatcaatctgatatttgtactaaaaccaactgaccgttaattggagagaacatctcagatcgttgtttggttcataaaaatctgtttcttccatgtaccaagcaaaataaacacatcactaaaatttgacgttcatagatgtttctgttttaggtatgatgcactgtgcgttcttctccgtcacagcaaaaatgtacgtttttggtttactcataatgtcctttttaatgtatcaaatcgcttctctgaataccttctggagtgccctagtgcagaagtgaggggtgcatttgcaaaacttatagtgtttattgcacacttttccttgcaagatgggtcttgtccttctccttttgcatctccaggaccttctagtcaggtaattgcatggctttttttttttttaagcaattaaatacttagaagtaaattctgtttctgcaaattcatattagcaaatttatgttcctctctttgatgtattcaccataaacaaattcatacgtatgttatgacacttgtgagttcgtaaaattatttcatggtaatagtgattgctgggcattctgaaaaagaagggaaattccttttgtgtattcaattatttagttatttagtaaatccttaagtttgacatttttaagatttatttttataatggctaaaggcttttcagtgaaacactgtaacatgaaattgacattagtgataatgtaaataaataatccacttaaattcttctgttgaagttgccagggctttttgtttgtttgtttgtttgttttacagttacagtaacatacaagatctacaatgaagtctagccgagctcttcattctctctctcaaagagcaactatatttaataattttctttctgaaagatttgctccgtataggaacataaccttttgtatgcaaataaaagctgtttctgcatcttgatgctgataaaataatatttcatttttcacaggcatgtgataacttgagcttgagtgaccacttactaagagccacactaaatctcttgagaagggaagtttcagagcatggacatcatttacagcaatattttaatttgtttgtaatgtatgccaatttaggtaagaatttttcacaactatattaatgattgtttcaatttcaaatattaaatgggaagcacattttaatcaagtgattacatgtaatttgttctgaagtagaagcaatataccatattcatattcttaaaatgcattgcaaattttctgtgtaactttaatggcatttctcatattatatggtaatttatgcacttgttttatttctctggtaatctttaagatcacatactttgtctgattgatgttatctcttaacattgctttttgaaaaatactggcttcctggtcataccccacactatctgaatcagaattcctagggcttggataaggaatccatatttctaaaggaccccaagtgcttgtgttgcttatcaggtttaagaattatttctttaaagaatttgacatgtacatatgttttattaaaataaactaaattgaaattaataataatgcaaatttataatccactttaattcttctgttgatattaatattaacatcaattaagaaatgtgattttcagtatatctttcttaaggtagcctgctttttctcacatcaacctatttatttcttcttttgagtgcctctagaatgcttacccaaaaaattctgtttggcttattccattgtgttttgatggtttttaaaatatttgccttactccccagctaggtagcagaattcttgcaatgagtggggattgcatagaacaactcagtcattgttgaatgcatggatagattgccaggaatccacatcaaaaatcattatagtgttttcaatgttgttttatgttgtttttattgtgtggaaagaagagtaaatttattacagatgtagttatccaatttgaatatcagcaattcaggtgttagtacaacaatatttcaaaattaataatttattgatataattaaaatttattgactagttaaaattttagtgttagtaataagtatttgatcacattttttgaagatttgactcaattagcacatacacttttatatctatgatatttgtgatttttaaaagttaaattttataactgtgtatctatattacacttttatatctgtggtatttgtgatttttaaaagttattcagctaacttttaaaaatcacaaatatcttactacctaaagttaagttctgtagtcatgcattcttctaatgaaagtgttatatgtgttattaatctttaacttgagcaggaagaacattttatcagttattcttccttctctgatcatctctgtgttttctctttctctgccttgcctgactacatatgagattcctggatacttgtaatagagtaagaagcagatattacacaaacataaatgaagtcacttttatattttaaatataaaagtattaagtttatgcattcacaaaaatcctattttatactattttattttagatattggctgctcatatacaacacattgatggtttataatacaacttaatgataattttccctgccaagaattagtgtagatttatgactcttaagtcattagggcagtatgttttaggttttagaagtttttggatttcagaaaaatgagacaatgcgtttgccacacgtcgtgtgagattcccagtaaggcctcaggcagtaccctacaatcaaacatgctaatatttctgtgatgaataattaatatttcctttaagggtggaagaagcagcttgccaggagaaaggggttggttaggattttttaaacagagtggttggtgcatgcaggcttagtattgacataactttgcttcttagacacagtgtgaggtattcagtgtgactttatacagtgaagaatacagaatagcaggactgatttccaggattctctaattatgctactctgattttgtaaagtgttctggacattatcaggagggcatgaatggaccactagaggatcacaagaagcttaacttaaaaacatcacactgtctataacgtagaatggcttacgatagaccaagataagaaagtattaaaaattatcaatagaaaaaaattgcggctgctttatattagggaaactggcagtatggaagacaggtatgaacagatgcaggagctctttatgagttagaatcagcaggagttggtaatttgatatttgagaaagcggagcaggaaagagatgttaagcctacatccagcatgtgacttgatgaactgagaaaatagtagtgccattttctgatagaggaaaaaggagttgtgtgagcagattgcattttaaaaacatatgggatacctatataaagaaatccagtagtgggatacatatgtccagaatttggaatcatctaaaatcatttggatacatctattactatagatgtagttacaaaaaacaagccacgtaagggaatgtcctagaatggaaactttttctagaacagtttttatggctcattttatttagtttctgtcttactttgttttatttttatttatctattttatttttctgagatagtgtctcgcttagtcgcccaggctggagtgcagtggcacagtctcctctcactgcaacgtccgcctcctggattcaagcaattctcctgcctcagcctcccaagaagctcggattacaggcaccaaccaccacatcccagctaatttttgtatttatagtagagatggggtttcaccatgttgaaaaggctggtctcgaactccagacctcaggtgatccacccgccttggccttgcaaagtgctgggattacaggtgtaagccactattcccagctagtttctgtcttactttcttatgatgaaagttattctttagctagggccttccagcttctctaggccctagaaagtatacatttcccttagtacctaggctaattggaatgccatagtcatgatcattatttcagggttacggtactgtatcttatttaattatatcagtgtattttctgttctgtcagcattctgcctgtattgtttctattctaagcaaagagaatgagcttttagtaatataacttacaaagagctataataattaatttttaattattgcagtacttaccctcttagtttttttttctacatattatttttctgtccttttttataggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaaagtagcatgttccatttcttttacagcagtttaaaaataatgctagctttatgtagcacttgataaaaagtagctctgaagatttataaaaatgaaattagtctgaaggcctatgttctagaatattatatttcttaagttttagctttttcatatgtttaatagggagtttattttttaaatgtaggatactgtgatatcttatgaaatgcttagtgtaaaaatgataaactttgtctttagtgtcagcatttatattttgcattttatcatcttggtatatacctgaccatttaggtgaatttttaatttaatttaaaatcagattgtattttttaagttaagaagtttattattataattttgtgaggaattctattggtttttcattgataacaaatctgttctaggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggtgaaagaaaaataaacatttatatatctgtaattctattcattttttaaaaatacataattcactatctcttacctatttgtaggttgcatattcatatacctatgaacttcggccatatttagatctacttttccaaattttactgattgaggactcctggcagactcacaggtgaatacccttttgccaccagaataattagaatttcccaagttcttgaaatgactggaattgtcatttgccatacacattttttatctttgatactccgcttaatgttgtctttaaaaacatatgaagaaaaattgccacttacttgcattctttttttttttaattatactttcagttctagggtacatctgcacaacatgcaggtttgatacataggtatacatgtgccatgttggtttactgcacccatcaacttgacacttacattagctatttctcctaatgctattccacccccgcccccaccccccgacaggccctggtgtgtgatgttccccgccctgtgtccaagtgatctcattgctcaattcccacttatgagtgagaacatgcagtgtttggttttttgtccttgtgacagtctcctcagaatgatagtttccagcttcatccatgtgcctgcaaaggacatgaactcatacttttttatggcttcacaatattccatggtgtgtatgtgccacattttctttatccagcctgtcattgatggatacttgggttggttccaagtctttgctcttgtgaatagtgcctcagtaaacaaacatgtgcatgtgtctttatagtagcatgatttataatcctttgggtatatacgcagtaatgggatcagttggtcaaatggtatttctagttctagatccttgaggaattgccacagtcttctacaatggttgaactaatttacactctcaacaacagtgtaaaaccgttcctattcctccacaacctcaccagcatctgttgtttattgacattttaagaatcaccattctgactggtgtgagatggtatctcattgtggttttgatttacatttctctaatcatcagcttttttccatgtgtctgttgcctgcatagatgtcttcttttgagaagtgttgttcatatcttttgcccacttcttgatggggttatttgtttttttttcttgtaaatttctttgagttctttgtagattctggatattaggcctttgtcagatgggtagattgcaaaaattttctcccattctgtaggttgcctgttcactatgatggtagtttcttttgccatgtagaagctctttactttaacatttgtctattttggcttttgttgccattgcttttgatgttttagtcgtgaagaccttgcccatcctatctcctgaatggtattgcctaggttttcttctagggttttcatggttttaggtctaacatttaagtctttaatccatcttgaattaatctttgtataaggtgtaaggaagggatccagtttcagctttctacatatggctagccagttttcccagcaccacttattaaatagggaatccttcccccattgcttgtttttctcaggtttgtcaaagatcagatagttgtagaagtgtggggttatttctgaggcctctattctgttccattggtctatatatctgttttggtaccagtaccatgctgttttggttactgtagccttgtagtatactttgaagtcaagtaacgtgatgcctccagctttgttcttttggcttaggattgtcttggcaatgcaggctcttctttggttccatactaactttgaagtagttttttccaattctgtgaagaaagttattggtagcctgatggggatggcattgaatctatagataaccttgggcagtatggccatttacatgatattgattcttcctatccatgagcatggaatgttcttccatttgtttgtgtcctcttttatttcattgagcagtggtttgtagttctccttgaagaggtccttcacatcccttgtaagttgtattcctatgtattttattgtttgaagtgattgtgaatgggaattcattcatgatttggctctctgttattggtgtataggaatgcttgtgatttttggcacattgattttttatgctgagacgttgctgaagttgcttatcagcttgaggttttgggctgagacaatggggttttctaaatatatagtcatgtcatctgcaaacagggacaatttgacttcctcatttcctaattgaatatcctttatttctttctctttcctgattgccctggccagaacgtccaacactatactgaacaggaatggtgagacagggcatcgctgtgttgtaccggttttcaaagggaatgcttccagtttttgcccattcagtatgatattggctgtgggtttgttataaatagctcttattttgaaatacattccatcaatacctagtttattgagagtttttagcatgaagggctactgaattttgttgaaggccttttctgcatctattgagataatcatgtggtttttttcattggttttgtttatgtgatggattatgtttattgatttgcatatgttgaaccaagcttgcatcccagggatgaagcccacctgatcatgatggataagcttttggatgtgctgctggatttggtttgccagtattttcttgaggattcctgcatcaatgttcaccagggatattggtctaaaattctctttttttattgtgactctgccaggctttggtatcaggatgatgctggcctcgtaaaatgaattagggaggattccctcttttttctgctgattggaatagtttcagaagtaatggtatcagctcctctttgtaccactggtagaattcagctgtgaatccatctagttctggacttgttttggttggtaggctattaattaatgcctcaatttcagagcctgttattggtctattcagggattcaacttcttcctggtttagtcttgggagagtgtaggtgtccaggaatttgtccattgcttctagattttctaatttatttgcatagaggtgtttatagtattctctgatggtagtttttatttctgtgggatcagtggtgatatccctttatcattttttattgcatctatttgatgtttctctcttgtcttctttattagtcttgctagtgatctatttattttgttgatcttttcaaaaaaccagctcctggattcatgacttttttttttttaagggttttttgtgtctctatctctttcagttctgctctgatcttagttatttcttgccttctgctagcttttgaatgtgttttgaatgtgttcttgccttctgctagcttttgaatgtgctcttgcttctctagttcttttaattgtgatgttagggtgttgattttagaactttcctgctttctcttgtgggcatttagtgctataaatttccctctacacactgctttaaatgtgtcccagagattctggtacattgtgtctttgttctcattggtttaaaaaacatctttatttctgccttcatttcactatgcagtggtcattcaggagcaggttgttcagtttccatgtagttgtgcagttttgagtgagttttcttcatcccgagttctaatttgattgctctgtgctctgagagatggtttgttgtgatttctgttcttttacatttgctgaggagtgctttacttccaactatgtggtcaattttagaataagtgtgatgtggtgctgagaagaatgtatattctgttgatttggggtggagagttctgtagatgtctactaggtctgcttgttgcagaactgatttcacgtcctggatatctttgttaacctgtctcaatctttctaatattgacagtggagagttaaagtctccactgtcacacaaaataataattttgtctcccattattattgtgtgggagtctaagtctctttgtaggtctctaaggacttgctttacaaatcttggtgctcctgtattgggtgcatatatatttaggatagttagctcttcttgttgaattgatccctttaccattatgtagtggccttctttgttggtttaaactcttttgatctttgttggtttaaagtctgttttatctgagacgaggattgcaacccctgcttttcttttgctttccatttgcttggcagatcttcctccatccctttattttgaacctgtgtgtgtctttgcacatgagatgggtctcctgaatgcagcacaccgatgggtcttgactctttatccaatttgctggtctgtgtcttttatttggggcatttagcccatttacatttaaggttaatattgttatgtgtggatttgatcctgtcattatgatgttagctggttattttgccagttaactgatgcagtttcttcacagccttgatgatctttacaatttggcatgtttttgcagtggctgataccgcttgttcctttccatgtttagtgcttccttcaggagctcttgtaaggcaggcctggtggtgacaaaatctctcagcctttgcttgtctgtaaaggattttatttctccttcacttatgaagcttagtttgtctggatatgaaattctgggttgaaaattcttttctttaagaacattgaatactggccccactctcttctggcttgtagggtttctgctgagaaagccattgttgttagtctgatgggcttccctttgtggttaactcgacctttctctctggcttcccttaacattttttccttcattttacccttggtgaatctgacaattatgttcttggggttgctgttcttgaggagtatctttgtggtgttctctgtatttcctgaatttgaatgttggctggacttgctcggttggcaaagttctcctggataatatcctgtagagtgttttacaacttggttccattctccccatcactttcaggtacaccaatcaaacgtagatttggtcttttcacatagtcccatatttcttggaggcattgtttgtttctttttactcttttttctctaaacttttcttcttgttttatttctttcatttgatcttcagtcacggatactctttcttccacttgatccaagtggctattcaagcttgtgcacgtgtcccaaagttctcgtgccatggttttcagcttcattagttcatttaaggttttcactgtttattctagttagccattcgtctaaccttttttcaaggtttttagcttccttgcgatggtttcgaacatgctcccttagctcggagtagtttgttattaccaaccttctgaagcctacctctgtcaactcatcaaagtcattctctgtccaactttgttccgttgctggcgaggagttgcaatcctttggaggagaagaggcgctctgatttttagagtgttcagcttttctgctctggttactccccatctttgtggttttatctacctttggtctctgatgttagtgacctacagatggggtgttggtgttggatgtcctttttgttgatgttgatgctattcctttctgttattattttccttctaacagtcaggtccctcagctgcaggtcagttggactttgctggaggtccctccagacgctgtttgcctgggtatcgccagtggaagctgcagaattgcaaatattgcagaacagcaaatattgctgcctgatccttcctctggaagcttcatcccagaggggcacccgcctatatgaggtgtctgttggcccctactaggaggtgtctcccagttaggctacctggcggtcagggacccacttgaggaggcaaactgtccattctcagagctcaaacactgtgttggtagaaccacagctctcttcagagctgtcagacagggatgtttaagtctgcagaagttatctgctgccttgtgttcagctaagccctgcccgcagaggtggagtctagaggcagcagaccttgctgagctgcggtgggcggaagcagttcaggcttcccagctgctttgtttacctactcaagcctcagcaatggtggatgcccattccccagccaggctgctgccttgcagttcgatctcagactgctgcactagcagtgagcaaggctctgtggatgtgggacccaccgagccaggcatgggagagaatctccttgtctgctggttgctaagaccttgagaagagcgcagtatttgggcggaagtatcccttttttccaggtacagtctgtcacagcttcccttggctaagaaagggaaatccctggacaccttgagcttcccaggtgaggtgacgccctgcccttcttcggatcaccctccgtgggctgcacccactctccaaccagtcccagtgagatgaaccaggtacttaagttggaaatgtagaaatcacccatcttctgcatcaatcacagtgggagctgcagaccagagctgttcctatttctccatcacattcttttctcttaatgttccactttcatccttaatattaggttttgtcttccatttactgtttttatttttttaaggaacccagtaaggcttttgatacctccttaagttctgttaatattttaggattatgatgtactttttctagaattagttacaataggtaacacttaatccatcgcctctaagtagttgtattagtatataagaaatcggagtggtaatttttcagaactgagattatgctactaacaggtctataaacatacccctagaattctcaattgtgttctcttcagtaaaatcagtctaagaattatactgtagaattagttgcctaattctgcctgaaaattctaacttttctcctcgtgagaattttaatatagcttgttttaggaacacacacaaacatacacacacacagaaacacacctattagacataataataagcaaaagaacccgaaaacaaatgtattataaagctgcagaacacagtgcttaaaggtaaatcattgtaatcttgaattttagagaaccgaaaatattagatttcaacaattaaaattctcaagttgtgattcagtccagcatcaagcagatcaaataatgtaaaagtggcattagatgggtaatgttttatattagatctcatttgttttaatgggttccaatttttatttaaaatttttactgtgtttgaaagaatttttagacaaatattgtttgctatgtgattttattttatttttttgagactccttcttgctttgtcatctggctggagtgcagtggcacaatctcagctcactgcaacctccgtctcccggattcaagtgattctcctgcctcagcctccctagtagctgggactacaggtgcatgccaccacgcccagctaatttttttgtattttagtagagacggggtttcaccatgttggccagggtggtgttgatctcctgacctcgtgatccacctgcctgggcatcccatagtgttggaattacatgcatgagccactgcacccagccagctatgtacatcttgtagttactataaggctaaatcacatttttagccttcttatcttatccaaggaagtgattttagtaaaggtacacatgttggattaatgtggaaaatagtagacttttgtacaaaattaatattgtccttacaaacataagcttgaagtgttttgtataatgaacattgagtttattcagtaaacagtattcaacagatatatatatcaacatctgctgtgtgccaagcagtgttattatcacttcattataaactgtaagagaataagaaaatggaatatgatacatcacaagtgttgcaggaagcatatccatgttattttttgtctgaaatgattagatttcaaaagttgccctttccaaacaaaagttgtattataaatgtctctgaagctaacaaaaaaaacctaacatctgacctggaatataaaaatactttgttaagtaagatacatggtatagagaaaagaaatttcaagttatttttctgtgtaggtaatgacacaaaagaaagaaagcatatatttgtttgtaacttttttttgagacagagttttgctcttgttgcccaggctggattgcagtggggtgatctccgctcactgcaacctcagcctcccaagtagctgggattacgcacatgcaccaccatgcctggctaatttttgcatttttagtagagacagggtttcaccatgttggtcaggctggtctcaagctcctgacttcaggtgatccacccagctttgcctcccaaagtgctggtattacaggtgtgagccaccgcgcccagccttcgtttgcaattttttaaattgactattaaggagaaacagggaagagttggctatgtaaatatgttgcagttaggcagtcctgaaataaaataattgatcattagcaaatcaggcagattttatcattgtcagtgaaaattgctttatgcgtcatgtatgtgttttcacagtatcagaattcaagttaattttatactgccaatttatatcattgttccataatcagtaagtttttttcaactaaagaagtcttaaaagactaatagctttagtaaagtaatgtggtgaactggacatggtggtgtgtttctgtaatcccaactacttgggaggctgaagtgaaagtattccttgtattctggttttgaggctacagtgagccacaaactacaatcatgccactgcagtccagcctgggacacagagcaagaattctatctcttaaaaaaaaaagaaagaaagaaaggaaaagaaatatgaaaaattatgtggcatcattgtccttaatttgctcttagtaatttttgtgagcagctggttagcaatctaagtgagattcctatgtctgactaagtcagattgctaaccagctgctcaagttgccagatctgtaatatttggcaagctatttgtgctgtctgtacttgttttctcatttgttaaaatgttcctaattttaatttgttcctacctacttaggaaagtaactctaatgttaattagattatatgattacatcaaaaaagtactaaatggcacataattaggaactcaaatgttagctactattggatattacaaagttttacatctgcttctgttttagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacaggtgagggtttttctcttataaatttgtagaaacctctgtcacaagtaaggaaatgatcgtgaaatttttgtattagcattttaagctgatactgaaaatcattctaaattctaaatagttttatttttttctaaagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggtaaaaaaaaaaaaggctaccaatggacagcagatggaaatgggaaaaagaaaagtatttttttaatgtgtaggcccatgtttattaatattgtgcttaaaaaaatcatgtgcagttttgtttgctttagtggttagcttgatttgtttgatcttaagttaacaaaggagtttccttttggaaaaaatttctgtgaaattgtctaaaaatcacatacctgagagaattcagatattcttttgtttgttttttgtctttgtttgcttttgctttttctttttttttttgagtctcaccctattgcccaggctgctgcagcagcgtgatctcggctcactgcaacccccacctctcaggttcaagaaattcttctgcctcagcctcccgagtagctgggattacaggcagccaccaccatgcctggctaatttttgtatttttaatagagacaggatttcaccatgttggccaggctggtctcaaatcttgaccttaagtgatccacctgcctggcctcccaaagtgctgagattataagcatgagccactgcacccggcctgttttcttatattttaaattatttgcagtaaatgcaaagatgttaaagaggccagctttgtgcattttttaaaagtttattctaaatgaaggaaattaaatataaatttgaagttacttttataatctaatgcttaatctctttaaatatttaaaattaggagccagatgaccaggatgccccagatgagcatgagccctctccatcagaagatgccccattatatcctcattcacctgcctctcagtatcaacaggtaaaaaggatttttcatttttatcccccaaacccattttgatgctttacttaaaaggtcttcaattattattttcttaaatattttgaaagtccaaactttctctgtacctggctgatatttaaaactggataaactgttccaaaccaacatggagtgaagatggatccactgtgactgtaaagtaataaattatctagaacagctttgacaagatgatcagtagagtgttagttgaaatgacgtcatgttttattttgccattgtgatatgttctttgtaaccaggtactacccccttttgctatttgctatggttaataaaattgtgtgatatttcagtaattgttgaagaaatgtgaaagcaaaagtatctgagattcagtggcagtaaaaattcagtttgactggctttaatagatggttaactgaaaaaatataacttcggaaaaatataaataaactttctgataagttcttttgcaaaacaggtatatttgggaaaagattctgggaagattagccgcaaatgtggctaatgcagtcattttaaggccatggttcttaaatttaatgtacatcataatcatgtaaatgcactgattgagaacagcaattgcagggtccagaaattgtcactctacagggctatcgtggggctcaagaattggccttttttttttctttttttgagagagtctcaccctgtcaccagtctagagtgcagtggtgcaatcacagctcactgtaacctccgcctctggggttcaggcaattctgcctcagcctcccgagtagctggactataggaacgcaccatcacgcccagctaatttttgtatttttagtagaggtggagtttcaccatgttggccaggatggactcaatctcttgaccttgtgatctgcccgccttggccccccaaaatgctgggattataggcgtgagccactgcacctggccaacaattgtcacttcttataaatttccaagtgttgctgctctggggaaaacacatggaaaacctttctgcttagcacaataattggccatccaagacttttttattttagacctagtctgactctgttgcccaagctggagtgcagtggcctgatctcggctcactgcaacctccacctcccaagttcaagccattctcctgcctcagcctcccaagtagctaggactacaggcttgcatcactttgcccagctaagtttttcatttttagtagagacagggtttcactgtgttggccaggctagtcttgaactcctgaacttgtgatccgcccaccttggcctcccaaaatgctgggattacaggtatgagtcactgcacctggccaagactcttgggtacattctctagggaggtgaaatgaatttttatcagaagctgacacatttatgtgtgtgcactttctcaaaacactttattcatatggtacttcttctcttcaaatataaaaatcagattgtaagttctttttttttttttaaagatccaggtttaaaaatgtctactttttgaccaaccttaccccatggttttaaatttttaattgttaatatttgaaaagtgttacaatgctggtctctttcaccctcttagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaagacttttgtcctgtggtgtgtttttgtttcttgttactctcttgtagtattcttaaggactacgcatttaaattaattatttgcatggcatgcgttggcatgacactgaattcagcatttcagacacattgagtttttatgcataaaaaaattggcccttggcctttcattaaggacctaaaaaaagaaaaaaaaattaagatattggccttgtaaaaaaattttctagcttaatcatttttgtgcttttggcacatttttacatagttgattcttgttattcacagttataaagtcaccatgaataccaaattagcaaatgttgaactattttatacaatcaatatttaaaatgcttatactctcccaaactaccactctgtaacctgtgtaatatgttcatttgatgtaatatctctttgcccattgttggacacagtagaccctggaatgtgttgcttagtatgaagaaatgcaattcatttgtccaaattggttataatatctttttttatatatagcattttaagcgttatcactgacctctgcgaatacagtcgtcaggatccattaatgccc

SEQ ID NO: 17058 - DNA, 4812 bp, Human
tctcagctcactgcaacctctgcctcctgggttcaagcaattctcctgcctcagcctcctgagtagctgggattacaggcgcccgccaccactcccggctaatttttgtatatttagtagagacagggtttcaccatgttgactaggctggtcttgaacttctgacctcaggtgatccacccgcctcagcctcccaaagtgctacgattacaggtgtgagccaccgagccctgccccgccccttcttattttcatctgcaagctttggccatggagatttgacttagcgggacgtagggtaaggcctcagcattcatatttttaacacgcgccctcgaagagcttgagggccatcataaaggaccttcttatccctaaagagaggcagcatagaaacaccaagggcatggcaatatcacccatcacctcctgtaaggatctgaagattaagcctcctgaatttgtttcttattgccactgtgacagatcatcacaaattttgtagctttaaacaacataaatgcattatcttacaggtctgcaggtcagaattctgaaagaagtctcatggggctaaaatcaaggggtcagcagggctgtgttcctcctggatgcacgaggggaggataacccatttccttgtccatcccagcttctagaggccgcctgcatcccttggcttatagcctctccctccatcttcaaagccagcagtgtggtgtctcccagtttctcttcctgtgaccctcctgcctccctattctctcttctaaggaccctcgtgactgcactgggccaacccagatcatctgggatgatctctgcatcttcaagtccttaaatttgtgtatctgccacattcccacattctccctgccctccatgaaagggaaactggttttgcagtttctgtgattctgatcccggactttaatgggatcatcaaagttcaatgagaagccccggcaaggccgagcgggaggggagaagatgaatattttggaggcggagaggggagcattccctgggctagggaggaggtggagagccaagggtatgactaaaaccaggctgtctccgtctgaatgctggcccggcctggccttctcagcagagtggccttgagcaactcaacttcttcatgcctgtttgccccacagaaaatgaggattgtaagagtgaggaatgcaagggtggtggctcacacctgtaatcccagcactctgggaggccgacatgggaggctcactgaggccaggagtgtgagaccagccagggcaacatggtgaaaccctatctatctccacaaaaaatacaaaaaattagctgggagtggcagcacacgcctatagtcccagctactcgggaggctgaggtggcaggatcatctgagctggaggggtagaggctgctatgatccatgattgcacaactgcactccagcctgggcgacagacagtgcctcaaaacaaaaagaggagagagagagagagagagagagagaatgagtgaatgtatgggaaataaatgaatcaatgcttggcacataggagctattagggaactgtttgctgctgttgccatcttaacagtaagctgtgtgcacagagatccaagcacggaagtcccttccacatggtggctgtggcacagcagtgagttggcaaggaagcttccaaatgacaatgtgcgtacccaccggcttggggagatgagggcttggattaggcaataaaacacctgccatctgtatggttcacctactgcaagagacagaggacatgctttacaggcaaggcaagggggtctctcgcccttccagccctgcagcttgggtgccagggccctgctagttgtgacccctggccctgtgctgccctcacagaggaggctgggcagggtggggactgggcggggccgcagagtcatagtgggcgccccctttatatacaagctcccggggagccttgcagaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggtctgcctgcgcccccgccttgccctccatgtccctgaccaccccaggcacaggagggaggcggggacccaccccacctgacaaaagctccagccccctaacccccgtccccacccagagtccctaggtgaccccctcaaccagaactttctttcccaaaaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacactcgctggcctgtcgggttttctttgcacgaatcacacaaacctggcttccctcacgcccagggcgggtagaggcttctctgcagcccttcctcagaggcaggtagggcgggagttctgatgctctcaggacacctaggagagggttactgtgcctgggaggccaccctatgatgctgtcctgtctattgtgcatccttccatggtgtcaaaggccacattagtctgtctggatccccctccagtgaagaacctgatcctacctcatgaaaggagaaaatggttagaacagatcgagtcctaattaagtcacaaagatgccaaggcaccttgtggccatatttaaatgcctactgtgtgccacagtttaaaaacacaacccatcttgagtgttgggtggttggaagtgtaaacggtgggggcagaggtgggggcactgctcagtgcaggccacagcttcgaggtgggaaacaggtctggcatgctccagcaacaacttggtcagcacagagacggcaaaaggcaaggagtagatgaatgcagagtaatgggctgcgctgtgtgaggcctgtgctggctgaagcctctggagacccaggcagaatccgatccttgttgcctgctctcctcggcctgtggctgcatcactcctccctcctgtctgaaatcaaggacccttgtgattgcactgagggactttctggacaacccaagataacctccccatctcacaatccttacatcataaattccaggatcaggaagggggcacttcggagagtgccaaccttagccaaccatagccactgaggactggggggataagactggcaagatccaatccatatgttggcaaatggatttctggtgctcagaaatgaccaatctttaggaagcaacgagtttctgaaaacaaaacaacaacaacaaaaaaaaaacagacggagtttcgctcttgtcactggggcggtgtgcagtggtgcgatcttggctcactgcaacctgcacctcctatgttcaactgattctcctccctaacctcctgagtagctgaaggagctaaacaaatttttttttttttttttttttggtatttttagtaaagacagggtttcacgatgttggccaggctggtctcgaacttctgacctcagatgatctgcctgcctcgcctcccaaagtgctgggattacaggtgtgagccaccacgcctggcctcaaaaaatttatatttaaaaaataccattgcagtgtacaaacgactcatttcaatgtataaaagacaaagtcctaaaccccctccccccatgctgaaattgtgctgcacagatgtggaaccttgccaaggggcagctccatgatgtcttctctgtggccccaaaacacttaagaggatgtcactccaccctgacctgggtagagtggcctctggttggtggtgtccatcttgcatcagtcagggacaaagcaaccccttgttcatcccagcttggtttctggcctgttcccatgccttggacaaacaaacaatgcttaggagccattgcctttcaagaagatttcacactttcaggcccccgaaggaagagttccaagggttcctgagttttatgagcttacagagtgcatacattttaagcacacagcttgatgatttatttccaagggttaacagtcaagaaactcaacagagacagctctctctggctggcgatttctgggatgtggggaggagtctgtgtgtgcccctcctgcttctagaaattcaatccctaactcccatcccagctacaagggaaactttctccagggcaaatgaggactatggtgtggcatccgaactggccccagtgctcagccttgcagacctcccctgtgggggctgggagctgccagtggctgaggtgtgagttaactgttggctcagacccaggttcccaagtggggatgggctccctttgtgatgtcagcatcctgcccccactcgcagccccttcacc

SEQ ID NO: 17059 - DNA, 4498 bp, Human
gttcagctccccgcccccatctctgtctcctctctctcccttcttctccctctttctctatgggtaaatccttgagagtagttggcaaacatatgtcatcacccctaaatcctccagcatgtgtatcccccaaacagggacaatctaatgacccccgaaatcacctctgactccttaagaaaaacataaaacttccacccaactcactcatttcggttttctgtttaagtagccaaaccaattctaactgctcccctctttacccttaaaatccatggggctgtggaaaagaccacaccatgaccagtgccctgcaccatgctctgctccaatccctcacacctgttagcaccttttggcctcacagcttttcgtgtttgcaattgagctgaaagtcaggtaacataaaatacatcattttaaagtgtgtaattcaaggccaggtgtggtggctcatgcctgtaatcccagcactttgggaggctgaggcgggcagatcacttgaggtcaggagttcgagaccagcctgaccaacaaggtgaaaccccatctctactaaaaatacaaaaattggccaggtgtggtggcgggcgtctgtaatcccagctacttgggaggctgaggcaggagaatcgcttgaagcaggaggcggagtttgcagtgagccaagattgcgccgctgcactccagcctgagcgacagagcgacaccctgtcattcgttcattcaaaattaaataaataaataaagtgtgtaattcagtggcatttagtacagttacaatgttgtgtaaccaccgcctctatcaagttccaaagcatcagcccacaaggaagccccccacccatggcacagctgctccctgctccacccgccctggtcaccccgatcactttctgtctccacggatcccctgctgcctggccctgcatagaaacagaactgcacatcctgcaccgcctcagaacagttgcaggagcagctctttcttcccaggtgctcctccctcctcttactatagcatccatttagggttcacttcgccagcacccctttggggctctccctagagcctcacctgaggtcaagttctcccagcacatatcctcagaaacccgaggtttccattatcagcatttgtcactattacaattattcttcagggctatttcattcatgctttctgtagttagattataaagtctattaggggcagggtgtggtggctcatatctgtaatcccagtgctttgggaggcagaggcaggagatttgctcaaggtcaggagtttgagaccagcctgggcaacatagggaaagcccgtctctacaaataataataatggccaggcacggtggctcatgcctgtaattccagcactttgggaggctgagacgggcagatcacttgaggtcaggagttcgagaccaagcctggccaacatggcgaaaccccatctctactaaaaatacaaaaattagttgagtgtggtggtgcatgtctgtagtcccaactactcgggaggctgcggccagaggtttgcttgaacccaggaggcagaggttgcagtgagccaagattgtgctactgcactccagcctgggtgacagaatgagactctgtctcaaaaaaataaacaaaatacataagtaattaaaaaaataaaataataataataatacttcttaacaagggcatgtctgtcttgtttatcactatataccagggcctaggccaaaatccggcatggaacaggccaaaatattaacagtaatattttgttaattgaataactagatgattgctcccacggaggagtcatcttgtatcgccccagctgtgacataggcagcccctacactcgggggcctgcccgcctctcaaatgcccatatatggacatgatgcaggccacctggccatggtttgtgaggtcccagcccctttgccctcacaatgaccaacggccccctggcatctataacaggccgcagagctggcccctgactcacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgagtaagtgggcccagctgagggtgggctggggctgaggctgggagctctcagggcccagccttcctctcaccacttttcttggtctcaccagggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcatcccactcttctctccttgttcttgagaggggaggctcagtggggaggagggctcggggatgagcagagggggagagggcctgggcatgcaacgggagaaagatgtcggtgggggggacatgaaagacagttgtcacgctgggttttgttccaaactttttttttttttgagacagagtctcgctccgtcgcccaggttggagtgcagtggcgcgatcttggctcactgcaagctccgcctcccaggttcactccattctcctgcctcagcctcccgagtagctgggactacaggtgcccgccaccacacctggctaattttttgtatttttagtagagacggggtttcactgtgttagccaggatggtctcgatctcctgacctcatgattcacctgcctcggcctcccaaagtgctgggattacaggcatgagccactgcacctggccattgttccaaactcttagtagtaccaacaagtcacaacccaaacctgcctccctaagatacaacaagaaccagtctccccaagtcacaaccagaacctgcctcctaaaccctcttaacagatccctacccagtggggtgctctagccaggtctctcgagtttgaggacccactgtgtacatttccccactctgcttggtgacctcatcttggcagcttgaaatggaccatggagtatttacagaaatcagcaaatgctacaaatctgggttccctccatcccaggaaccccaaagccagttaaacatttaccagctggagctcaagattgaaccagctcatcccatctgacctgtcccctagctgcccacccgggtttatttcagcccaaagctgaaatttccactcttcaacaaaggaactcttaggttataacttaaatagattaagccagtcaccatcaggaaaattaaattcaaaactgcttattcctcactctgtgccagaagttttcatccccatttgggtacagagataacttgtccaggtagcagtggagctgaacttttcacatttaatcaagcaccattaaggaagtctcttatctgccatcctgtaaactcaaacatttttgttaaccaccggtttctttactctttggggcacggtttcacaacgttatgtccaccgaagaaacaaaggttaacttgtccatctggtcggatctaagtccacactcaagctgcttgatataccacctatactaaaatttctaaggcaagagtttaagaccccagtgagatctggggaaggacataagaagtcctgctgggcactggtctccttggctcacccacagcctaagaaagcccacctctccgattccttgacacaggccctgggtcacagtcatttcctgatggtagagcaaacccagagcattttggcagagaccagaggctctgagacccagttccctgaagtgacagggcccaccaagcacctcagaaatgtcacagtatgacttctgtttatgggacaccaactgtgtgcctggtattctgcatacatcacttccttttttttttttttttgagacaaggtctctttctgtcacccaggctagaatagagtgcagtagcgcaaacacagttcactgcagcctcaatctcctgagctcaagtgatttccttacctcagcctcctggactcctgagtagctgggaccacagacatgcaccaccttgcctggctaatttttctaatttttttgtagagacgaggtctcactatgttgcccaggctggtctcaaactcctgggctcaagcgattctcctgccttggcctcccagagtgctgtgattacaggcatgagccactgcactcacctacggtgggtatcaacaaccatgttctttcaagtgagcacatgagagttcagtgctagccctggcactaccatgaccctgatcactttagcaatgactccccataacacactcggatcatgacagcagcttggctggacaggcagacccctgggtgtgcc

SEQ ID NO: 17060 - DNA, 16716 bp, Human
accaaagaagcaaagaagcaaggattggctgggaatttgagccagtatggtacaggggaatggccacaggctttggagacagatgtcccaggagtcaaatcctgctttcaccactgatcagcttggtgatctcagatgagtcacttctctctgagccttactttcccctgtaggtaaaatggggatactgaaactcatttcaaaaggttatgaaaggaaaagcatctaacttggttcttgacaatagtaggcactcagtaagcagcaggctgctttctgtattcaggttttgatgtcctagcatgcactccagggatcccagtctcccagctagactactggtgtgtccctacaccctattcatctcatctctccttccttacaccccaatgcagggtccagctgagagctcagagaccccaaacagctccttctttccctacctacccagagccacttcaccctcaagggctgcccctggaagtgggaagggcccagattttccctattttctcctctatttgggagaaaataaaaagacaaaatctgggctattcccacctctacagccacaaagatcatcagaggatccactgagaaacgcagtagctcagtcacctattaagcgagatgatggacatgaaactgtgtgaatggtggagcactttgggaatgttgctcatctaattatctccataaagaaaaagtggggagaccttgtattcttggcagtccctaagcctaccccaaactcagatatccttctagttctttcccttcctccccatacagggtgacggtttttgccaaggctacgcctgtcccaggtcttgtgctatggcaagctccgggtttatcccaggcgcccgcagtgctatggaagtccagcagggggagacattagcacgtgggtacgtcctctggggtccgaccagcgagagtgggtcggacctggaaggtctgagctatgggatcgagccaagttataagcaaagaggcaaggcggggcgggaagaatgggccagggctgggagacaaagacccagatggcgaggccgggacaggctggagtccggcttctccggtccaggatgcccgcttttgctttttcaaaagtctcatgccctgtgctttttcctctttgccctcgaggtgtctttctttatcgacgtgccctctcatccccgcttgcctatcccgggaccttgcccgcgccttcggacaggacaagactaaatcttggctccagaggtcccacaaggctcccccagaaagctgagattccgaaggcctggtccccaggggcgatgaacacgcctttctctccccaccacaccccaccctgctccccgccccacctctaaccccaatcaagtactggaccctcaccagtttccccctcccactgttctcacttttatgttcctgactccgggtccaagtgcaagcagacagtgcattttgagggcgagaggaggaaagcccactaaagccttacgtgggactggacgaggagcagacaggctgtccttgacacggaggtgggcacagagcaggacttcaggggtcctgtgtgtaaaaagaaaatggaaatactttcctggggtacttgggacagggtcagtgggctggggtgttgaccagacgcgtggagaggagagcaggccggcagctcttgagagtgccaacttcccacgggttgagctctctgggaacaggactgagagggacccaaccctaaccgcacgagccgcacatcagattggtgccatcgggcgcgcggcgtccttaagagctccctgaaaccccgcccccttcctgctctgggggcgtggtatggggcaaggaccccgccactgagcttgctattggctaagagagcagggttggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcctgtccactcttgctgccccacgccgcctcccccccagccccgccctgccccgggtaacttcccaggctcctgcctaccttggcctcttgggtcccagggacgtttgatctctcagccctggagtaggagaaggcagctttagttttcttctcctcgattaaggtagagtcctattactggttggtgggatggctaaaccagggttggggtggagggctctccctgggtacaaggaaagggattggcaagaatttctttcctacccagaagccaaacggggtacaacactctcctaacagcaggggctcaaaatgctctgggagctctgggctgcttgagcccaggggggaacgttgtgaagtgctcagtggttgtgaagtgctcagtggttgtgaagtgctcagttaccctggtaagggtggaggctggaaatgttctgtcttgagccaggagagttgaaatccgcctggggtagcccatcataggggctcatgggagtgacctaattgctctctcgggtctctaaccagagatagcatgcagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgcttctgccaccgcgcccaaccctcaggctgccacagcctttcaaataaacagtccctctctgtctccctccctctctgcctcctgcccgagttctcctctcaggcccgtgtcagttcgccctctcataccctccgcgagcagcgctcacttcccctctccagctaggctcgcctgctctgccttgctctcacactccctctcactcttagtcactctctgcctctttttctcaagtccttttgtttctcgcacatgcccgtgctctccctctcaggctcattttctctcttccttcccctcttcctctcctggcttttggtctctctcctcagccctgtcagaagctggcaacccccctcccaaaaaagaaaatctcccagtgcctataaaccctgcttaattgcttccttcttgggaaaaaaaaaatcaaaataaaagaagtggtggggctgggggtccgcttccaggttccaaggtgcgtgcggcccggccccagccctgactgagaggggaagcgggaatggctggcccaagactcccaagcctctttcccaaattggtgctggggccttctgggatgctagtccctgagtggcaggagcttctgcctccttggcccctcctgtcagatttgccccatgagcgcaaggtggggggatgggtttggtcctgctagagttttttttaggaacctctgtgtgtgcgtgtgtgtgtgtgtgtgtgtgtgtgtgtgtctgagttggggggctgttatctaaatggtcctaggcgacccctcccgcagcctcttcccctgggaacttggggcagccggcaggcctcacacttgagtcctcagccaagtccagctgctgcagttcagtctctcagtcccgtcctgaccccttcctgccccccactcaggttcccccacctccagggagtcagaatgtgcctgagatcacattacaaacattccctacaagggggtgggggtgggggggttcagcttggcatccaggacccttgactccagcatgggtgggggcagctgcagaccccaacccatgcttgcctgctccaagccaaagtgttggccccagccccacacagctgttctagctcacagtcctggggaggccagctcagggggcccttttccggggtggttagggacctgacctcttctactttgtggctgattggccacaggtgggagcctgagagtgatgggaatccagcagctcctaaagtcccctgttcccctgcctcccctctcccacatagggcagccaggcaagggcaagaaggacctgtgaggctggggtggggactgaatcaagggttccctttcttcccttgggctctctgttgtctcatccgctcaggtgaatggggatgcgtgggccctggatactatggtgcatcactgttttctggggttagggactaaaggagatagagtgggccagccaggaggctgctagttgccatgggaacaccaggtttgggggagagtccactctgtgactattagaggagctgagatacgggggtgctcaccagccacattctgggttccttaccccgcagaccatagcagcccctcttgggcgtgtttcacgatcattgttttgggtcagggtgctagcagccaggaatgtaagctccttcagctttttacttctaaataatgctgtgtttggcatgctaactaataggcaggcggcaccttgctacttacaatgcattctcatatatgatctcatcgaatgctcccaacaaccctgggaagtaggtattggtcccattttccagataagaaggcatatgcccggacaagggaagtgacttgtctaaggccagtcaatgacttgcctatgggggcagagctgtgttgtgtgccattcattcctgctgccttgaaatgtaggagagacaggaattcaaggtggggtttgggaagaggccctggctccctgcccctgagttcccctcttacctcgcaggtgtgcaagcatctgtccctgtgactcaggccctgtctgtgtggggtgagcagtgctccaacttcctcatttgacttttctaggcctaccttccagggctgactgcttgggtgacctgaactaaaggcagccaactcactgcctggcacactccctgcggagctctgagtggcacctttggttcctctctgagctaagaatctctcttctcagggaccccacagaaagcagacatcgacatcgaggagggggggtattaaattcataatggacacgagccttagccaggtggggcagagggaagggcatagttcagtgtagatggggagggtgacttcctccaggactctcctggcttccctgcctctgacagagctgtgtgtgccaggacccagctgctgttcctgcccacccacgcctgggcgggcactgctgggacatgccaggcctgctcctgccagcctcgggggctgggtggagctgggggagttaaagaggagcctttaatttgggggctccccaccctagctgggatgagaacagacttgagctctggcttggggtctgtcctccattggtcttgccaccctgggaggtgcaggtgcagtggtcgtggggtcactgaatcgaggttgaggctagaggcttctaccagacttgggcttgcatggcctagaaccaggctccccctttggtcattctctgaccacaagttgctagagcctgagagcagggtgacagggaaagaagtatagacctggtgggatgtgggcagctttctgggcaagaccctcctagctgcaagctctccctgccccctgtaaattgtattcacatgggtggagaagggcttatccggagaaaacaaggagggggctgttggttagttggtttctggccagtccagggccttggaggctactgtccccaaccccttcaggcttttcatatcccaggattctttgtggcagtgatggcatcgtggtgcttctaagctaggtagaaaggctgaaggtagaacttgggttagggtagagggggaagagctggaatagcttaggccgcctcccccaagtccttttactccctggggtggcgccctggggtcccagggctatctgaggctggagagggaaggcctcaggggttaccatggtgacctgcttcaggcttcctgctgagccatgtcaatccctttatttttcagaaaagggctttgtctgggggtggccccagacagaaaagcttggcttggtcctagggtggggggaagtaaggtggaggataaagagtttcacttcgggatatctcttcctcctcttcccttactcctactcctaatctggtaagaggggagaactgtagggtccccctttaaagtatgactagtgttctacctagctttggccttcactctcactggctatacacccatcccttatggcccgttaccactctcttgagcttctgacaggtcaagacgaggtttgcccagtggtcgggaagatgctaaggttaccagtatgggggatcagggtcagggaaggcgggtctcatcaggctccgctcccttctgcacttcaggggaaggtgagtttccctctgccagctgccatgcaaatgaactaatgaatatttatgaagtctgttcactgaggttgaagagactctgaggggttttgggggcaatagttctctcttctcccccctcctccatcatgtagacatctgtttcctcaatgcctctggcttcaaggtagaaccccaattagctagaagccctgttccaattccagggctctggaacctgggtggcaatgggagactgcacttggggtagacaggactccctggtgagtaagccagaaccgagtggttagaaagctgagctggcctgtctccctttccgtgccctctatgtagctgcatatatatgtgttgttaagatgcaacagtacaaggattcaggtaatgttttagggcctcttagacccatcgggttattgtcctgggtaggtttagacccctcttttcaatgggaacattcatctgatcattcattccctcacatgaagggcctggactctaaggttcctgctggctctaagatgtgagcagttgtctaatcctgccatctggatggaaccgttgtgagcactggaaagggaaaaaatgcctggagaattctagaggctttggggaaacttgttggctttgtatggtgcatgggacaggggtattccatctgaaatgtttatccaggcttccatcccatgcctacttcctttctgggccctctatagttaggtaccagtggggaggccatctcattctggcttttaccctcctgcacatcaagatggcagctcccaatttggtggagcctcactcgacatggaggaaaggctgcttttcttcgtccacttcatccatgtggtcagtttccctcttcgcctacttgggtatcatttccctccctcagatgaggacacaggtttggcattgcaaaggcatttgcccagagttcccagtaggccggtattgcttgtagtacctttggtgtaatgggccctcaggaaatggaaccactcttttctcagatgattgtggtagcctgtgaactggtgcatgacactgtcagcttcattctctttaagcactgcctgaagccttccattgtccttcctgctctgagagcctgtctccaatgggatgaaacccaccctgcttgctgtgacccttgaagcctttcagtctggccccaggtgaacttttccacctcttcttctgtttctctcttctcactcccagccaagctggaccaatcactggcctgggctttgtgttgtagccactgctgtctactgtctcagtgtgttgacttcttattcctcacctaagacccactttcatcctgcctttcctgtggatacatctctgaccatcctggtcagatgagctatctctttcttctccctgcctccagcccttgctgcttgaatcatcatcctcacacatacctacagatagcctggtgttgtctatcactcgagtatgggttatttacttttctgacccaaactggacagtaaagtccttgacgatggagccatatcttctcttcctgtttcccctccaaaatatgagagtgagctcataggtacttagtgttagtatctgacctcctgcctcttgggagactgcttctaagaggcagtcaaacatgttgaacgcctattgtgtgctaggtgttctccatgtgctgccttgtctccccaccacaatattggaaggtaggggctcttgccacccccactttacaagagaagaaactgaagctcagaacaggcagctcatccaaggtcacagagttagtaagggcctagctttggaatctgattctaaagtctgtgttctttctcctacatggttctgccttgctctcagcaccagcccatccagtctcagaaatggccaatggagcaccattttctttctgtgtgcttaggcaaggacagagtcctatggataggtggtcctgggctgctgaccctccctgctgtcccccagtgcctggccttctggattagaatatgaacctggctcaaaaggcatttgtccatctcctctcaggagctggagtaggagcaacatagaggtgacaggttaggatacagatgaggccctatcttctatgatctgttgtctctggttgagccccttctcttctcctctgttctttttaagaatgagatgaatcaagtttaggaattcaggctcttgcattttgagggtgggatgaattgccagtaggacaataggcagtgggagtgagcagagctgcacctggccagagactgtggccatcatccctttgctccaggcgatgcctgttcctatctttccatcatgaccaagattagtaaggatgggggagaagacatgggtcccagacagattgagctcccccagcctttggctgggagctgcggggagtggtgactaagacatgtgtgggcttgctgtgtgtgtgtgtatgtgtgtgtgtgtgtgtgtgtgtgtgtgtgtgtgtgtgtgtgcgcgcgcgcgcgcgcacgtgtgtatgggtataggagaggtagtagcagcggtcatgaaggaatctttgttgggggtgggggtatataagactgccacctccaggtagcatgggcctgacaccttggtacccagcccattggccacgtcagccccctgcggaaatgccacattaggacaaagggctcccccagccaggcagtgctccaccctgccgagcagtcagagcctggcagccttgcccatgggccaccccttccacactctcctggtagtgtggttctctctccccacccccagcctgaggatggaggaagggcagaaggcttgctcttgccatctccacccagtaggcccagcccggctcttgtccgcttccctggttctggaatggcctggggccacccccaaccctgaggctgaccatcttcttccttctgggcaggttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctgtgagtcccgcccatcccatcctctggctctctccctgggcttaactctttcctctcctgtagtagtgggagcttctaagtggtgcaatgctattgcatgtagttaagaccctgctggatctgatcccctttgaagactggcatgttctcctcttagcctggccttggaattctcgccccaacatttaccaagctcaccttggctccaggggttgggcaggagaggtctccaattcgtgttgcttctctcttattttctttgcccacctaagttctaatattgggaatggtaacatatgccaggccctttgggatcagccagctattcagcctttttcttcaggggaaaccaaggccccaaaaggtgaagggacttcttgccttagatcacacagtgagttagagatagggtcaggactccaacccagttctcctgattcctactccagaattcctttcagtctatgtagaagcccccattatgatcccagtgaggaggcagaccttaccgaggggccatggcctgctcgtgacagaggagcagtgcccctgggggtggggcttgttcttggcctgggctggactaggccattttgttcctagtgggagggaagaaaatgaaaaggttcactggtagatgggagctgcttgcttctcccgactgcagtttctctccctgttggctgaagcagaatgggagtttctgggtaatgctagtagacctttctctcctcctgacttctctgacttctctggcctcttcctgcagcaacatccaatggaagcctggaggggctggaaaaccgggagggcggtgtgtgccgcacacgcaccatgaagatcatcatgaaggttgggcaaggtgagtgcctagtctgagggtcccctcaccccaccctgtttgacctttggaacagatgttcctggctgggtgcatgtgtattaggagtgggggagcaggcgtagggttacagtatccaggccattcttggcccacccttgatgactgagggcacctatgctggccgggtccctgcctctcacctgttctgtctccattcttagatcccaatgctgtgacgcctgagcagctgactaccagcaggcccagcaaggaggcagacaacactgtcaagatggccacacaggcccctggtagtcggggctccctgggtgactctgatggcaagcatggtaagtgtatgtgtttcccagaggtcaggagccattgctctgtcaccttgttaggccctgtccctgaagaaatgcaagctgggcctggcctgaaatctgctgtgtgtccctgggacccctggctgactgttccttcccctttcccttcctcagagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacacacacaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatggagaaatgggtgtaaaatggtgtcgtgatgttgggaaatggagagtgagagttgtgtgcgtgcgtgtgtggtgggggtgtgtgtgtgtgcgctttcctgtgctcaaaccactggtgactggggcaggtacgggcagatgatggctatcctagtggagcaagatgttttaatgccctatgaccctcctgccactcccctcaccccaggtttttctgctctcttgttctgctgtcatggagcctgagaccatttcccctgttcatcctgtcacctctgtggcataggccacgggcatctgcccagtctggcacaggcccagttagagagggttaatggaggaggggatgttcccatggggacctgggtgtgtccacaaagtactgccaccacctagctggggctagatctgggacctgctggcaggcccagccctgccctgcctcaggacgcctggaggtggatagaaataacttcccaagatctgaacttcagctgcagcctactgggtattgggcctgcttcaggctgcccagttcacctctcagccagaagaatcttgcttctgagctgggccacaccacagccaccaccatggcatagttgggggcttctggccagcagtcgataccctcaagctagagcagccttgagcacccggtctacctcccacaggctgatgagtaacttgctcaagtcaaagagtgtggtgagggccctgaagagggtttggcctccatcccacagcggagaggcagactggcagggcctggagccttcctgctccagcctggagccgcctgctggtcttgtggggggactccctgtggagacggctaagacagatgtcaggggaagaggacaagtgagatccagcagctaaaaatggggtagaaggcagcagaggaaagaggaagaagaaggagagagagagtgatccagagtaggaagccccagagaattagccaaggtgccacccgggctatgagggaagtggggagctggtggagaagaaagggggcggaaagccacagggcctgcaggcggagggaaggaaggttgggctagtgtagggctgggcctggctggggtgctcctggagccagctggggcagaggctgtttatttggtttctcattaaccaaaggaagtgcctggatcagatggagcctctgctgcttgactgcctgcccagagtggggcccggcctgggctgggggtctctcatcagggttggttcaggccagattggtgtcgctcactggggtagagcctgactcagttgagtgagcacttcccgcacttctccaactgagtttcctccagtagtcccccacccagtccacgccttcaaccctcccagtgggggatggagcactgggggccccctgggagcagctgtgggagtgtgaagtaaaatccaagggagattttacaaaggaaagtggggcaatctgctggttagcccagaagcttcgcaactggctgttcccttgccctagcatgggtgccatggctggtgctggtttgagcttggtgctcacactgttggtcacacagtgtgcttagtagttccttgtgtccttcatctggacagcacctgccagtttgttcaaatgcttttacacacttt

SEQ ID NO: 17061 - DNA, 96922 bp, Human
atatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggaggctgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaacttggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggaagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctctctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggcgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaaggcactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactatcaggtaacctcagagatcatatattgttcaaaaaggcatatcttcattttaggtacgcatatgacatatatgtatatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtatatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctatcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttcttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtagattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcagcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcccacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgaaccactgaaagtgagtgatggcttttatggtactggagagacctttgtttttacattctgtccggagtttgaggtaagaaccactatttcaatattttatttataaagaggtgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattagagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcagagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatgggtatttctgcagaaaattgtagggacccctcaagttttcaggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccatccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttctttctttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactcattttcttaacaagtctttgattaagcctactactatctttttttttttaatgcttctaatagcttacattgtggtggtggtggtcatggtgttaggagtaatagtgataggagaatgcattcaattagagggagcattacattttttaaaatggagatgggagaaggcacttgacacatgggaaagtgtaagttatttgatatttttaaagtacattgttttcat

SEQ ID NO: 17062 - DNA, 29516 bp, Human
  misc_feature (1)...(29516): n = A,T,C or G
ttcccaaacggatgccacctactccacctccagggctgtctgccacatctgcgtcctcctaggctgtggcttccttaatatgttctttaaattgacttactgccttttttatttaaatgcatttcttttaaaatgagactttatattactcctataaatggaaaatcacaggattcatggactagttatgtatatttttataatgcacattaaaatgaatttatcaccataaaaaatgagaaatgtttacccatagaccatgtacaattattccacatgctgtcagtgtgtttcatccctctctttgggagttggctttgcacctgtcctggtttcaccaaatcacaatgttatgaatggctatcatttattatggtaggaaatcgtcaaatggcttctgtgcacaatcaaatgcagactccccagcatggcctcagggccctcctggcccctggtttcctgatctccagttcctctggtcttgctactcttagacaaaggaggacttctcttggttttctgcctacccagccagaagatcccaggccatgggcctgtggagccaaagttcttaaccactgcactgtgtcacctttctatgatgtcaggcctcagcaaggcttatgaaggaacaggaacagccttgaaaatgaagttgggaagggataggccaggcctcccaggagcccaaagcttgcagagtccccttggtctcattggcacatggagaatggattgatcaagtccaccaatcaagttttgtgggtctaacagagcaactcctgccaagtgggaggagcttagggactttctataacctctcctggggcagaaatgatgggctgcagcagtgtccaatcctaactccatgatctcctgggagggcagggcttcatggcagttcctgtctgctctgcactagaagcttggcattgcaaaggggctcagctgtggaatgaagcagggcttcttccagaaatgttgcatgtacttcctattccctttctttattgcaatatggataatttatcatctgaggagggagtagagattccagggtagcttgcctaagagttgtggcttattaattccaactttttgcaagatcaagggggaaaagcaatccctgattttgtgtgagtatggggattgggtcttgaggccctgaaagtgaggttcgggtctcacagattgctgtgaagagttattgacccacctagaagagaagcctagcccagggcctggcgcacagttgatgggtttgcttcctggttattcttccgtccttgtctggagccctgcacgcctcttcgtagcttaggaagaacaagcttttccctgcggctcagggtgaggaagtgggagagaacaccagctccagggaggcttctagcaccagtcagcctcagttaacatccttgcaccttcattgactagctgtgtgaccttgcacgaatcattccccctctctgtgcctcagtttcttcatctgtaaaatggggatcataatagtacctctctcaaaggattgaggtgaggatcaaaggagtgaatccaggagcatgcctggaagaggcaggaaatgcctcctagacaatagctatttttgcagccagacagatctgggtttgaattctgccaccagtgctaactactgtgtgatttggggcaagtgccttgacctctctggacagctgtttcctcatctggaaatgggcttggtaacagtcctggcttccaaagttggtagtgttcttctagtaagcaagctgtgtgaaacggtggaaccctggccctggtgcagagaagggcatgatgaccgtgttagggtctgtcctctctggaaccccctcctgggaatggcagagggcagtggggtgctctgaggcaggctgctgccctgtccccactccccctccccagctgccccgccccagctgtgacgaccttgtccctgcctgtctaaggggcaggaaggaagtgaggagggcagccagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtggtgagtgtgcgggccccgggtgtgtgtgcgtgcgtgcttgtgtgagtgtgaatgtctgcggtgacccgtcatctacggagccccacaaatgaaagaactcctgctctccacctctctgggggaccctgggcaaatccctgtcctgctctgggcctcagtttccttctctgtcaaatggctgggggtaccctggggagatgccgcaagagtgaggagtaagggagctggaatccactttccaggcaaatgtaactgacgttcactccgaggctggctccgtttctgcctctgtgagatggggcacagcagcggccggaaggttatttgtgtgcaaagccaacagcagatgtgaaagtgctttggaaggcagggatcttggaaggaacgtgggctgggattgtttgaccgggatgtgaggtcggccgcagacacagccccgattcttcccctggggcctggagggagcctgggccactcgaggggatgagaagtgggaatctcccctttgtgcctccagtggggaggcaggggccgtgtcctctcagcttccagctcagtcaaaccacggccttctgcccaccaaagagaacttgagacctgtgctaatcattagggtaacttgcccggcccaagctcttgttgggcaacttgtgaagtcacggctgtcactggttcctcctttcctggtgactcacagtgtggtcttgggcaagtcacagtgcccgggggccaaggctgcccctctgcctggggtggctgagggtcagtgtccttgtactgtcctgcctagacccaccctactcccaaactcctggccacactcatctcccctagacccaagcgacttcctcctggggtgactcagggcctgtggttaacagttttctcatgagtctggaagggcttcctcaaaattagcctagatccacatgctgcggtgggttgctgcaaactcagacctgcctgcgtctgcttcctgtcacaggcagggcaggcagagctgtggcaagagcccagccttcaggggggcgatgctgttcagtggttagcccacggcctctggatgcagactcctgcatgcaaatcctggcttccctgcttcccagctctgcagccttgggcaatttacttaacctctctgagcctcagttttctcatttaaaaaaatggggatgtgaattatcatacccatctgatagggtttgttgtgaggctcagggagttgatacatacaaagcatgcagaaccacgcctgacgcacaggtgagtgctttattattcgttgtgcatcagacatggcacctgctgtcagcatccttggagtcaagttgtcagattcaaggactctagttttgggaggaggaactcagaggttgtccttccgagctcctgccaatgcaagagctgagagaagcaaatcactctttgagcgtccctgtaccctgtattttaggccttcaagctctgagactatgcacattcttagaaggacagtgtggcatgcaggggcgcctcacaggtagcaagtccctgggtcctcaccccagccctgccactaactggctgtatgggctcagacaagcctctctctgggcctcagtttcccttttataaagtcaggggtaaggtgatgttgactggctcagaggtctccaactctgatgcctctagggtctgggcaggccatgtgagtgacagcagggggcagatggggcctgcggtgaccccgggagcccttgcttggcccaccctgcagctgttctctgtttttgcttgttgttgccacgaaggattgtgggccctggtggccgctcttctgatgtttagagaatagggagcaggcttttgtgtcacatcttctgatgtttcaatgctagtgattgatgcatggtagaaaaaaatctcagtgcaggccaagtcaaatccatttgcaggttgtgtgggcccagaggctgccctgcaaacccgggactgtggggctgttaaggtttcttgttgatcgtgccatccgatgtcctcacctgtaaatggtggtgtgatatacggtccctgctcacagagctgaagaatgtgtgggccctagcaatcatggaagacttcttggaggtggtgccattggcaggagggagagtttggttgtgggcagtatggaaggtgaggagaaacaggtgagcaatggcgtatgtgttcggcttctacagggacacaatagagacaaacctggagtttggggaggaggtgataaaggttttgagtgacaagctaagaagttggatcttctctgcagtgcaccattgatattttgggctggataattcttcatcttgggggagtgaattgtgcgttagaggaagttcagcagcatccatggtctctacctactagatactagcagcactgcccatctccctaccctgccacttgtgataaccaaaaatgtctctagttatggggcccaatctctcccagttgagaaccaatgcctatgagtgatgagacgttctagagcaggagcaagcaaaagagcagaggggtgtcctggaagctgtgcgctcggcccaggttgtctccaggctgtggtcctcagttgactccagtggggggttatcttcctgcaccccgaaagagtcctctctccttcccagaaagggcagggcctgggggctttcccataggctagctggcaacaggtgtgctgataggaccttgagcatctggatggaaaaagagaagctgtggtccagatgtgtcaatagcccatgctggctgtcatctggacccagccatgggtgacgactctgcacatcatgagctatttgtggacttggcccctctagggagggttaaattgagaccttgccatcctgagacagtgccacgctctattgagtcatgagggcgttattacatgagggaagcctggtccgtagctttgggctcgggcatcttcctcaggatgtcagtgggtttgtgtagaggattctctgggtcacccaaacttgcacactttgggaacccagcaaactttctttctttttttaaaaaatctattctttttttcaaaattcagtaacttgcccatcttttgtggtttgatttgttttgttttgtttttgtttttaagagatggggtcttgctctgtcacccaggctggaatgcagtggtgccatcacagctcactgcagccttgaactcctgggttcaagagatcctcccacctcagcttcctgagtagctaggatcacaggcgcatgccaccatggccagctaattttaaatatttttttttgtagagacagggtcccactatgttgcccaggctggtctcaaacccttggcctcaagtgattctcctgccttggcctcccaacgcgctgggattacaggcatgagccaccgagcccagtctagagaaatttcttaaattgggtctcttgggtcctggctttttgtcaacctgaagcacgttctaagtcgatggtagaaagtggacacccccagaagacacttttgcccagaaatctctttcttcctgacccctcttccccagagtgcccggaattccactgtcagaaatgcattgtctgggttaaaaaacttaacacctgctatgatttcaacagtgtcaaaacaggatacgtcaaaactgggcgaggaggaaatgtatttgggttctaggatagtgaaagctctattttttctacttttctgtattttccatatttggtacaatgagcacgtacttagaacggttttagatttacgaaaatattgcaaacacagtacagatagttcttgcgtcccccatgcctagttcctctattgctaacgtctcaacgttagtgtggtgcgtttgttgcaatgggtgaatgaatattcgtgggctgttattaaagtcagtgcttcacccctatttccccagctttcctcttacatcctttttctgttccaagattgcatccaggatgccgcgttacatttagtcttcacacttccttaggttcctcttggtatgatggtttctcagatttttcttgtttttgataatcttgacagttcgaggagtatttgtcaggcattttgtcaaatgttcttcaactggggtctctggtggttttctcatgattagactgggaatgtgcttttgggaggaagaccacagaggtgatgtgccagtctcagaacatcgtactaagaaaaggttctgccaacttgacttaccactgttgctggtgactttgagcccccggctgaggttactcctttgtaaagttactctttttttctcctttccatgctgtatgttttagaaggaagtcactatgctgctccaagcaactcaagtttgatgaatggggagttccgccccacctccttgagggcagagtagctacataaattacttggaatttctcaaggagatttgtctgtactcccagtttattatataaataaatgatttatttatattacagggacccagggatctttactgtatgctttgggttataatccaatggtactttactttgtggctcaagtatactacttttaaattggaaaaaaaaaaaaagtacggccaggtgcggtggctcatgcctgtaatcccagcattttgggaggttgaggcgggtggatcacttgaggtcaggacaaaaccctgtctttactaaaaatacaaaaaattagctgggcatgatggcgggagcctgtagtccaagctacgcgggaggctgaggcaggagaattgcttgaacctgggaggtggaggttgcagtgagccaagatcgcgccactgcgctctagcctgacagagtgagactctttaaaaaaaaaaaaaggtaaagcattcaaatcatagtatttgaagaaggagtctctattgccctgacctcgtgcaggtaagttcacccatgtgcccagccccaggccgggatacagccctgactcattcacggcctctgcccttgaggggccagtctgccaaggaaaaaccgacgaggacaatggatgacattgctggctatgatgggggcacagatgtagggctggaggttgggattctggaatagcttcttggaggaggtctgagtcttaaggatgagtagggctttgcttgggcaccttggaaaagaggtcacgctgggcggggggagtagcatgacacaggcttggaggggaaggaccctgcagtgcttcagagacctagcaggtttgtcaagctgggttaggaggggtggccacgaggtgtgtcggggaggagggtggagaggtccccaggggtgggacctgcccgagtcctttgcttttacaagcttcagagctaagaagatggatctctcttcggcctatcagctcattttgcagatgggaaaacaggtccagcagggccccttacttgctccaggacacatggagagatggggcaggagcttgcttcaggtccccctgctggcacacaggtgtgtggaatgatccagaaagtgggcaaatgagttccttccctgccccatggctggggtggtgtgtctgtctgggaggccctgccctcatccagcctcccaccattcatttcttctttatggtccagtttacgggaagcttcctcctccaggaagctctcctgatttgtcctccttagaactcctggggctcttttctctgctccactttgggggcagtgatttgtgattgaaaggaacacaggcccatctccattacttaccagcagtgtgacttgagcaggcgggcacctttgttatctgagccttgccttcctcatctgtaaatggggccagtggtccctgcctcaaaagtgatcatttggaggagaccctagcgaagccgggtggagggctagcaggtgagtgcctgaagtgggctgtggaagaagaacacaaggccccccgccccttttttttgagactgagtcttgctctatcacccaggctggagtgcagtggcgtgatcctggctcactgcaacctctgcctcccgggttcaagtgattcttgtgcctcagcctcccaagtagctggaatcacaggtgtgtgccatcatgcccggctaagttttgtatcgttaggagagatggggtttcaccatgttggccaggctggtcttgaactcctgacctcaagtgatccaccagcctcagcctcccaaagtgctgggattataggcgtgggccatagtgcctggccccactcctctgttgaaagttcatctgtttggggttgaaaaatgggtccaaactgccaggtggggaaaaccctgggtgagaatctgttagaacttgccacctttatgtccagtgcccctgggctggacagagaggccacgttctctgccactgcagctctgtgcgcttcacggaggggtgaggaggccggtgggggcagggtgggagttgtagcccctcctcagtgtcagaactgagttgttctcctcacctcaggggtgtgaaccccagcttctaaaagcaggaggcccccatggcccatcccacccagagagtggctgaagggcctagcctggcctggccgagacttctctgttgccaacctggccccgaggcctccaggaagtgaggcttttattttgagcctagagcatcagcctggaaccaggacttcgctctgagctcactgtgaggcgagcgttggtttcccaggggaccccaccctgccaagggaagtggcacaaagcaccccctaatgaggcaggaagcaaagccatgagctgcactgcctcagccctgcacaggggctgcttgggacaaggcacccgtcccccagcctcaatttcctccctggtcaagtgggattcagtaactaccatttgtggcaccggaaaaatggcagctgccacgggggcctccattttacagatgaggaaacaggctcaggagggcaagtgactctgcagcctgtgttagataaagaacccgagcccaggtgtctgctccaggtggaggcagggaaggcagccttcctggcagccatgggatgggggagggggtcagctctgccatccccagagccttgttctgagaagcacagagcccatgtgtaaagagctgatttcaattttacctgcaaaatcagaaaaatatgggactcatgttagaacctgtctctcaagactggcgcgaggttgacacgagagagtgtatggtcagtcggccctccctatccgcaggttccacatcgtggattgcagattgaaaatactcagatgcagagcccgtgatacagagggccgactgtataagttcagaagaggacctggcgtctaataaatgcacaacaataatagtatcaatacttattatcactattgtgggtctttgctctgaagataaagggagaagtgatggttttagggaatcgtttggggagtggagggtgcttccccagatatctaggaagtggagaatgacagggccttgtgtcatacctggaggccaactctgagccccccactggctgctcctaaagggagatttgataagctaccaccagccagaatatctctgctgctgggattcactggtactgtttgcctttggggcaaagttagctgctagcgcccagtcacagcacttcctgtgctgcaggtgacaacctcctccagcgccatctgagccgtccgagtctaggttctctaggttttgcatgagccgtcacatctcctgcatgctctttcccctttctctctaaccccagaggccccacccctgccaaaccggtggatccgtgtgttcccccagccaactgctgccatttactgaggcctgctgcgtattcagcacatggatgacgccaaatcacagtttactaagaggaacgtcttgccgtttcctgaatgcgtctcatgcacactggcctctgctcatgccctttcctctgcctggaacactttttccattgctctttcggggaatcttcttcaagatccacctcctctgagaagcccgccctgacccctacggttggaccctgagctctgggtgttgacccagagccctgtgtgctgggtccctgggagtcgtgccctctggcctggatgctcgtttgggtcttgacccagcctgattcatcttcatgatcccgtggaacctggcacaggaggtgccagccaatctctatttgatttttgcaaaccttttcttgatgtataatttacctacagaaaagcacagctatcttaagtgcacaccttggtgggcttctacaaggtgaacacacccatgtgacctccacccaaactaagaaatcagaccagcacccagaggcccctagagcccccgcctcgccactgccccgcccccactgacttctgcctgtctatgtagttctataatacatacatctgtagaattacgtagaaatgaaattctgcagcgcgtgttcttttgtgagcacttctttctcccaacgttatgtttgggagcttcgtctgtgtggttgcgggtagctaactcattttttccattgctgtgtatactccattgtatgaatctaccacaatgcatttgcctgttttcctgcaaaataacatttggattgattccagcttggggctgtcacaaataaggcagccatggccaccaggctccgtgctgggtgtccacacacaggcacctgtgctgctcagttgatctttctgaatcactgtcttcaatgatttacttctcacacccactccaggaggtggatggattcttctctcccttctacagatgaggaaatgttacagatgaagtaacatggccaggccaggatcccacaggggatcagcggctgcactggggttctcactgaggtctgtgagccccagagcccagtggagggaggaggggatgaggtggaggcggcgggtgaggacgagaactgcggaagagtgaagaggagagagaagccaggctctggggagctgcaggcagccaggccgggctgctgcggagtgcgtggccccaggaatgggggcgtctggtggtatctgggctggctggagaggtggttggggagatagtgctcttggggggctggcccccactgagccctcataagctctgaccagaagcacagggtggggaaggggagcttcctcttgatggtgacacatctgactcccttctcacatcctcctcccaggcaacccagggaaatcagggtgggcaggtgaggttgaggggactgagcttcagggaggggccataataataatgatgatggcagaagtgtgaggctgtaggacacagggtcagggtggagcagccctgagggggaggggcaagggagggctctggcacttgggacccatatggcaaactgcattgtctgttgggaagggttgaagacaagcccgggcctgtcttcttgtgcagcctctgtcctgggctcgcacatttggtaggaggagccaatgaagtaaacggataggaaagtgtccacactctggctggcacgggtgtgtgctcactgacggctgggtcctttctctataacctttacctccctgaaaatctcagatggtgggtctccgcctgcctgcttctgagacggtgggtcctgggcctcagggagtgagagagagtgggcctgctctcctgcagaagggactggtctttgaaccccagaatcgggggttcttgtgtcatcaccaccatccacatgatattccttatcaccatcctatcctgatgtccccattgccgtcacccccatcactgtcaccaacatcaccaacagcatctctgatcatcactgtcatcaccacgccaactccaacaacatcccaacagccactccccgcctcacatggtcaccatggccagtgcctcccaggtgacacctggtgcactgttttcaccgcatcccctctggtaccgccatccttattgcccagccatgttcaatactgaccccattgtccccatcttccctgatttccatcctccagcccctgcccccattcttttagctcaacctgttgcttgctcctcagagccaccaggaaaagaaacaaatccccctgcccctggccacttccccaactggccagcttggggaagctgtgtttgtcattaagaaagaaaggctgcgtgcagacgggaataagaactgaaaccaaagatgggcagaagaagaggtgaaaagcgggaaaggagagtgggggtgggaagggtggctgagcatggctgggaccgcagcctgagcctggcttggaggcaggaggacagagctgattttgaccctgcgacagttttggtgtgtgaccttgggctggtcgctgtctctctctgggccatatttccccgctggtaacatcctcctctcagggaagagacactcccgtgccttctgagtttccctgaagggactgaaacacacctgcaccaccaggcctgtggcttttgcacatgatgtctgctcttttggaatgctttcttctcttctgtgttggaaaactcctacttgcccctcaaagccacgctcatgggtttcctgttggtgaaattctccctaagttttttagacagcaatgcgctctccctcatcaaggaccccaagccccatgcgtgtcctctgtcatggctctgagcacaccattcatgtatcgagttccctggagactgtgacaccggcacgccagggtcagtggcttttctagacagagtttggaggcggtaggtgctcagagagtgtttactgagagtcagtgaatgcccagaggtagcaaaaaccaccacccaattgtgcttgtttatggtgcacctgctgtgtgcccggctccgcgcaccacacgattccatttgacctcagcaatcctgtgaggcaggtcagtgattatccccattcctcagatgaggagccgaggcccagagaggttagtggctggctcaagggtgcagagctcggctggggcctggggccatctgaccccagcacccgagctcttatcttcatgatctcaccagcatagaatgaagggacagtgggtgaaaagatgctgtaattggggagcaagtgggtgagggcatgctgtctgcctgcgcattgttgggggagagaagccttgtacctgtcatgggatggctcgggtcccaaggtcacagcccagctgggctctcagagcttggggagaaggcagcgctgtgtccaggtggaaaccggggacatgaggggaaggcaagggcttggaggcttggaaatgttgactgtctgcatactctgtaggtcggccaggtactttccaggaactaccaacagctgttggttagggacatgggtggggcagtgagggccttctgaggggcagggtgctggccctggggtggctgggggtggaggactgtgggcagcctgggtgagatgtcctacagtgtgtaggagctccaccccactgaccctcctgcgttctgtcatcccaatggccccaggggaaaatgagggtctcttctcattgaccagaatcgaaagctgaggccagggagaagccagaacctggccagggccacacagcagtgaggcagtggaggaggcctcctgctccccagctcttgtctcctgagctctgagtggctggggctggggcttggttgccagggaagggtgggcagatggctagagagatcctggagcctcaggggagcaagttcaaccttgtggggagccctgaccccaggagagaggcaacagggttcacaccccagccgggccacgtgacacaggacatgtgagttctctctcagcctccatttcctcatctgtaaaacgggaaaatgttgcctgtcttgtaaagttttgggagattgcagtgcaagcctgtgcgtgcaggtctgagcacacagtaggtgctgaataaatgtgagttcctctccatcctatgtcctagagagccacatgggtgcctggagagccgagcttcctccctttctcctgggtcagggcctggcatcttcgtggaaggtcggggcccctcagagtctaagtcaggctctgaggttgcctcgctctgtgactgtgggctggtcccctgccctctatgagtctcgtgagccatccggcaatggggacaaagtcctccctcgtcccctgccgcagggttgttgagaaaaggtgaaatgggggagggtgagcctgggttttaaatgcaggtggttttcacaaaagtagaaatacctctggtgcctggtgctggggctgaggggagggaggggggactgcagagggagaggggatgggggcgcctctctgcctccactgaggcactgaggggaagggttaggccttaggcagagcccgggtggctggaagatgccgggcagcggagggaattggccaagatttgaaccctagccctgcatatgaccagctgggaggccttgggcaaggccctggacctctctgagctgcactttcttcgtctgtgaaatgggaaggaaagtattaagaatagtcccttttctgggtagtggggaagatcatgtggcatggagttaggctgtacaaatgtccccttcttcccctggggtgattggaggggttacagggcagtaagggatgcttggaggagaacagaggagttgtagggggagttgaggattagtagaggtctctaaagtcgggtaatgtccaaggtgacctcatggcctcaggaggacaatattaaaatttctaaatttttccatcatataattttttaatttctggaaattttttagtagctgttttatgatgttcatgataaactaggacagcaacacatgcgtgtaatttagaaagaaagaaaaatagaggcgtgtgtgcaaaaggttttactgacatagatgcatgatcaaaatatctaagtcctctccggggttcaggctagcagggctctgaggcattttgggggtcaggggaatgggaaggcatcagaacagcactgggagacttgggctcctccctcaacttgctgtgtgtccttgggcaagccacctaatctctctgagtttataaaacaagcagaggaagcttataaaacaagtacatgcaggctccttctagcaaggggaggttgagatgatctgattctaggctttgttccagatctcagataatcctggaatcttgagactttgaaagtcttctcatttcacagctggcagatgctcatggtccttctctaagcccagctgtgactcatctgtgatctgcttacatactcccaggaacagggagctcaccacttcacaggacaccccgttctgtgctggacggagctgtcatctgcctccctttctctttctctcgttcaaggtgaaactgagaggagaggggctgcggcctggcctttaggggctgaggaaggagtttttttctctcagggctgtttcctgtgagtgtcagccacagccctcaccacacctgccttctttttggggtgttctcaactttcctgatgagacaaagcctttccagctcactctttagcaggtagagggggcagttagagcatgcaccgtgctcctggtactactgccgaaccacgtaagcttgccccagccaaaagcagattctgtttgctgggcaccccctgccagtccctgagctcagtgctttgcaaatataatgcaatttaatcttcactaaatccagtgattgcaattttccagatgaggaaactcagagaggttaagagacttgcccaaggtcacacagtgacctggattcaaaatcctcttgatctgattctggagcccagctcttcatcactcttccgttcagtccctttccacgcccctaaacaggatgtaatgtggcaggaagacaagttgagacctgtgtctgagctaaaaaaaaaaaaaaaaaaaaaaaaaacccacacagtcagcaagggggaaacagatggtgggtggctggttgcctgtcagctgagcatgagttaccagtgcagggctgcctagaaagccgatgtaaacttagggccatattaatagagatagggcaccgactagaggggaggggacagttttcttgttctttatatgggcagaggttacctggagaactgtatgtatgtcataggggaagggtggagggcttgctgtgaggacatggacacacataaggttgtgagttccccatggctggaagcacttaagtagaggctgcatggcacaggtttatgggaggcatggataaggtgacctccaaggttctttaaaactgcagttttgtggctgaacttcagttgtttctagggccaccccaacactcaggcctatcagattcgccccttccacatcattcttagcaagggtcatctgagagtgtggggttcatttgttcattcattcattcattcattcattcaacaaatacaacagctaggggaatgaacaaagagacatacaggctttccctgcctggaacctacagtcgaatggggataatggataacagcacagattgagtgcttactatctgccaggtactttaagtgaattatcccatctggccccaccacaatcctatgaggaagatgttattgttccctgaggggccatgggagacagagattcagggttagatgctctccagggccctcctgggcctgtgttgatgattccgggaacctgaagctctatggtgctctctgatccccagagcttgttgttacagaaggggatgcagtggaggggccttcagcttctaccccccaccccacctctttaagcctgaccttcagtagtaacagttaccactcttcctgagaactgggcctaagggctctcctgggatagtctcatttactcctcacagtagcctcctaaggaagttactagtattatccccatcttgcagatgggaaaaccgaggcacatagaagtcaagtagcttgcccagggtcacatagctggagagaggaagacccaggattctgaacatgggctctctgtgtgtaaaggccactcttttgtctgagatgccctactgacctggcatgccatctgctccaggatccccactactggcttccctgctgtacaccactaaggtgggaggggctggtcggggggccgtgatgcaggctcagctgactgatgctttgctttgcctccagatcatgagcgtcttgttgttcatcgagcactcggtagaggtggcccatggcaaggcgtcctgcaagctctcccagatgggctacctcaggatcggtaggtccaggggacgccggtggagtggcggggggaggaggacagggagggccctggccagggatagccaggctagtgttggaggcactgccacctctccatggacgatggatgacctctggcaagtgtcttcctttcttggggcctcagctgtttcatccgcaaatggggatgttccacctgaccccacccacatctgcaggtggtgagagcagatggaatggcactttgcaaatccccaccagctggtaaaggtgatagcctcactcttctgcttaaagccgtcagtggctgctcatcacactagaataaaatggaaactcctcaccataggatccagcctctgcccacctctctgacagcatctccctgcgattctccaccccacaccttgctccagccacactgacctcaccaaccctgtccctgtctcaggccgattcctcattgctctcaggccactccccagggatgccttcctcagcctcaccctggctgaagtggaccccagcctgcacctccagcccagcaccctctgtcgcatcctcctgtgctatgtgtgatgttctgcttttgtctttgtactcactccagactcaggactgcaagagggcagggcctgggctttcctgtgcatcctcatgtccccaaaccagtggttccccaagtgtggtcctgggagcctggctggggtcccaggggcacccctgagcacctccctgctctccttgcctttcagctgacctgatctccagcttcctgctcatcaccatgctcttcatcatcagcctgagcctactgatcggcgtagtcaaggtgagggctcaggagccccgctgccccctgccccttcctgttattcacacccactggtggtgggcagtgctgggtgctgagagggtgggaggcgggtatgttaggcggtcccacctgcgttctggagatcttcacacataccttttggagaaccatgtttctccctgagattccctgggcaggtgacctcagttccctggtaacatgagcctccacggggccgggcatggtgggctatgctggtcaccgacactttggtgagaactagctgatgactcacatccttttaaacggcaggtggaagcagggaattttgagagtgaaaagaggaagtgttgtttctgggggtgagagacgggagaaagcactggattttgtaatggatgagaggagccgaagaagggggaaagtaggatgcatgcagctctatccatgcagtgacaggagccagcaccctgagggggacctacgccctggaaggcccccagagagctcatgatctgattggggaagatgggccttcagagagacagggacagtctagtgtgacaacgaggggctcctgggcccgaggcaaatctggtgggagagttgagatgggctgtagctcaatcccctgcagaagaggaacccgcggtccctgggtccccagaaaggcaggaagccagggcctcaccacatagccatgggagtaggatccagaaagagggtccttcctgtgcagacaggggcctggcccttgcagggccggaggagtggggcgatgatttggtgctggtttggaatgcgtccaccctgcctcaaatgccagcacccactccccttgctaacactcactctgtcttggaacccatgctgcctggggaggccgtttgccttgtgcagggtggctgtgggtgcttgtgcagaaactcaaagggttcagctagagaaatggagaaatggagcaggtggtccctgaagactctgagatcagtcaagattgttctggttgcctcctgagtgattttagacgaccacatgagacaccaggaaaccactgttgcagtgattttgtccccagctgtgagagcatatgaatgaatactggtcatggtggtcacttgctttcaattgaagaagagggacttcagcctcttcctggcagggcctcttactgtgactttggacccctgggagtggctggtggaggaaggtccaattgnnnnnnnnnnnnnnnnnnnnggggtgggggaggaaggtgtaaaggggtgtttgggtgtaaaacgaagagggacgaaatggtacgccgggtggtggccccgtgaaggtttttttgggtcacaggtaaaagggtgggttgtggggtgcccctccgggaaggggtgtttaagtgtgggccgccatgtaggcccccgagggaacccccgctggttcgcaggtgtgttttgttccccccacccttttagagggccatatgaagttgaaatagtggtcaatgggggggccacttggctttcgaaattagaagaagaagggactttcaggccttgtttcttggcaggggccttttttattgtgacttgggggcccctgggaaggggattggtgaaggaaaggtcccaattgtatgccggggggtgttgggaagtggtgggtggggggtaggggctctctgctgcctccgggccttcactcatgttggtctttctgcctccagtgccccgcccctccctcctgttcactcctagtctccttccccgatctagccctggtgtccccacctccagcaagtcctctctggtcccctctcctctgtaaaaagtgcacaaagcccttccttgctgggttcttgtgagcaaattgagtcaaatcctgctctttgagccctgatagatggggatggttcccttacgtctcctgggacaccaagactcctctcattcagggcctgggtcttatccactccctgtccccagagtgtcactcagagggaggtgacctcaactgaggagggcagggaaggtttgggagagggtgggaaggggatgcatgaggatatcaggctgggtggcggagtgttggctgcatgcaggggacacttgacggtgctgggcctacctttcagaaccgggagaagtacctgctgcccttcctgtccctgcaaatcatggactatctcctgtgcctgctcaccctgctgggctcctacattgagctgcccgcctacctcaagttggcctcccggagccgtgctgtgagtacccagcccccacctctcaccggacagcagagcccaggtctggcatgggagatgggaggggaccagacacgggccctgtgctcaggctggggagggtaggagccctcttcctggctggtgtcttgacccagtctctgagtccctccacattgccccaagtttcttcctctgtggaatgtacctgcaatcacatctcatcagcctgccttatgagggttacatgaggaacacacacattgggggtgcagcccatggtcagcactcagtcagtgccgctgggagtgaattgacacctgaggaaaggacatgtgcgctttttagcccccagcccccagtattatttcttctttggaaccaagttgaagaaaggaagagaaggatgattcatgccagtgagcgcccactgtggggtggcttgagggctgctgccagtcaaggacacagtctcccaaacctgcttttctcactctccccaactgttgtccttgaagagaccggggggctacatcatggaagggccctggcccgggagtctggagaccttggttctagtcttgggtctgccaccagctcttggtatgaacatctgtgtgttcatgtctctctgtgcacaggggacgagagtcactgatgtctgtagctgagacggtctctcaagtgagggcctactatgtgccgctcagtaactgggactttaattgctgctcctcattcctcctccttgtatttgtcctccccagagctcctccaagttccccctgatgacgctgcagctgctggacttctgcctgagcatcctgaccctctgcagctcctacatggaagtgcccacctatctcaacttcaagtccatgaaccacatggtgagtctggggcagggaaccatgcccatttgctggctgtgtggccttgaacaggttacttcacgtctctgtgtgtctgtggtttaggccaggttccctggagttggagcttgggaggaagattcttgtgctggtgatttattgagggagccctctcaggaagaaacttgtcaggagtgaggaaggcaggttcgagaaaaggaggaagccaagcaaagaagcaaagatgtggctgtaggagcagccctgcatgatcccagagagggctttggcatgtgaattgcaacacagacataatatcagtttttattgttgtctaatgaattatctctaagcatcatggcttaaagcaataaacatttattatttcacacagcttctgaggatcaggagcttgggagtggcttagctgggttcttctgactcagggactctggtggggctgcaccagagatggtacctggggctgtggacaactgagggcttgattagatctgaaggatgcactcctggtggctcactcacagggcgtgggctctttgcctaattcctcatcctgtggacttgtagtagtgctgcttgagtgctctcctgacatggctgctggcttcccctgcgggagtgatgtaagagataagcaaggaggaaaggcagtgtcttttaagacttctatcacttctgccacattctgttagttagaagtgagttgctaagtccagcccacactcaaggggagaggaaataaacaccacctttagaagggaggcgtctcaaagaatgtgtggtaatatttgcaaatgaccacagaggcagtctcacctagggcgagttcccctgcatcagtcattggtttcaagctgcccctaggggagggaatgtaacctcccaggtattagtggattaggtggtccctgtcagccaaaatgatcttctagagaagagcataggtgtggcccatgggcagctgacacctgccagctggggatgggccggtgcgccagcctgggaagcagatctggagatagtagccacttggcttttcttggtttgcccgtcagtgggatggggctgaaggtagcacctgcttcctaaggctgctgtggcggtcgaccaaggtgacggctgtgccacgctgtgctcgtgtgtgtgtggagggtgggatcattattcccggatgtgtgggtgctgttggaattccttatgtccagagacattgatgtggcccccaaatctgttgcagaattacctccccagccaggaggatatgcctcataaccagttcatcaagatgatgatcatcttttccatcgccttcatcactgtccttatcttcaaggtgagtggatccctgccctgcggctctgggaggggtggtgaggctgtgctgggcccaggcctgcccatgccaagctgttagaaggcagggacatgtgtcctccatgcctcctctcctgcttttagctcctttctcttgctttcccatgccagctcctctgactttacttgggatcctccgagacagcccatttagggcatgtgaatccgtaaaggccacctgcgttcagatgtctaattccagctgtctggaattagatttggactggcctgcgtttgaatccaagccccactgtcactagctgcgtggttggtcttcagcaagtcacttctctctgggcctcaggggcaggagtcttgttttgcctgtgttacagttttatgtaattcaggcatcaaaatgtacctgagattatgttaatagaggtttggtgatgagaaggcaggaggggaatggtctcattcttctctggggtggtcaggcccagaggatagggtccagcttcaggtcccaggtctgagtgatggtgaagcactggagtgtgttcacagcagtacaaccagcaacgtgaagagacaagaaaacgctgccatcttaggaagtcaaaaaacccccacaaaacccaacaaagacctgagcgtttattcagcatggaaaatagaggactcaagggggacctgactgctgtttcttaatacctgaagaactcttgtggggaattttgtgggatcctagaggccacaatgggggcctgtggcctgaagccacagggatgctgatgaccacagaaggaagggcttttaaaaagtgttcttttctgattataaaagtaacataggtcatagtagaaatttaaaaactacagatgagctggatgtggtggctcacatctgtaatcccagtgctttgggaggctgaattgggaggattgcttgaggccaggagttcaaaaccaacctgggcaacatagcaagattctgtctctacaaaacataaaaaaaaaaaagttggatgtggtggcgtgtgcctgtagtcccagctactagggaggctgaagcgggaggatcgcttgagcctgggaggttgaggctgcagtgggccataatcatgccactgcactccagcctaggcgacagagtgagaatctctctctaaaacaaaaaacaaaaaccaaaaaactacagataagtagaaagaagacaagcactccaccatccacaccccacacagagagcatcactgctgacaactgggtgcatttccccccagcctttctgtggtggtgggtgggcatctgcagaccccagctcctgcttccatctgaggccctgggcagtctctgctgtcacctaatgccaacctagaaacagaaccttgccccttttagcatcttctccaaggactgacctagcacaaacgcactagtgagtgtacagtgagaacacccctgaaggcctcatgggggaagccagtgtgggctttccatggcactctctactgcaggacccctccgcagaccccagcacacagctccgtcccccagctccccttctgttttttatcctccagaatgaggggcttccctctttgaccctcattctgcctctctggccccctccaccgacttgattttccctgggccttcatgcttcattctttgtcactccgtacctccatatgtctccttgccccacctatgtgcccatcagggaatccatcaaacaagaccttccagtacaggaccctctcctcttactcagggggcatcctgggggttttctgttgtttcttgagcttgccccttgggattgtatgccccactctggaaagcttctgcccaattcttacattaacttgcatcagctgatggacatgtactaactgttcctcctttataaacatggaccaatactgcacatgctgttttgtaatctgcttcagaaaacaacatatcggaagcaattttgaagaaaacatgtcccaccatcagctctgtttcgagatgggcagggctgtctcaggaggtagtgagcttccaggcagtgtgggcagtcaagcaggagctgtgggactattgccagggaaattggagggtgggctagaagccccccaaatccccttgctatgtggtatctgtggggcaatgaaaagggcaatacctggaatattctggactggctggtgaggaacccccaaccagaatgagaggtccgagcaggagcagctggatgctggcttctggagagagtggtggctcctgcctggcatatgtcctaggcctgctggagcgtgagaaggacgctcagcaaagcacagcctgacctgggcctttttccaggtctacatgttcaagtgcgtgtggcggtgctacagattgatcaagtgcatgaactcggtggaggagaagagaaactccaagatgctccagaaggtgagtgtggctgcaggtgggtgccagccctgtcactaactccctgtgccatttgggtcaagtttccttccctctctggaccttggtttctctatttgtaagatgagggttggaacagaagaaatgtgttctctttcagttctggtagtctaagattcattcactcactcattcatttattcagtatttactgcctctcactctttgctagtctcatatcgattccaggaggcgcagagaaaactaagatgccacctctgccttagaggagtgtacagttcagacacatagatacaattacaacttggtgtgaagcacagggacaataagcacagaggaaggacctggcctcttctcaggtatcagggaagccttcctggaggaggtgacagttaactggtcttggagggtcaatggatatgagatagctgggaaagcagaaggaggctttccgggaagagaggatgaggtgtgcttagaagcagcttattggaaagtgacggtttaaattcctggtaacttactttcctcacctgtaaggtggagattgtattagctaagacacttttggttgcaagtggcagaaacccaactcaatctgacttcaggaatttactagctcacagaacttagcagccaaatgtaggtctggcttgggcctggctgagtcctgacatcaggatatgatctcgtcctctccaactcttgactctactttccttgatgttggcttcattttccggaagcccatcccttgtggtggcaaaaaggctgccaaaacccctaggcagatatcccaccctctcagaaatcccaacagaaaaagaaggtcccaggagtatgtctgattggaccaacttgggccacgtgcctatccccaaaccaaggactatagccagggggatggaattctactttgagtggccaagtccagccacctcgctggatctgagggatgggaccagttcttctgaaggtatatggactgagaatgttttcccaaggaaaatggtgcactgttttcaaaataagggggacttgatgctgaataggcaaaggcaaatatgtccactacagggctgggaactgcacctatctcatgcaggcaatgtctagcacatagcaaatatccaagacctgccagtcattatcatcatcattttgccagaggtgggggtttgggtcccatgaccccaggttggaattgcaggtcattcttgaccatactcagccctcatctctctgtctctcccaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttctgtctggctgatgtgtttctggaaatacagtgtagggagggtggagaccagccttctacctccatcaccccaggactcacccacaccccctacacccacatacacacccctcacactcacactcacatgccccacaaccacgcccaccaacatacacacccacacccccaacgcccaccccctcacccccacgcccacacacccacacatgtacagctacatacacacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17063 - DNA, 100837 bp, Human
  misc_feature (1)...(100837): n = A,T,C or G
tgatcccaggagttcaagaccaggctgggcaacataggaagaccccgcctccacacacacacagaaaccccacaaaaattagctgggcttggtggcacacacctgtggtcccagctacctgggaggctgaggtaagtgaatcgcttgagcccaggggttccagggtgcagagagctatgattgtgctactggactccagcctcggccgagcgacaccctgtctgtttctttccttttctctctctctctagctctggatcgtacaagaagggagacaaggaccactgacaagatatggtatgtgatactaatcagatttggcttctttctgtcctgcttcaccagaggctggactctccttgtttcagtttctccgctttccacagataaatcttttgtttcccggatagccacttggcctgtttgccctttgctcccatttttccttgtttgcttctttgtctgaaaatttatgctgtcctgctgcctccgctgggcttcgtttccacctttgctggaggagatttagctgacaacctcacagatcttccccgccccttctgccgagctgatctttctcttggaaatcttacccgcagggaagggcgagtgtccgtgcctgcctgcctgcctgctgcagcccgcgcaaagctgagcggccagggcgctgctgttcctttaaagtattattaaaaataatatttcagcttttaagtaactccttgagtttgaatcaaaagctggaagaacctcctgggctctatgagcacctctgaatatgtctgactctacattctagaggcttcaatatatttataattttggctcatagattctccacatcttttcagcttcaattcttgcttttcccagaaacaattttcaagcaggagagaatattgattggacttgattttctcagtttgggcagaggtttgcagacactttgcaggttgccagacccttcgtccagccacctgtcagctgggggtcatatggtatagaaagcagtcatttctatgcaaggtactgcttgggcctgcctccctcaaaggggtaggggatgcgggctggacaaagggctcgtgatcaagtaaagcactgtgatgacagctgctatttctatatctccctagacttgtcttctaaattaaaccttgactcctcccttccaagctggagccactgctaactactgggagagccttagcagataaagtctcatgcctccaggcgtttgtgcatcccattttctctgcagagtagaatctcccttctacttttgtgctcctggggacgtcctactcttcttccccagttggctctaaggttatcacatcggtgaagtgtttcattatcactttttagaagaaactgagtcttttagagaagttaagtgactttctgcattcatactcatactcaagaaaatctaactccacaataaccaaaaataaaaagtagaaaaaaacccacaagtgatgagaaaaaaaaaaatcaaaagttataaaaaataaatgaaaaaatgaaattaaaggaaaaaagattttttaaaaaagtaaaaaaaagaaaagaaatctaactccagagctctgacacaaaatgccttaggtgttattctcaatgagagaaaagggacgtgaatctttaagtgattaagtgaatctttaagtaaatctgtcgtactagtgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggtataaagaaagccatggacttgggctttacccggactggggatccggagagggtggttcggaagcaggaatcgtgggatcgcggtcaagacaaagaatggggcaagagaagatcatggtggtgggctcagtcaggagggccgggaccgagggatgcgctatgagaaaagctggagatttggggctccaagacctgaatttgagcctcgctgactccacctcttccattacccacccatcccatccctcttctccctctctacctgctctttgtctcacctgcctccccacccgcctcccctctctctctctttatcccattccactccctagccccacttcctctattacttccgagcctgggttcttaagatctctatgagaatgaaaattagctgtgataaagcaactatcccacagggcttgttgtaaaacttaagagagggactatctgtgactaaaataacttaaactgtaaagcgtcgtattattagctttataataacgtagtatcccgcatttattgaaagcccactctgtgagggacggatctaaaccttttattcttatctcatttaatcttcacaaccccttgaagtgaaaactatttatccccattttgcaagtgggaaaaccgaggaataaagaactgtgggcttttcctggtgaaatccggatttgaatccaagctgtctggtttcagggccctggagaacccctgtgttgctagaaatctatgaccattggtgtcccagatcagtaacagaaattacaatgaattttaaagtgattttttttttcaacataaaagagtggtagttgtctctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggtttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcagaggaattttgtggtttattagcacgttttttttttcaaataatctaattttacttcagaaatctcttagtgcattgtgttgtttgtaaactagtgaaaaataatcttttcttttcatgtgttgcctgagatataaccacatttagaaatcatctataacttccctgataggaattcattcaggtttttaaaacatttctagggtcaagagatcacttaaaaaagagtagtttctttattgatcacttctaaatgttattttttatccctcgtatggagtcgcatcagtctccctgtaacttccatctgttgatcccgttgtctttcttggcagaccaatccttttatacaacagttgtcaaatatctggggggaggccagacacggtggcctatacctgtaatcctagcactttgggaggcggaggtgggaggattgcttaagccaaggagtttgagaccagcctgggcaacacagtgagaccccaactctacaaaaaaaatttaagaattagctgggcatggtggggtgcaactgtggtcccagctatttggaaggctgaggtagcgggatcacttgagcccgggagatggaggcagtagtgagccatgatcatgccactgtactccagcctgggtgacagtgagaccatgtctcaaaaaaaaggaaaaaaaaatggtggggaggaaaactgttatgttccctttaatcttctcatctgacttaaatatctagttatttccaactgttctttacatcatgtattcttcagattcttccctaagctgctcatttcatgttcatttgtaattaattttcctggtaagatgttagcccagaactgctcacagtttgtttgatcggtacaaagcactgcgagactatcagtcagagtcaaggaatgtgaactccagaaaggaccttaaacctcatctagtccaacagtttcctaccttttagtattattaacagtgagattaagtgacattcccaaggactcagaactaatgggtaggagagatgggactagatcccaggtctcccgattgctattatcttttttcaccagaagacccttcttttctcttcttgaattcactacactgttgatacagaccaacatatttaggcgatgaagtaagataggtgtggggaatgtggtgcaaaagacatttcacgttgttgattgattttataattcacactgaaattgtgagttgccatcaatccaggtctcttccagcttgtgttcaggtaaaatttggaagccaggtataaataactttacatgtattccttttaggttatgtttctcttattttcttagtctcctacatacgtgattgctatgtaatggcttgtgccttagcttatgtgattccgtctgtcacttacttgttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggtattatttgttatctgtctgtgtcctctactagaatagatttggtgtctttattttagatcatcagtttacaaactgactcaaattgtcagggtatacctcttagcatatatatagattctagcagtcacttcttgtgacaaaaatgcttcataacaaattatgccccgaatcagtgacttacagtgaaagcatctgttctcatgtttgtaggtctgcaggtcagctgcagtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatccctttttcacacctttcctaaatactgatacaggttcatgaatacaataagcaagggacattcttacagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacactaaggttaggtcacatttaagggaggagaattagactccctctcttgataaaaagagtagcctgcaaatacaaggagagaaagaacggatggtggctatcttggaggttagctactacagtgcctcagtgtcccatgtgtaaaatgagaataatgatacctgtcacatagggtagttttgaagaataaaagaattaatgtagataaagtgcttagaatagtgcttggaatattgtaaacactatgtaagcatcagctgtttttatttctgccccttctacttggtatgactgccacttttgctaagtccatgagttcctgcttctttcattgtctactgctgctcctcctggacacttctgtttcttctgtgtgtttacacttccgttgggcactagtacttcccacctgtcattctagatttttaaaaatcttgatgacctggagtccttgaggtgttgtgtcaaggaaggtgctctaaccctgttcttggttatagttgtgttggtggaattcaagtagtgtggctgtcccctggtatgctgttagagaaggtaagtagacatgagcagggcaggagagagggcccccgagaatgttgggcatttgtgaagccatggttaggcaattagaaatccgtccctctgaagtgatgagcagggcaagggaggggccccaaagctgtcaggttatcatcgaggggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttctctggataactgccgacttacaccccagtaacaagagtataggtgtttttttgtttgtttgtttttgttgtagagagaaagagtcagaatcaggaagtcagaatcaggaacttagtgccagtcccatactacattcagaatttcctcccctcccatgactgagattttgtctagggcaagattaccttgccttaagatggatacttgtctaggcggcagatacctgcccagccagtatgctacgcatgcttgaatccagcagcaggcacccagacaccgttagtccatgtacaactgggaattgttgtgttgtttacagactaaaggattaaacagaccctacaaaaatgaagaatgacagaattccattatctctccatacagcactcttccccatcaatgtaaaaaggcttatgttaataattagacaggactgtcttttgtgtcagatactattttttgtttttatatttcattatgaaatatttcataaaataggcaaatatggagaatatacaggtaaccaattttcccattgtcttatgctgtaaatcctaatgtttcatatttgtttgattttttttttaataaagtgttacagataaacctggaggcccttccttaccctttttttctcttctccttttctcaggattttggtagttattaccatgtatattttatacttggacataagtatatattcataaatacttagtattgtataaagctgtcaaaagtgtaaatggttttatatgctacatgtaattctgcagcatatcttttatcaacttattttagatctattcatgttgatacgtgttgcacaaatttattcatttttactggagtatgatatttcgttgtataaatattctgcaatgtatttttgcattctcctgtttgatagtttgcttccagtttttgccctatcataaacagtgctgaagtgtaaacttcctatctgtacataatttttctagggtatactgtatatgcctgcccctgaaattgctgggatataggctatcctgcacttttttttttaacctctggaaaatttaaaccttagacattccataaagacatactaaaatcttttcacattacccatttttggttctctcattgagaattagagtttgatttcgctggaaatcatcaagaacacttactaccctcctatttccacacctcaacttctgctgaaatgaagggtgagacttatggtcaatgaaaaacatctgttcagaacctaagaattgtcattgtctgtaagtctcatgtttcatcccgcccaatactatatggccccagggacctgccatagggaggtctggttgtcctgctccctgaaggttaggtattttattgcttccagattgttctaatatggttttcagccatctgacatttttttctaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgactgtatcctttttctgccagagaagactttaagaaatttcctttattctgggaatcgtacagcagtttgatgagacacccccagagtttcagctatgagtatatgggtatattttgctctgaggagggggaggtaatgtgttaatagggtttaatgtgaaattaatcagtttaaaacagtgcctgggctcccagccctccactcacttccctgttctctgcatgggtgatactgagaggttgggaggcataggaagggggaagatcctagggagtatatgtgagcattgactatatgcagagggttttagtggtgctcgttagaaatgtttggaggcggatagaaaatatttttagaagagcatcctcccaatgttctctcctttttttctggatggaagatgtttttgtgccagaaatcagattgatacccaaagtgagatttccagtttactccacaggtcccctaattttaagggatcatcactcttgttctttttctaatcagttagtagtgctattcctgatcactgggaagtgctgttgtgttaggagtgacttgcaaatgctacattatggttcgcttcatatttaagaatggactgtggccaccaagaatgggttctagatactattaaatgacataatttttggttaaatgaatgcaatgtgttagattaccttttgtttatatttcttggttgtttttggcagaatatatagtttgatatatagaatgtatgaatatatgttagtgaactttggaagaagggcactcaggcaagtactttaagtcatcacatagttcagtgtccacaatttccagcacggtggacttcattggaaagagttgcgtgttcacatgaagagactgtttggtgatatccctatccttaactagctgagtcctggatgcactaatcgtgagcatggatgtgattcaacatgaaacaatgtaagtgttccaaggaagagagctggaagagaatctttttgcaaaaattgtatgggttaatgtattgaatgtattttgtgattcattgttaatcaagctgcatgtttgtgtgacaagagaaacattttatagaattgaatggttcagtccaacctctctgttttttaaaagttttaaaaggggaagggctgtactcggtgattatttctctggaagaaataaaacatttggcttatttcagtttacttcctattagacttaagctgattaccaggaattttaaaaaacactaagtggtataagccatatgtcattgatattaagtgcatggtaactctggccaacttcccttttttgttgtgtgtgtgtatgttttttgttgtttttttttttttgagttggggtcttgttctgtcacccagactagagtgcagtggtgccaatatagctcacagcaacctcagcttgatctcctgggctcaagagatccttgcatctcagcctcctgagtagctgggactacaggtgcacacccaagtccagctaattttaaaatttttatttttgcagagacggtctcactattttgcccaggttttctcagactcttggcttcaagcagtcctcctatcttggcctcccaaagtgttaggattacaggcatgaaccaccatgcctggcctgcttcctaattcagtatttatttaattattgtgccttggaagtgtatctctggagacatatatgtgcatgtacacatacctcttgcctgtcaggaaaatcatttgcactaaaatcccagacctaaatctgtgtaatcatttctcaatctctgtacatcctctgccaaatcttgccacacaaaatctgtgcatggagtcagagcaggatatttagaaagtgaacctgagcaaggctgaagttagagtatgctgggagaattctttgtttacattctgcctatgtggaggctgggaagggatattttttcatcacatttgagttcggaatccagaaacataacatttccataatacccagacattttggccaagatgttcaaagtataaagtgtatcagggttgattatgaatttaataagaacttaattggactactagaatgtaatcacatttattaactctagatccatttctaagcttctctcctcagtgaccaagtgtatttgaatttgtagaaaaataattcaggagaatgatttcttaatatgataactctctcttttagaggaaagaagtttgagaagaggcatattgaaatattcactgacctcagcagccgattcagcaaaagtcagctggatattataattcatagcttgaagaaatgtgacatctccctgcaattcttgtaagatcctaagaataatgcatgtagacaaatcctatgatttcctaatatagtgaatgggccctctgtatagagtacttggtttatgggaattttcgctttctgctccaaggctgaatctgtcagatgactgactactcagcaaacatttgctggttactctctgtgttctaggaactgttctgagtggtcgtgacaaaaagatgaaagtcagtgatccagaagaattgagcttagtggcagatcattgtttagtgttcttagactcaaagaattgaggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgctttttatttggttgtatttttttcttggtaatatgctttcttcctgtgctacaaacctccagcatacaaagtagagttcatagttttactgtttggtgtattccatgtacagctgattgttgtaattggactaaaaaaataccagcagctcagagaagccctgtgttctgtttttaatttatttttaatttttttttttagaaacgtcttctgtagtggcatagttatagctcactgcagcctaaaactcttgggttcaagtgaacctcctaccggagccttctgtatagctgagactatagatgcatgttaccacacccagcagtttttagtttttcttggttgttgtttgtttttgagatggagtctcgcactgttgcccaggctggagtgcagtggtgcaatctcggctcactgcaacctccgcctcccaggctcaagcagttctcctatctcagcctccctagtagctgggatttcaggtgtgtgccaccacgcccggctaatatttgtatttttagtagagatggggttttaccatgttggccaggctggtcttgaactccggacctcaagtgatccacctgcctcgccctcccaaagtgctgggattacaggcgtgagccactgtgcctggcacagtttttagtttcttctactgactactgaggaagcttatttctgatctaacgcagaatagacagaacagttattatttctttttccaggataacttcctttctcttcacttttacgacatttgtccttttctggttattgctttgaaaacaggagtaacctgatgcaaaccctgtgtctcacactttcctccctggaaactttttacctgataaatgcaggacatgcaaattacatcatgctgtatttgctaagtatatgaagaaaaattgtaaacagccttattttaagtgtagcaaataaaatgagaaatcaccttaaaaacaaatttatttctcacagttctggaggccgggaagtccaagatcacagcactaacagatttggtgtctgctgagagatctttgctctcaagatggtgccttattgctgtgtcatcccatgtcaaaagggctaacactgttctcacgtggtggaaggacataaaaggcaaaaatggcaaaaagcctctcccttcaaccattttttttaaggtcgctaattccatttatgagttccccaccctcaggacttcattacctcctaaagggcctctgtcttaatagtatcatattggtgattaggtttcaaaataatgattttgggggacacgtgtagaccattacagtgtggaagaggccagtcggagagagtgaagccagcataaaggcaaatgaaggtaaaatagagacagagagagtaatccttgccacagttgagaccctgggtctggacttcctaaggccttgtgccaccctgccctttcagttacttggttatgtagtagccagtgattttccccttttacaaaccaaagaggtttcagtcacttgaaactgggagaatattggctaaggtaggtaagagtcgtttgacagatgagaaatttgaaacttgaaaaggttgactgatgtgctcattttctcatagctgatgagttacagttacaggattagaacactaactactgttgatctttcttaatagcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaattatagaaagtggtctcagatctgagatagtcagtatcttcttatcatcctattaaggttttagaaagtagcatactatggtatagtgattttttttttaaacttttgatcacaaagcagtttgattgagtgaaaaaaaaaaaaacctgcaatgtaaagagttcatagcctacttactttacgtgggcgttggaaaggcaaaatgatttaagaaaagtgaattccttgaagtaccgtataacaataaagcaaactgctttttcaaccatccagctagagactatggaagagaccatctcctttatccatcttattcttggttggaattggacatacatgcattttgagcaaagaacctaagaagaatcggtggcatctagaatagtgtgtgtcctatggggttcaatttggtaaaagtggcaatagagtactttacatagcagtatggcttgggtggttcaaattctcaggggtaatactgcttgatattcttgaattatttccagcttatcagtctgtacacaaaatactggctgtttaagcacattgaagtagtgattgaacaactagaatttttttaagtagctacagtgtatatctccttaatattttttctaaacgaccatttttaatatttctgatgagctataattgacaaaaattatgttctgattttctaaatacagacagccttgaaaaatgataggtaaatttaggaaacagaattgcccacgggattgccctaggaatcagtgaggaatcctgtgaggtgaagtttcttggcgtaatgtgttcttgtcacaatatttacagatatgtgttcctaagttgtttctctttcaaattttggaataaatgccttaagctaaacatattacccatgatatcacaaagaaaaattaggctggacacggtggcttatgcttgtaattccagcactttgggaggctgaggtgggcagatcacttgaggtcaggagttcgagaccagcccagccagcgtggcgaaaccccgtctctactaaaaataaaaaaattagctgggcatggtggtgcatgcctgtagtcctagctacttgagaggctgaggcaagtgaatcacttgaacctaggaggcggaggttgcaatgagccaagatcatgccactgcactccagcctgggtgacagagcgagactccgtctcaaaaagaaaagaaaaattagaggccaatatagattactctttaaaaagtgtttttgtttgttttttaaatttttctgtagcatatcagatagggaaattactgactatgcattgttttagcatttcgacgctactttgattttaggtctgccatgaaggtgtagaccagaactttgccatccagtacagtagccattagctacatgtggctatttaaattcaagttagttaaaattaaatacattttaaaattgagtcccttagtcatattatctgtgtttgaagtgtctattgggctagcatggttagaaatagaacattaccatcattgcagaaagttgtactggacagcactggactagattatctccatatagatcttaggaagagaacttgacatctacctgaggagattgagctctactgcagaactgagtcagttgttcttagattttttttgagacagggtctagctctgtcatccaggctggaatgcagtgacgtgatctcagctcactgcaacctctgcctcccaggttctagcaattctcatgcctcagcctcccaagtagctgggattacaggcatgcgacaccatgcccagctactcagatcttatatattggatgcccgtctttagaattttccctgaaatagaatctaaatctcatggtgattttaggccatgaggtttatattctgtttgactagtaatgttgtatgagacacgttagacctggttcagacccattcattcctcagcaaatccaaagccattgtgcaccataggctttggaagctgggtgtcaggtaagatatctactattcgttgtaaattatttctgaaaattggagtctcttgcgacctgtctgtccataactctgtggataatgtaaaataattctctttaccactttgtagatctgttttttatctgtaccaaggagttcagccagaaagtctggactgtatgctttgagtgtattttgtcattaatttctttgctgcttattttagtgaataccacaaattccacctatctcctatcatcttccctgttgtgtttgattatgggccagatgaaaatatgattgattttcacttttgtttaaatgaagcagcactccacaacactgtttgcacctctccccagcttttcccaccagtaagaaacctagagttaacgtgctttaccttgagactaaatatgaactaaattcctttattccttggatagtctttaactctcactattatatacatataaaaatgtgtatctttaatattcagaattggaattaatgaattatagagttgtaaacagtgatgataattataggatggtgccctccctttgatactctagaacagaggttcttttttttttccttttttcttttttttttttgagacaaagtttcattcttgttggccaggctggagtgcaatggcgcgatctcagctcaccgcaacctccgcctcccaggttcaagtgattctcctacctcagcctccctagtagctgggattacagccatgcgccaccacacctggctaattttgtatttttactagagatggggtttctccatgttggtcaggctgatcttgagctcccgacctcaggtgatccgcctgccttggcctcccaaagtgctaggattacaggtgtaagtcactatgccggccctgagcagaagttcttatcctcaggtccgtggttttcagggagttggtagtgaatcctttatattgtgtgcagactcattcatgaatgtgcttttatcacatcctcaaaggtgtgctggtcctgaaaaaatgttaagaacctctggcagagttgaaataaagtattgaataagaggaaaatagagctgttcattttcacctgttagtaaagtaattcagctcctcttcccttctaagccaactcactcttgccctggctatatctcccaacttgtggttgttgttttccggccatctcctgctgtttctctctttataattaacattagctcacttctcattgtagaaaatcaaatgcatcatccagcacaagttaacatttaaaaattgttgctttcattttatatttttctttattaagtgagagtctgagaaaactgtgcgtcttcaagaaaattgagaggcattccattcactggccctgccgactgaccattggctccaatttgtctataaggattgcagcctataaatcggtaagtggcaggtacacatttttaacagaaatgttaccaggcagataaatatgtgtatataaggaacagacaattcatgtgtgtgttactcggaaccataattactgcttttctagttgttctccctgctcatttaatctctgtttagctttttgtgtaaaaggcaggctaggagaggaagtttaaagaattgtctataatagagtttgatttcctcctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcacactttaaaaaatgagttgcttttggtgattatttgatgaaattctagtttgagtaggaatctgatgcgtgccttcatataagcctccttgcctttttcctttaagtgttcaaaataaataggaacattttagacatataaaataaatatacaaaaacatgtttttatgtatttagtttttttctttgtatattaaagaacttaattccaaaatacatgatatatctgtgagaaccttggggcagttctttatttatttcagcttccatcaaagcctagaatagtgtccctaggaatgtgaatatagtctccctcctcttttattttggcctgcttttcaaatttctttgttgatttctgacacagatatattgcttcttttttttttttctattggaaactatgataaaatgtatagtcctctttttattaaacagtctggctgggtgcagtgactcatgcctgtaattccagcactttcagaggctgaggtgagcagatcactttaggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaaactgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgtcatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgcttcatattaaataggattttttaaaagttgtactcctatgttatacccatttggattgaatagtgtgtctagatggcatctttatccagaggacttagaaactagctgaggatatctgtatgttcaagacctaaaattattaagataccaaatgatggttaagatagaaacaagagtccttagataaatgttttgccaggctattcactacccagtatagttttgatttgcaagtcttgaaaagaattcttttcctctgtgacactgtatttcatcttacagtgtatatatttgtgtgtgttggaggagggggttgtttaaaggtggtggtggttatgattccttcctttctcctgatggattatatgtagaatataattaataccctacaatttctaccagttcttgaattcaattctgtagcatagaacatgaattttggaatcaaacctgggttagaatcatggttccatcattggttaatcatttgatcctagtataatgactggctcatagtaggaagaatagcatgattaaagccacaagacctggaaagtagggggacttctcagagatactaagtagtccacttgggttggtgtattgagcatatacaggttagtacttgagggtaacatctaatggacagcctgcattttctcttttaatcatcagcgaccatcttataaagcaggcactctttgttatttccattttatagataagggaactgaggctgaaagacactcgttcacatattcaaagccacacagttctcaactagcaggacttggatctaggcctgtactgcttcagagtctgtgcctgcattctattctgaatttggactgagtaatgaagggctttggataataggctaagagtttatgcataaccttgaaaacaacgtggagccacttacagttttgaggaagagaatgtcactggggctatattttaagaagattaatatgacaactggttgtaggatggattggaaggagaaggatctagtgataaggatggatgccagttcttttggttgtcagcaaggaaggcatccctggttatcttaggcaaaaaggaaatttattgctggggcaatggagagggaagagttaaaaactgcttgggttcaaagagcgtagaagtgcatcttttctcctgtcctccagtttccagcccctaatcagctagaggtttttgctttttgttttttgttttttcttgaactaagggaccagtatacacatgtgggcaaaggaatctggttaaatgttgtagtctattgtaagtatacaatgtacaaaagttggagttatatgccatttcagtagatgaaccagaaaacatgaaacagttttagttagaatgttcattacaagttacacaattcacacgattcaagtaagatgatgactgatgacagagattaagacaaacatttggtttaggtaccagtcttaatcatgtgccatacatttccctgttaattttttgttggaaagtttggttttgtcactagctttttaaaaaagacatacatggaaataaaaatgtgtttctattttgagacggagtcttgctctgtcgcccagactggagtacagtggtgtgatctcagctcactgcaacctccacctcccaggttcaagtgattctcctgcctcagcctcctgagtagctgggactacaggcgcgtgccaccatgcctggctaatttttttttgtatttttagtagagacagagtttcactgtgttagccaggatggtctcaatctcctgaccttgtgatccacctgcctcggcctccccaagtgctaggattacaggtgtgagccactgtgcctggcctaaaagtgtgtttctttttaataaaataaatgtcatcaacagactaacaggaacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggacttttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttctaatctggtattagtagagctgtcttgacccctcttgatactgtgctagataagttaattgaatttaagggggtggggggagagacatgcagtacttatttttgatttaatttctctttctttcaacccttcccctctaagtcttcactcaagcctctactgttcatcagtgcctcagtgttactcttaggaggaaatgcaaaccacttagctttgtttttaggagacttcatcatctgatctttgttaatctctgtaatctaatttttcacctttcctctcacacagtggcactgtactactccaagagcagttctccaaatgtaccatgcttttacagcactccagacttctattgatactgttttctctgcctggaacgcttgtgcccagacttttctcttagttcctatttgtccttttaagtctcgacttaggtgtcaccgtttgcagaaaccttccctgatccctcatgaccaggcttggtgccctccttatgtgctcttaaagcaccatgtaaccctggaccataatactacactgcagttaatttcatatttatctattgaagctcctcaagggcaagattatgttttgttcactgttgtgtttacagtgctcagataatcttgaacgcatgctgggtgctcagatatttgttgtgttgtattgaattaaacttcaggtaataaggtgtttttagtatctgaatgtttttcagtaagaggattttgaatggaatttcttggcaatgtgtgtcatggttatacatgttacttattttggatcaaaagcaattcttttcctctcttgtaggttcagagaagattcttcatgggaaatcaagttctaaaggtctttgcagcaagagatgatgaggtgagttggcagcaggtctttgaggtagtgctacagaattgaattgtaagtctatgaaagcaagttgtttggggcttttatagtttaaaatgacatgaattcttgcaataggagtggggaaatccactgatgtttaactgaaaatggagatgtggtaaatggatttgtgttagcatgagcacaagacccgaggacatggagaccaaggaagtattaaaaacattttgaaccactgcatttaggaatgggaatttcacagtcaaatgttaaggagggttggggtcaggttgacattttgtgttgtcataagcatcctggatgtgcacttcagtgactcactagactgcttttgtcattgaggaaatgtgtcttttctctattcctctctcttggtactcttcctgcctccccaagatactctgttttcaggctggtttttctctagctaacagcctatgactgctgcattctatactcacatctgccctttctgtaaatatttactgtttgatctccaagttagaactaactttgttggagatactgattttaactggaagattgcaatctactatctgtttaaggcagctcaagcaggtttccaagttcctgaagtatttgcatttgtaattaataaactggatgtagaaggcttgtttggggtgggggtagggtggtggtataactagtatagttctctttttctcctcacttctggaaggtagctggttgctgatatagtggatgggtatgccattattatctcagaacagttaagggaagaaaatgtttggcttctaccctgttctgaatgaattattagagcacaatattagcatacatgaatcttcaaatttgagaatcctacttcatggatttctcttgaatcaaatcctgttgggaatcatggaagtctagtatatactgtcaaaccacaacttagctgaagttttattttgttttgtttttttaagagacaagatctcatatgtttcccaggctggcctggaacctctgggctcaagcgattctcctacctctgtttcccagatagctgggactataggtgtgcgccaccattccttgcttctgctgaagttttaacttccacttactgtctctttatgcaaagaacattctgatcacttcatgagacttgctgggtatgcagtgaggaatcacaaagttgtgttgagacacacgtgttgggtaatgatgtaggcttgctagctaagggcagccttgtggattgtgtaattcaaatctggccttatacaacactaatttctgtatatcataggatcactttgagataactcaagaaaaacagatttatctcctaatggcaaagggatactctctagtgtcagtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcatttggagaattatcttgtagaatagaaattaaactctgcttcgtatcagaggggtgaactggaaacagcaggtggtgctttttgttcaagatgaagaattattttgtcaacaaggattactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttctctggtcattagcatataattttttgtattgagaatctatactttcatgtgctgatttgcactgtgtgtagaaaacaaggagggaaaagaaaggaaggaaatggagctttagttaagttatacacagctgtagtactgtttcaccatgtagcagtcattcacagccccatccttccttcttgtttttttttttgttttttttttttgagacggagtttggctttttgtagcccatgctggagtacagtggtacgttctcggttcactgtaacccctgcctcccgggttcaagtgattctcctgtctcagcctcccgagtagctgggattacagatgcctgccacaacgcccggctaatttttgtattttttgtagagatgggggtttcacgatgttggctaggctggtcttgaactcctgacctcaggtgatccacccccccccctcctcggcctcccaaagtgttgggattacagttgtgagccaccgtgcccagccccttccttcttttaaacatcctaattggtcctgtcaaagacatataaataaaaacttcaaacaaattggaagtaatctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcataggttttttgtttgtttgtttgttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctcagtgatgccagaatagaggaacgactggaagggagtgacgtgatgagctctgggaacagaggtggctgtcagggaagagatggatttgagagacagtatagaggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaaagtgaaggatgagaatggtgcggtggcattatcaaagaccggggtttccagtgtggttgattaggcaatgatgttaatggaaatagggaatccaggaggagaatgagggggaaagatagtaagtttaggttttagtcttgtcgtggtgaatgtgaacagttcatactgaacagtttgagataactgaagatgccatgtcagatatccaccagctagcaggcagtctaagtctagatcttaggagagttttaaaaatgaatgtacaggcctggtgcggtggctcacgcctgtaatcccagcactttgggaggccgaggcaggcggatcacctgaagttgggagtttgagaccagcctgaccaacatggagaaacctcgtctctactaaaaatacaaaattagccgggcgtggtggcacatacttgtaatcccagctacttgggaggctgaggcaggaagatcgcttgaacctgggaggtggaggttgcggtgagctgagatcacgccattgcattccagcctgggcaacaagagcgaaactgtgtctcaaaaaaaaaaaaaaaagaaaagaaataaaagaatgtacagatttttgattcatcaactcatgggactggatgaaataatccccaagtagaattttagagtgagaggaggagggaaaggtctaaagtagaatttacaaattggtggagaaaagagaataatcaggggagaatgttgtttttgaagccatgaaggagaaagtatatagagacagtggaatggtgagatgctactgtcaaacaaaaaaatcgagaaccaaggagttggcaattagaaggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgatatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatcatttcctctgtctcagagaacttactgtggccgaactggaaagagaaggcacatatcttgacttccaggtcaaccttctggtcaccccagtcttctcatttgttgtattggtcatgcatttgatagcagtcctttagtattcttttatacatttctcttatgcttaatattctttatactgtttgcagttgtgaacagccagtagcagaagtcaaaacacttcacttttcatatgccagagttgggctgtccgatttttgaaatatttctgttatgctactttcacagaatttgggatcagttttatattttttcattaatttcatcgtttctgcttttaccccctttctttctcattagtgtttagtgtatgtgcagctgcctttcatggaagacttgcggcaatacatgttttcatccttgaaaaacagtaagaaatatgctcccaccggtgagtttgttttcatttagatcactcattgactacacacactgttcttgggaaatcacctgtctgctagttgttggttggggctaggtatttatagggtgcaattagttggatttccaatcatacacttagacacagtaatgatgaaggtggtttacttggtgtttttccagtagtagggataggtttgccttaaactcacccaacactgtctagtttttgccttggagcatgtacctaggggaaagcctgatggtaatggatgtccatctctagttgtgagcagagtttgcccctgccgaagtgaatctgagcagtatcaaacctgtgactttagtgttctgtgtaaagtctgatgtagctttgaaatgaaaagtgacagtgctgaagattaacttttctctttgccctgtttttgtagtttgcaccaacagtccaagtctcattgttacttatttctggcttttaggagttacttcaggcttgatgtgaaagctcctgattgagcatctggctgcaaatgtcagggtcctatatagaattattcttagagccacaggtccagtcttccagagagcctgtcatttaaaacaattgtaataaaatataatagggggcagaagtagaaaacataccaaaaagaacaacaaatgatgagtagatgttttaggttacaagtttatatataatgtctgtgtctgtgttaagattagggaattgtgaggtgagtctcggaactcaattctttctgttattttggctagaccctttggaagtagtgtgctatagaaaggccaagaatcagatgggtccctagggcctgtatctttatcttccttctagaaatgagtctgtctgcatcacggtggaggcaggcatggacctgattatatggaagttgccactgtattacagtattactctgtctctatttcctgataattccaaaatttaaatgagtagaatatttaattatttatttatttgagacagggtctcactctgtcacctggctggagtgcagcggcgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgattcatttacctccccctgggtctctcccacaacatgtgggaattctgggagatacaattcaagttgagatttgggtggggacacagccaattctggctcaagcaatcctcttgcctcggcctcctaagtagttgggactacaggtacgcgccaccgtggctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcatgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggtgcagaatagaagtataatgtactttttaggaactacttactcttttccaccttttgcctggtgactgtgaatgttccagaaatagtgcctcaggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttctttttaatgtttttcttctttagctaattactagtttttaaaatattagctcaatggatactaaatattttgttccagtctccttatagggattggtttttatatggctgtattcctctgaaacaaactttcttgcttttgatctgatactccattgtcagaggctcactgaatggtagaactggaacctaatcagtcagtcactctaaatcgatcttttcatggataagaaaaccaagacttgggttaaatacgtgcatagctagagaatactttggcagggccaggactgtataacctgccaatattgccgtggatatctctacgtagaaagcatttgttttagtggagaataatggaaataatcatttttctttcggcttctctgtttaagaggcacagttgaatgctgttgatgctttgattgactccatgagcttggcaaagaaagatgagaagacagacacccttgaagacttgtttccaaccaccaaaatcccaaatcctcgatttcagagattatttcaggtaagagaagaaggatgaacaagtcatatttcttttaaatgaaagagagctaagtgcaaagttgcggtaattggccagtcctaaataaatgtcttttttctctgaaggccccatttgctctatttaatggaagaataacatcttcctctcctacttcagaaggtaaaaatattctgagctcttaaaaagaaaaataaagttggaatgctttctttcttttcttttttttttttttttttttttttttttttctggaagaagcttactttaacaaaaaaaatacaggaaggccagttgcctatgctggagtgcagtgttgtgatcatagctcactatagcctcaaactcctgtgctcaagcactcttcccgcctcagtctcctgaacagctgggattgcaggcacatgccaccatgcctggctcatttgtaaaaatttttgtgaagacaagtcttggccacgtgcggtggttcatgcctgtaatcccagcactttgggaggctgaggcaggtgcatcacttgaggtcaggagttcaagaccagcctggctaacatggtgaaaccctgtctctaccaaaaaataaaaaaattagccgggcatggtagcacgtgcctgtaatccgagcttctcaggaggctgaagtgggagaattgcttgaacctgggagatggagagtggagttagccgagatcacgaccctgtactccagcctgggcggcagaatgagaccgagtctttaaaaaaaaagaaaaaaaaaggttcctaggctggtctttaactcctaggctcaagcattctgagtagatgggactccaggtgtataccattgcccccagccagatgcctcttttatattttttcaggcttttctcctgtattgtatgtaaataacacttttcttcgttttctatatcaaaatagtaggagagcttatatgaactctataataatataacattgttagagaagaagtgttctaatgtcacatttctcaaaaatttcataattaaagggagcataggggtcagataaaaaggttatattgtgaaattattaaagaataattaaaatacagaaaatataaaaaatcttctgaatctgagtccaaaggaattggaaggcagagattggattaaggtaaattggggaagttgacaagagagctgacttatgctgaggaaggggagggctagaccaaggttgaaggagaaaggaatattccagtcctggattcagttgatgacagcaggacataggcttctctgacccccacaaaactgaaaaaaaaattatataagcagctttttaaggcaagctgttgctcacagaggagtagagggcccttttctgcaggttgggggtaacagggcatgtgctgcagagaccacagattctcccttatgactcacttcatgaaacatctgtaactaacttaagtccatattggggcttgtgatttgagggatcctctacttgaaagaaactgcctgtttttttgatgcttgtaattcttttaagtagtgaaaaaaatcttttgttctaaaattagagatgtgaagcttaacatgtgaagacttgactctgaatactcatgcccctcagtttatgatggggatacacgcctataaacccatctaagttgagaatataagttgaaaatgcatttactacacctaacctaccaatcatcatagcttagcctcacctactttaaatgtgctcaaaacacttcacattagcctacagttgggcagaatcatctgacaatatcatgcactgtaaaggttgtctacccttgggagctgcagcttgatatcactgcccagcattgtaagtgtcctactgagttctactgaatgagtatcgctttcacactgttgtaaagtggaaaaattgtaaattgaaccatcataaaccagggaccatctgtactctagcatgctaagtgtaatgaagtataaattacagatataaaaatcctttggtgtttttttggcaaatgtacttgaagacctaaagccttgtgccatttgtaggaaaggtaggagcagaccagttcaaagcttaccaaaatggttcactgtggagaaaaagagaaacttctattaatactattttgcacacttatctacagtaggttgtatttatctttaataaatgcttattggaataacaaacagatacaagccataaatgcaggcatttttatattccaaagctgctgcaagcacgggctttgatttttattagtttgttttgtgggggagagtttttaatgtggcttatctatataaagaagtatcttcactaggatacataaacttaaaaaaaacttatttattgagtactaacaatgaaccacgtgcgaaagatactataagctgctttttttttttttatttttattttgagacggagtctcactctgtcacccaggctggagtgcagtggcgtgatcttggctcactgtgagctctgtctcctggttcacaccattctcctgcctcagcctcccgagtagctgggactacagatgcccgccaccacgcccggctaattttttttttttttgtatttttagtagagacggggtttcgctgtgttagccaggatagtctcgatctcctgaccttgtgatccgcccgcctcggcctccccaaagtgctgggattgcaggcgtgagccactgcacccggccaagcttacttcttttatggacccctctagaagaatgagaaaagtagagagagaaaaaaccagttgttaaaacagtggtgggaaaacaccatgagaataagaagaaaaagatttttgcaagtgggtgacttagggaaggctttgctgaggaattagcatttggacagagttctaaaagaacaaaggcggtgcatgtggtaaggagggcatgccatgcaaaataaataacatggaaaagcatgaaaatatgaagagccaggatgtggatccctttggctgcagaataagttctgtatggggaaatgatggaaaacgtgacagagaaggtaagtagtaagtaggttgtgaataccttgtatgccatactcagtcatttggattttacagcagtgggtaattaaagaattttcagtggcccacttgaaggcttaagagttaaagcagtgatggagagagtggagacgagaatcaattcttaaggcatttagaaggtatagatagaacttgagtgattgatggaaaataaagaggacttgaagataacaggatcctagcttgggtgactgaaaagatgatgtcaccattcaatatgataaggaatacagaatgagcaggtggaaaagataattcatttattttcacaagtgttaaatttgagaaaatctattggatatcctggtacagacactcattgggaagttacaaacagggttgcagagcctagaagacaagtcaggtctaaacacagatttgagagtcctcctcattgaggcagaaagacaagtgagtaagattgtctgggagagcacactgggtgagtaggagagagaacaaagtagagaactgcaacacgtgagtgaacaattagacatataaaaaagggttgttacaaaaccaaaccaaatgctcctacctccataccccaataaaaatcagcgaggtagaaaactaggagaaatgcatcttggaaggcacaggaagagacgagttggaaaggaaggaatcgcaagtcagatgcacaatggggagtagaggtgagcttagcaaagggtctttaggaatttgtagtccagtttgaggactttggggacacagaatcagttgagtaatggtgtgcaagccaggttacaatgcctagatgagaaagactttctgatgaagggagagagaaagagaggacacagtaatctataggaggttgtgggatccaggaaggccacttttttctttttgaaatacctacagttaagggtaaatgagcttggagaaggagagagagattaataattaatttgttatcaagaggttaatttaattctagttttggaaagaaatgctgaaaatatatcttgtcaagtatacagttaaaaccactttttaaataattgatacaatggtgctaaaatcagtatattggtaacttttgagctattgtggtctgtaggtttttcctctaatctttttcaaattgtaaaaatcacatccagtaacagttgcttaaaagagaaataaataggtgatctcagcttcccatctactcagaaatgtcactttctcataatcccatttttttagtgcattgggaatttttacctgaatgaattttgtaagtatctcgcttagcttaatttgcctaaaatgtgacctttcagaaaatatgagagggaggttggtacctcagaacatctcttgtagatcctttattattgacttaacggatgatgacactgaaaagattgcctggggtttatgctgaaaatctggaatgttttacagtaggaaggttgggtaggatacttgtccattggttgttctagcccttttccaagaaatgtcaattggatatcacagatagaatcttcaggagtttatgagaggtagtctgctatgttgggtgtttgattactgctttacatctttaggactttctaagctgttcaggtattttaatgaaccaagggagagcactgtgaataaaggattatgcataataagaaggtggtgagggggtagattcacagagtttgggatcttttggatttgcttaaacagtttggggattaccttgctttacattgaataggcctgatgttactgatgctcaagggaaagtcaagtaattaggaaagaagaaagcaggcatcaaactcagacaaacaaatgaatatactatggagaaggaatagttgtggttggtggttgaaatggggaagggagcagggagaagcgcatggaatttctggaggaaattggtacttaattcctacttcagggttttcgaaacttacaggacattgactcttggatgatactattaaacctaagcatcttttatttttttagaatagaaactttcagcttacattttcttcagtgtaggaaaggagtccaggggaccaggggatagtataaatcacatgctttgtgataggagcagtattttgaaattacaggagctcttcagctccctggtgttttgtttgttttttttagaattaccaatttataagttgtttaaaagtgggaatagttataccttaattttggaattaatcttcatcgaaggaaggaaaacatcaataaactgatagtttcatttctttctttgttttttaatgacatctaatcttactgctttctatactccttttagagcatttccttttctgggcaggccaaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatctgccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaataggggtggaggggctacttcatatagagtgtcagggaaggcctctctgcggagatagtatttcagcaaagactaaaatgatttttaaaaaaagggcaagggtggagctgactcttgaggtttagggaaagacagaggaggcagaggtagtgttaagcccaggccccaaagttaggatgagcttggtgtatgagcgaagcaggagcccagcctattggggttgtgagtgaggagaacaagtggctggtgatgcgatcgaggaggcaagcagggctgcatcataggaccctagggtatggtgagcagttcattctcggaccacttccagtcagacagtggaaagagaagctgggaaaccagttagaaggtgactggtaggccagggatgaggtgatagggcttgggcaagaatggtagcagtggggagagagaaaggtggatggacttgtgctgaaaagtgcaaactcagcactcagggacaactcagtattctcatctcttttgcagacctctctctgggactcactgagcatgggcagcttccctgtagccacctgtttcatccaccacatggcattctctgagattaagtgagggagaaagcacagcatgattaagagagataaaaggattataacaagaaagttataatcccagattatcaggtcttagaatcaggtattttagggaatcttgtatattccccaagtagtaaaaacaacagctttgatttataaggtgaggctcctttccaggaggtccagagcagaagatactgttgctaggcttggatctatttttacaattggttttaggtattgaccaatatcctgccaacaaaggtggttctaggtgaatcctcttgattgttttttacatgtggtatgaatcacttagccctcccacactaaagatggaggatccctgatcagaaaatataaagaagccatatatgtctccatctgtgttttaaaatccttactttttccaacagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttagagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatcataggttttttgggttgggaggagattagatgttggggatgtcaatgagatttttggaggaaaagtgggaacaagagtgaaaaactatcaattcttcagccgttctattagtgtatcagtgatgtatttggttgtgctattggggaggtgtttgtagttttaagtattgcaaaatgcttttcatatacacttaaatcaagcttacaactggctattaagttttttccctcttctgttcacaatctgtgtcagcttccattcaaaacaaaacaaaaataaaacaagaagaaattgttgttgcttatccagaattatttgagtatgtaaaattgatttttaccaggtttaggtcaaccagttattggtgacttttttttctcaagctggaataatctatacatttcttttggctgtattttgaaatctgattttaaaccatgaatcttttccccttttttatttgatttttctctccacaactatctttattgacaaagcttcttatttataaataccccagtggagaagtattgagtaatttccggaagtcttcacaggtttctataaatcattgatttagagaattactgtctaaattgaatagaaagttgtgcacattctgtgactttctaaaggttaacatccaagctttgtcagaattgaaaaaaaaaatcatgtacttggttccgccgcaccaactgcccgccccccataagaccatctctcaaggaaattgatagattgtttcttgatagattttatgatgtgcatttcttacacatcctggagaggttttcatttctgtttagtctatcgttctacacaagaagactgtccctaaaaattcactttccccctgctatccttatctaccttctggatttgtattttaaaacagttcaataaaagtctgcagccttttctttctatgacaccttgctgaagtctcactgcaatcacagggctattctctctctgtgtgttaaatctccagtccgtgatcttgattaccttctggtgttgtgggaaagaaatgggccattttctgctcttccctttgattaaaatgtaaattagctagttaaaaaagcacaccacccagacccagaaggatgcagttctgtcgtttgatccctgctatgatcacacctttggctctggtcctgctgggcactcttctggaagcttgggtgtgctgagcttcttgttctttgctcccataatggctcgcagcatagctaagttaatcttgcaggggcctgagaagtatcttactcacacacgcttgctcacgctcctattctctctctcttctgagaaagcttagtttttaagaattgtggaaatgattcatttagcaaatattgagtaccacctgtattcaagaagaatggttcagtcctttctacaaggttctaaaacccctcaattttgatgataaagctccagtcagttctagaggtagtttttccaaggaaagaaaaaattgccaacaattcgcaatgtttttgtatatattcatcatctctggatccagggtacatatttctagtggaggggagaggggctaagatcaggagtggacaaatgtctgttcaggaagtttaatcatcttaagagctgggaatcattccagttttttcacttgatatgattttggtgaaataattttacctttatgagattttcttcacctaaagaaaaatctcaagagatactataacaatgaacaaagatattaaagcactttgagcaactgacatccttcacttaacgacagggatacattctgagaaccgtgtcattaggcaatttcgttgtgcgaatgtcacagagtgtacttacacgagcccacatggtagaatctactacacatctaggctatgtggtatggccttttgtcctcaaggtacaaacccgtgcagcgtgttactatactgaatactgtaggcatttgtaacaaagaggtatttgcatatataaacgtatctaatgatagatgcctagggaggctgaggtgggcagataaccgaggtcaggagttcgagacagtctggccaacatttttagtagagaatccccatctctactaaaaatacaaaaatgaactgggcgtggtggtgtgtgcctatagtcccagctacttgtgaggctgagacaggagaatctcttgaacctgggaggcagaggttgcagtgagctgagatcatgccactgcactccagcctgggcaacagagcgagactccatcttaattaaaaaagaaaaataaaagaaaacgtaatgctttgcgctatgatgtcatgacagccctgatgtcacaaggcgataagaatttttcagtttcattataatcttatgagaccaccattgtatatgtggctcatcattgaccaaaacgtcattccgtggcccaggaatgtatttggagggaaggcaatagtcaaaacctaaagcaataatagtatcattatctataaaaacattgaacctttgagaagatctgatatttgtcttggacttgttgaatacctagtgttagaagtgatttcatttcaagaggataagagcaccatttgacactgtagacccaaaatatactaaatattaccctcatcatataaaagcattgcttccatttatgttgctgtacacccttgaaatgaaaatgtcatctcttggacggggaacttgcatgagaattcggacatctcaggtctaatcctgcttgtgcagctgatgtatacgtgatcttgatttctgtttatgcaggtggtctaaagctttctgctcttttcaggtccacgaagactccttctcacttactctcagcagacatcctcacttggttaatggttaagacttcagactccagagtcagccaatatgagtcagaccccttgctctgcagtgtggccttaggcataggttacatatcctctcaaagcctcagtttcctcatgggtaaaatagggataataggaatatctgtcttatagagttgtcatgggggttaatgcgagcagtgtatgctgttcactcttgtatccctaggacctggcaaagtgcctagcaaatagtaagaacacagtgtttggagtaaatgattttaaaaatcctagtaatatgcctggcatgttagtagtgacaatgacagtagaggccaataggtggtgtattagcatcactcatgctgctataaagaaatacccaagactgggtaatttctaaaggaaagaggtttgattgactcacagttccacatggctggggaggccttgggaaacttacaatcatggcagaaggcgagggagaagcaaaggtgcatcttatgtggcagcaggcaagatcgagtgtatatcagcacagaagaaactaccttatataaaaccatcagatctcatgagaattcactcactatcacaagattagcatgagggaaccgcccccataatccattcacttcccacccgctctctccctaaacacctggggattacaattcaaaatgagatttggggctcggctcagtggctcatgcctgtaatcccagcactttgggaggccaaggcaggtggattacttgaggtcaggagttccagaccagcctggccaacatggtgaaaccctgtctccacacaaaaaaaatacaaaaattggttggctgtggtggcacaagcctgtaatccagccactcgggaggctgaggcacgaaaattgcttgaacctaggaggcggaggtttgcagtgggctgagatcacaccattacactccagcctaggcaacagagtgagactgtcttaaaaaaaaaagagagaaaaaaatttgggtgggaacacaaagcgtaaccgtatcaggtgagaactccgcagttttgtggcccatcttatctcaaaacatacctgtttttgcatgtacctcccttcttttcctgtctcagtgaaatagggtatttatttcatcctgcctaaagtgaattcctttacctgtgccctggatccttttttttcttgtttttttttttttaattttagtttttgagacagggtgtctctctgtcacccaggctggagtgcagtggcagggtcacagctcactgcagcctagacctcctgggctcaagtgatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacacaaaatagtccccctagcttcttccctctaattactacctgttactaattactaatctaattattatctttccttccagaagccaggctcttggaagaatagtctattctgcaacctttctcagctctcattctcaccagcttttgcccccaccacatccttgaaactcatctttcaaaagacactaactgctaaattcacttcggctttgtggttctttgctttcttgacctctttgaagcacttgacactgtcagttattcctgctttcttgagactcatgtatctgtcttaacttcagcttctccaaatttttctttttcaatctttggcagctccctctcagattcctgtgggggctgcttttgtgtgtttttgtgttgatattctgtaggatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacttaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaagtgttggagtaaggatttaagtgtaggcagtctgactccagagcttgtacttcaaactgtaatgccactttgccttagcaatgcatgtcccaagacctcttttttatttcagagcctcaaaaactactaaatacctatcttcagctcggatttctatcccatcaactaaatagcttaggtgcctgtaggcccctccagttcagtaagccagaaatggctttgttatctgctttcttcttcctgctcctttccaacccctcttcatgctattattctctatttcagtgaatgacacctaatttcttgggagtcttccttttcttttacattctatatgtaattggtttaccaagttgtattatatttacctcaaatctaacgctttcacttaaggttagtctggtggctaatggcattgattttggggtcgaatttggagctaaactcaagcatttccccttaaaagcagttgaaattggcaagttgctcagtgtcaagtggcaataacaaatgcctgccttccaggaggttggttaggagaatgggtgagtacaggattagttctttccctttactgtgtgctttaaacaagggatcaaactttcttcaggcttagtttgctcatctgtaaaaggatgctgataatagctaactcatagggttgttgcaaaatttaactgagataatttaaatgtgtgtaacatagtgactagcacatggtaagcattaaaaagaaacgtaagctcttaatagcatcgcccactgccactgcttttatgtaggccttctcattttagcctgcctcactgacataagctcttcactaatttccctaatttgtcttacccctttccaattcatgctgctacctgagtgagtttaaaaaacaaacctgatcccatcactgtcttgcttaaaattcttaaaagtagtgattcttaatcatgtgtgaaagacagagagtgcagtgaactcacttgatacaaaatctatgaactgtcttcccagaaaaatgctttaacatactaagttttgaagtttggatataatttctggtagttcacagattccttgatgtcatctttggacccccaattaaaaaacgcttgctctaatggcctcccattatccccagcataaggtcaaactcttttacacagataagagaatccagataagcagaaagaaaagaggcatctattcataatccaactatctagagaaaaccattttctttttttaaagtaaataaaaatgaacttattaaaaaaaaccatttatcatttcacaacacatcaataaccaagtagaaaataaaaaaatatataaaagcctgggcaacatagtgagacctcatctctacaaaaaatataaaaattagctaggcatgatggcacacacctgtagtcccagctactctggaggctgaggcaggaggatcatttgagcccagggttcaaggtggcagtgagccattattacacctgtgaatagccactgcactccagcttgggcaacatagtgagactcccatctcaaaaaaaaaaaaaaaaaaagacaaggaactaataattaggatatacaaggacctcttggcaaatcaaaaaataatttttcaatttttccatggaaaaatggtcaaagattataaaaaagcaaatcacaggagcagaaactcagctggcttacaagtgtatgaagagatcttcaatctcaattagtaatcagaaatgtaaatcaaagcaaaaaaaaacattggcaaatatttttaaacattagatgataccagttgttggtgagaatatgggagaaacaggaacttctgtgtactgctaagggggaatgtaaactgttacagtaggacattagaagcaaccagtgtactcgtcactaggggaaaatggtctgtaaacatggtagatccatatcatggattatgctgcaagtaacagccacatggacagatctctaaggtcaccactgaaggaaaattaagaaaaagaataagatctataatagcctatatcatcttgtacttaaaaagcacatacataaagcagtactgtgtaacttaataaaaatatatacacatctaagatgtatctgatatatcggtgggtacaagagggtaagtggggtgcagagggagtgggaaaataactatgaaggggaaaggtactaaaatacaacgagaagggcctggcacagcccatatttgataatgtgctaagaagtcattagaaattttgaatgactgaattccctatacctgaggtccccctttaaaaagctcacccttcttatagacgaagaagcgaagacactaagttacaatgatataaattaagctaccaatgacaaagtgctcagtcaaccttctgccttgtgttgataacactaatctgccctagttatatctaaagaaaaatatactttcatacagatttcacagcttttcaacatccatatatctggaaagataagaacatttgtatatccttccatatgagtccttgtgattcgttgaggccataggttaagtttcctttcagtcattccaaggagaatcagcatgaccaagcaaagcaggttccaaaggcaggaagcagaagcaatatgatgctgtggaggtacctttctgaaacagtctcttctgctgttgtggggtctttgggcaacccttcaatttaagtgcttggcaacaagtctgctgagataggctgaccttgtagcttttgtagtctctatcgtacagcactggtcagatctacataagcctcatcgatgctgacgcattcaatcacagcaaaacaagacttcctccatcacttcaacactggcttcccggtacttggtgaggttagctttcccatggtactcacgaacttgtgccagtagaagacctggacttaacttctttgcatcatctgcctacatatagtgaccccaaatgcaagagcttcataactcactgcaattattctaccaccttccatgatttgtactacacagctgcacaagatttattcctcaaatgaggattttgccgctgctccattggaacaaagtctatgtccatgagagtaaccacacaatcctgtccagtagccatttttcaaggtaacagacacctggccagactgccagcagtgggtgccgcaaatgctgggctcggtgcccactggaaggaaaatggaagaagggcttttgaatatcttttcgcctttctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaatgtgttttctagctccttctctcactacgtcccagcttttgcaccttatgctttaacccaatacaactattttcttttttttttgttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagccaggatgatctcgatctcctgacctcgtgatccgcctgcctcagcctcccgaagtgctgggattacaggcatgagccaccacgcccggccaatacaactattttctatcctctgaaagagataggctgcctatcacagtattttgttaattgtctatatgtatacttcaatttttatttggctgaaggtgttgatggtatattaatttttgtatattgagagtttagagtctagcttagtggctgatatatagtacatattcagtaaatattaggctaaataagtgaattgcaaaattcatacatgtttgtgaaagaaaataagaaaggagaaagaacaaattacccatggtctcatcatccagatgcaccaactgctgacatttatatgtctactgtgatcttgtgtgtataaatttctactttctagagcttagcgccttcatagataatttagggaagagagtcattaccctttcccacttcacatagagattatgaatttagtgtatgcaaaattcctaataatgctgttaaatgatttggcctggagaatattaaccatactaaattttactgtgttgtgcatatgactggggctacttttacttgcctggtacgggaaaattgtgtatgtgtctgtttacccttctttccctagaacctcattttggagggttgaagaaattcttcatgtgattcaacttcatattcccccacaacttagctttttatgtgtaatccttcttaatactactatataagctaatctgtatttgtggaagagaatagttgatatactgatggtagttttcatcatagtgctttcctaaggagcagactgaagctcagagaggtttgtagcttactagactctaaactctagatagataaaaattagtacacagtgaacgccatcaagaaggtgtaagatttcagggctagtcagtggcaaaatcgagactagaatccaggtcttttgactccaactcttcagtagtttaatgttgttggcttgtctcttgggaagaactggcaaaggttaattgaaatgactggctctgacctttttttttaaaacagactcaacttctaatggaatttcattctaccttggatttctcctttttttctttcatttttccacgaaggctgtgtgtttattttttattctacttgcaagaaaagagttctgggtgacttaccccttgtaatgtttcctggttcccacccttctgtcttctactttgctcttgtctacttctcaaagggaaaacatttagtggtgaatgggaaagatgccaaatagtgaaaattttaattcatggatgtatggctgtgatgattactttagttcttttacctacctctaagaggaaattcattattgaaattgaggaagcccatatatgttttattttctcttggcttcattttatttttaaaatttatttttgcttcatttttaaaataacttcattttcaagcctcattgtctgaaggttgaggctttgagcaaaaaaacaacacatttagaaattctagtcctgaaaattgctgagaaattttaactgttctcataataaaataagtaaatgaaataatgcatatgataattagcttaatttagctatttcacaataaatgcatattttaaaacattttgtacatgataatatatacaatttttatgttaaaataaatgaatttttaaaatttctagatcttggttactaattctcttatcatttagccatttctgatggctgcttttgccctagattgcatttctctctgggagaaaaaaatcttaatttctttatgttcagcagcttaagggagattacaggcagagtctttggatttgattttcttctcttttgcaattaacttgacctcctcttgactttaagacaggctgttaaagccagcatgttgcttgaggcaagatgtttgatatacttttccttagcacacagatgctactggactgttagcatattgcacaaaacagaattaggtttataaaagaacaaattaaaaagttttcggggaagttttttttttatagtttacgacttctttaagagggaaagctcttgcatagttaattaaggattgtctagtaagttttgacagttgtaaacagaggcttataaagctctaacatacatgatagagaaaacgggttgttagacacaaaggtcttctgtgtacatggaaagctaatagctgtcaattctgagacaggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctggtccttgctctatagaagccaaaaagacccattccatacttctttaagtaattattatcatgaattgcctacagaattatctatatgatataaggtatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatttattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcacccagccaaatagtgccttgttctaagcagcattagtgtgaatcaacaaatcttaaaaattggccgataactttttaacacaatgtactaggaaggatagtcagggaataaagggcatgcctttattctcacctcaaacagaaactcagaaaaattgaatgtgtgaaaaatgatttagatttcatttagatgttttatatataatagtaaaggaaaaagtcatgatcttgttctgagagcttttctgcttcctatatccaagcaaactggaagctttagtatattttggaaccccattgttttctttcttatgagctgagtggttcttaggccctgtgagggttggggccagcagattaaaaacataggtataatcagaaagttccatataatatggcagtttcgtctttcaaacttcctcacccagcactgcagtacatctttgtacataatctgcttttactttctgaggacatgttcaacctgggtatgctttgtatattctaccaaaacttcagtgccaaagggtcagcagcagtcccactaatgggcacttcggtgaatcaggcattaagctgtatttctcatgttatcttagtggggcaaatctattcgaaaccgaccccacactgcagaatcctcggctttctaattggttgggtgacaggatatacaggcagtctgtgctacacaaagccttccagctgggctggctggtggcttgagttgtaatacttttttgacccttctggaaagaaatcagctttcataaagcaaggtgagtgaaagcacagagggcagctcttggaccactgaaatctgccggcctttcacagagccctagaaatgaaaatgaatagaaaagcccttctctttgtctttggttttattttataagagcacacttattacattaagccatcttgtattgcctggggtgctgctaaaaagagaaataacctgtaggtttatcatctgttggtatattttaggttggaagtgtgaatcctgctgaaaacttccgtgttctagtgaaacagaagaaggccagctttgaggaaggtgagtggttgactttgcatttaggagaagctgtttagttaagctaactaatttaaagtctagattaagaactgtagccttttgttgtaacactttagcatttttctttactggcggatctttgtggttttcccttgttagggagctcactgaggcaacattatgagcacatgaaagtgaactcagcacagattttctcaaaaggaactaatttgtaggtctccctacagaaaaactttgggccaacaccttggcgcttatagctccacttcattgaagttttttaggattttgtcgtgagctataaataaaacacttttatgtcacatcttcctattttattttcttccttttttttctttttttttttgagatggagtttctctcttgttgcccaggctggagtgcaatggcatgatttcagcacaccacaacctctgcctcccgagttgaagcgattctcctacctcagcctcccgagtagctgggattacaggcgtgcaccaccatgcccagctaattttgtttagacggggtttctccatgttggtcaggctggtcttgaactcctgacctcaggtgatctgccagcctcagcctcccaaagtgctgggataacaggtgtgagccatcgtgcccggccacatcttcctattttcagagacacataattcttgttccagtcctaagagtttgtggcccatttatagtagacctagaaagaccttgatgctgcccctaaatttaatccttctcaaaatggctgcatggtcacttttccttatcaggtagtacctagaatctcatttaggctgtggctaacataaaaatagctttcagggatgcacagagggcctggaactaacattcattcacttgattgcattcaggtttctgttcatttaccctttaaatggtggcaactggcagttgttaatcctgcaggtttatatataaactattatattcattattgctggtccaagtctggcctgtctgcgagctgacttctacgtatgtgagtgtttatgtttgttcatgtgtgtatagaactttctcttccaacatcctgcagggagcaggggaatcacttttttttttttagtgacagggtctcgctgtgtcacccaggctggagtgcagtggcaggatcatagctcactataacgttggacctctgggctcaagtgatcctcccacttcggcctcccaaagctctgagattacatgtgtaagtcaccatgcctggccaaaaattactttttttctttttcttttttttggggggacagaatcttgctctgttgcccaggctggagtgcagtggtgagatctcagcttactgcagccttcaccctggcctcctgagtagctggaactacagttgcatacccccacgcccggctaatttttgtatttttagcacagacggggtttcgttatgttggccaggctggtcttgaactcttgacctcaagtgatctgcccaccttggtctcccaaagtgctgggattactgtgagccacggtggcatgagccaccgtgcccggcccaaaaatgagagttaaatgcctagaagcactactgcctgcagtaggtctaatgcatcttactacttgcagtctaggaatcctggcaagatccccagatctactgtgctgttgtccagaggcaagcatgagcagctgagcctcagagagagcttacagtctaccaggcttaaatcctgtcagcaggaatgccaaaggccaaaccatgagaatctccagaggaagaacagcttcgttatcacagtaatctgcagtctcttaagtggggtgtatatgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctgctgtgacaagtcaatgaactcttgtctatcaagactattgtgtttttgaaggaaaattgagactttcctagctttcaattgtatgtcgtcaattacctcagccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctccaccccgccaagtacctggagctacaggcacacactaccacaccaggctaatttttgtagtttttgtagagatgaggtttcgccatgttatccaggctggtcctgaactcctgagttcaagcgatctgcctgccttggcctcccaaagtgctgggattacaggtgtgagccaccaagtccagctcagaaaaaattttgaccacagctgtatatataataatcatctatcagttatgaaagtagggttgtttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctttttgcctttgttcttcaaccttctttaatctcacttactagaaacatcctttcatttttaaaagatatttcctaaaattcactttttccaagcaatttcagcactagatagaatatggtacaattagtaataatatgatattcatcaaagccaaatagttttcagtgttggttttgtatggtatagcactatcccatttgcatagctgtttacttacatacattatgtgattttctgccaggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcactaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttatctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaaagcacatgacgtagaaactaaagaccattatgcacacataatcattttaagtattttcatttttcagcgactcttcctaaaaggctttcatctattcttacccagcctttaaaatccttttaagttcctgtcaatctgtatcagaatatccctaattacaggatatagctcttgtaaaatgtagcctggctatccattaagaaagagaaatgtgtggtagcataaaaatgaaagcatgtttgctgtagttacattctgttaactgaaaaaaatcacaagatctataaatttagaaaaagagagctttatttcttataaagggttacagcttgcaaggtggaaatagcaaggccaagtggaccctagatcgcatataagttacagtaagtattattatccccattctactgatagataaactaaaattggaggagatacattttccccaaagatcacataggaattcaaacgcatgtctctttcaaatactggattttttacttagccatactgtttcttttgattcctaatgccttcttttcctacactttttaaaacaacattatagggtcacatatctgaaaccttgtgcctgttgataggacttttgatgaaagcctgggaaaggctattcctagtctattcaaaggctgggaaacatggcctccagccaaagcccagagacaggcactatgaaggagggtttggggtaagagcattattgctgacctgattgactaaacatacatattcagcaggttacaggaggagctatgaatattcatgaaggtggtcctgatgcatgagtattaaacatgcatgttacgtaatacccatgttcaccttgcagggaagacttgacatttaaatattacagttagaccctgtacatcaaaaggtcttttcaggacacagcatgcaaatgtgccatctttgtaaaacccactagaaccagtccgtggttggtggtcttcttatcaggagaaagttaccgaaatcactctcttgtccaatcaaagctgtagttatggctggtggaacaagagttcagtaagtcagcatctggtagagctgcaaattgttttaaaaacaatattgcttatcccaaggccagtgcttttttagctgcttaagaaaaagaaaaaccttttggcagttagaacatagtttattctttaagtttagggggtgcgacttaacccttgcctggcatggccttaggtcctgtttactacagtttgttctctcagtcttatgatacctattttaaaattaatgctggaaggttgtgtctaaattgcaaaaaggaggggtataatgaaatgcacctggccgggcgcagtggctcatggctataatcccagcactttgggaggctgaggtgggcagatcaggaggtcaagagattgagaccatcctgggcaacatggtgaaactaaaaaaaaaaaaaacaaacttaggtgggcatggtggtgcgcacctgtagtctcagctacttgggaggctgaggcaggaaaattgcttgaacccgggaggcggaggttgcagtgagctgaaatcgtgccactgcactccagcctggcgacagagcaagactgtgtctcaaaaaaaaaaaaaaaaaaaaaaaaaaagatgcacttgaccccttgtcgtgtcatgaccaaaaactcagttaaggttttctgggatcccctttgtcaagagggggtccatttcatcagtggggagcttaggatttctagtttacatttctcagtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccagtcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttagaattcacccttgcagtaagtgctaatgagtatgatttgtgagacagagagcagttcaaggatttactcatggcaatttggttctttctttccacctcctgttaaattctgcagttcttccttccatggtaggtcattgtcatgtcatgtagggtattgtacttggttctccttgaattgggctgtcttcaagattgctccttaagcccagctggttgaaaaaggaaaccggtttcagattgtgctgatgtgcaaactgctttaatcaatgacttgaagtgactgctggtggcaaacaacagacgctcttaaccaattaagatatttaggaaaggatgttaggcttttgttaaaatagtcactaatgaactgaaatgtgttaagaggagccaagaaacagctaggagttccacttaaatgcaataaaagtgtttgggtcctcccctttcaaattgcatgcccaaggcaaaaaatatgctgacacagaaagaagtggcaagtgtaatttggtacagttagcctgtcagatccatgcgtgtctacataaaacctagaaaaatgtcgtgcttgcttctttggccagaaaagggaagggagtttaattcctttatagaacagtttcagcagggctggagaatattaccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaatagtgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtaaaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagctagcaatgcagtggagtgtctggtggaaaggaggagagtaaaggttgttatttcataactaaaaagttaatacaaagggcctcagaaggaaaagtttaagaaaaaaagactaaaaaatagaatactcggatacactccaactttgttcttttctaaaaatgttttaactactctatgtcatttgcgtttccatggaaactttagcatcagcttttcttttctttttttttttttttttgagacaaagtctcactctgtcacccaggctggagcacagtggtgcgatcctagctcactgtagcctccacctcccgggttcaagtgattctcgtgcctcagcctcctgagtagctgggattacaggcatgaggtactacgcctggctcatgtttgtatttttttaatagagacagggtttcgccatgttgaccaggctggttgaactcctgacctgaggtgatcaacctgccttggcctccaagttttgggattacatgcgtgagctgccgtgcctggcccagcttttcaatttatatgaaaaacccactggtattttgatagggattttattgagtctatagaagagttaagggaaaattgccattttaataatactgagttatccatgaacatggaatagttactcatttatttagatcttattttttctccataatgttttatagtttttagtgtacaagctatacagctcttttattaaatttattgccaagtattctttttgatgatgttgtgagtggaattgttttttaattttatttttggattatttgttgctggtatatagaaatgaaattatttatttattatatcttgcaaccttattaaacttattagttcttgtggttttttaaatatacttcttaggattctctacatacaggatcatattgtctgcaaataaagaaagctttacttcttcttttataacttgtaagtttttctttctttttttttaattattgtactggctggaacttctggcacagtgttgaatagaaataagagtgaacatccttgccctgttcctgatcttaaggaaaaacctttgtctttcactattagtatgatgttagttgtaagttttacccagatttcctttgtcagcttgagaaagtttccttctatttctaattggttgaaagtttttattatgaatggatgttgagttttgttagatgcattttctgcctctattgagatgactgtgatttttattcttctgctaatatattaattgacttatagttgttaaatcaaccttgcattccaagtataaaatccagtcgttctataaaatcctttttatatgtactgaattcatttagctaatgctacagtttgaataatgtcacccaaagtttatgtgttggaaacttaatccccattctaacggtgttgagaggtgggacctttaagaagtaattaggtcatggaggcatcattctcatgaaaggattcaggccattatcacttgagtgggttagttataaaaaggatgagttcggcctgatttcttctctgtctctggcttgcttctgccttctgatgtggggtggtctcctccagctgccggtgtcatgctcttagacttcccagcctccagaactgtgagctaaataaatatctgttctttataaattacccagtcttgggtattctgttatagcagcacaaaatacactaagacagctaatattttgttgggaaattgtttgtagttttcttgttttgtgtgatgtctttggttttggtaacaggaaaatactggactcatagaatgagttaggaagtttccttctcttcaagatttctattatttattctttacatatttcatataatttaccagtgaagccatctgagttctttgtggggagcttttgttttgttttgttttttgaattttgagattgtttcatttgaaggtcaccttaatgctcttaaattcaaaaatatgctaatttaaataccaaatcctattaatctaaaacacacattgcaaacatacaaatatctcttctcttcacatgtcagtgcccattcatgtcatggtttggaaatggggacagtagattccccttgagctgcaagtcagcatatgtttctttatagttaactttagcaaaatttatacaaaatagtaattaacaataatcttctttatttgttaactcaaaagaaaataccttcaaaactgcattttaagtttctgtactaaaatacagaaaaactacacaaatattgaaaagttgaaagttctttaatttttttattcctgttatcactaccacaatttacagggcaatatacttgatgtaatgaaaaagaaacagacaaagctacaacagataaaagagctcaggaatgtacgtctaatcgacactatattgcattcattaatagctgcacttttgcaaactgtggctatgatagtcctgcacaagaagggttttctgtttaagctgcaataacttttctgaccatggatcaccattccttctgtggcagatttttacagttcctctaatgcatttgggatgactatctcaaataacctgcaacttttgtgacaactccttgttctttctcctgctaagaattgtagcccctctctgctgtttttagaaccttctgctaccatatccgtcacgtctaccgccagatccgtaaccaccaccaccacaggaactccccgagcttcttccaccaaaactgcaccctttaatgggttcataatttgattgtttttgtctgctaaaatttccagaatcattatagttcccaccaccaccatagttaccactgccagaatttcctccttcattgtaaccatcatatccttcaccactatccccatacccgccattgtggttttcatatcctggttcaccatctccatagcccccactactgctgtaggcaggcccaccaccattgttgcccaccgtcacctccacatccattatatccaccattacaccctccataaccacctctgctgccaccacctctacttctaccaccagagcctcctcttccaccaaagtttccaccacagccaaaattacttgcaccacttccagagtttcctccacaacccataaagttgtcagatccacctccatcacctctgtgatcctgcagactgcatctcttgtttagaaagggcctttttcactttacagttgtgcttgttaatagtgtggtgtttctaaacaacagttttatcaattgtatcatgatcatcaaaagttaaaagtgcacattctctctttttccactctgtcatccataacttgtatggtttcagtcttgctatagttttcagagtaatttctgaaactgtatctactttaataccaccagcaaaaatgttcttcactgttaggtgggcaccaggctttacagaatcctctctagaaacaactgtctttggttccactccacacccatcaaccttgtgtggtcaagcacacattgctgtgtccacctcttcaacacaagagaaagccataaaaccaaagcccctggaatgtttgcttggggttctgtcattaccacacaatctgtgagtgtgccccctttctcaaaatgttctcttaacccatcatctgtagttttaaagctcagaccaccaataaacaattttctcagccgcgctggattcctttggatcatggccttcctcctcttggcggcagtggcaatgacaacggccagagtcagcctaggggcaaccgggtagtggttttacctccattttaagactagacttgcctcctccaactcaagttcaacatggaactgtgaggaagaggctgtgggaagctttttaatactaattcaatttttttcttttttttggatacggggtctcactctgttgcccaggctggagtgtagtggtgtgatcttgactcactgcaacctctgtctcccgggttcaagccattctcctgcctcagcctcccaagcagctgggatgacaggcgcccgccaccacacccggcaaacttttgtatttttagtggagacgggatttcaccatattggctaggttggtctcgaactcctgacctcaagtgatccacccaccttggcctcccaaagtgctgggattacaggcgtgagccactgcaccgggcccaatttttaagctaataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttgtttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatgtgtttctgaatcctctgcttcgagggaaaaatcatattagtagaggataagtttactcagtactggaaaaattgtgtagattttaggaacttgttggagcagaaaggcgattaattgtgagaaatgaaagtcaattttagtggcagcaggtatatcaagtacatcaagtcttagttcaatgtttatagattttgaaaatttataggttcattattcctttcatttgtttcttcttttgtcccatttttgtcaagcatgtatttattttgtttgaatccttttttgtctcatggactgagaagaaaatataactaaggttggattatcccacaatttgctctgtgtctaattattctgaggtggattgtaatgaagccagcaagacttatacattggaattttaaatgtatgggattgtaaggagggtagaagctacaaaccaaagataagatatgcctgcagatctgcttcagatttcctgagggcagtagatgaaattatttctaagggcctttttcaccactgctctttaagtatatgagtaataaacaaaaagaacaaagtatgtggttcagaaggaataaaacaaaaaagaaagaaaaggatcaatgaaatagaagtattgtgtcaccccatgaaaattgtcttcctgttgagagctcactagaaatagaaacaattgttttttatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggaggggataaaagagagttctagactgtctactcccctaagtggcagccagtgctaaatacacagcttatgggtttaaactgaacgaacaacaaaaagacatgttcattccttaggcttttagaggaataaaccagtgaggcctacaccatttattcatccattcaacaattatttgttgaatgcctactgtgtgccagtcataccaagatacagacagtaaacaaataagaaaatatatgtcaaatggtgataagcatttgtgttagtgtcctagtgctgcagtaatggagttccacaaactgagtgccttaaagcagtggaagtttatccttgcagttctggagactaaagtccaaaatcacaggactgcttccttctgagaggtatgggggagaatctgttcaatgctctcttgtagcctttggtgacagctggcaattcttgcatcccttgacttgtagatccattactgtaatctctccttctctcttaacaggggagttcttgtatgtctgtatccaagtttgcctcttcttataaggatgtcagtcctattggattagggcctttcctagtgacctcatcttaatttgatcacacatctgcaaggactctctttccaagtaaggtcacgttgtgaggttttggtaaggacaggaatgtgggggcggggtggggatactattcagcccatgacagcactatagagaaaagttaaagcaggatagtgggatagggaatgctgggttgagatgggcttataattttatgtagaggatcagggaagtcctcactgttgaactgagaattgaggatagtgagagagagaacctagtggatatctgggaggagagctttgcagacagagggagcagcatgttcttgagaagctcaagatgactatgcttggctagaagcatcagggaggtccgtgtgactggagcaaagaaagtaggagctgagaagtcagagagctggctggggtacatatcacataaggcctcctagaccttttgcttttctctgagtgaaatgtgaaaccattgaagagtttgaagtagcgaatgatctggttttatatttcataccatgttgaggaaaagggcaaggttgaggtaggcagatgagttagaaggcttcggcgttaatccacgtgaccggaggtagtaagaagaggtccgatttttgatctgttttgaaagtagaattgtcaagttttgctgatcatttgaatgtagagtgtgtgagagagaaaaagtttaaaaataactcccaagatttttagtctgagcaactggacgaattgccatttgctgagaaggagaagatggtcatgcaggtctggacttcaggaaaaaggtctgagttgtatgtataaatcgtggagaaggagccatagagactttaagacatgagactggaagagatccttgagtaacggagaggcatgggatctagggcacaggtggaaggggtaacttagataacacacagacagttcagcaaaggcaataggatggaaggcagactatatgggtgcagatgcaggtaggtgactactttgaagaagaattcgtggaggggccgggtacagtggttcacgcctgtaatcccagcactttgggaggccaaggcgggtggatcacttgaagccaggaattcaagaccagcctagccaacatggcaaaaccccatctctactaaaaatacaaaaatcagtcgtgcatgatggcttgggcctgtagtcccagctactcaggaggctgaggcacaagaattgcttgaacctgggaggcgggaggttgcagtgagctgtgatcatgccagtgcactccagcctgggcaacagagcaagactctgtcttaaaaagaattcctggaggaggttggcataacctggtccattatggtaaaggtggataggagagggcccaaagaagggcattctaaggaaggcaaccacctaagtgatggcgtgtcctgatgttattaatgggactttctccagaaataagcagtgttgttaactgttgttttgccccttgagtatctttttttttttttttccgagatggagtttcgctgtcgttgcccgggctggagtgcaatggcgcgatctcggctcactgcaacctctacttcccaggttcaaacaattctcctgtctcagccttcctgagtagctgggattacaggcatgcaccaccacacccagctaattttgtatttttagtagagacggggtttctctgtattggtcaggctggtctcgaactcccgacctcagatcatccacccgcctcggcctcccaaagtgctgggaatacaggcacgaaccactgcgcccggccttgagtttcttcattggcatttctgacaactttgtatccatttctcttctgctttctaatcatcttctaatttacttctcaggtctgtcttttcctttccatcttatcactatccgaattcaggctttcattattttatcattggacagttccagcatccttcattaataaccttcaaagttctccttcattcctgcccatatgtttgtacagatttaagttcttatagcacagattttattctgggtcagcccttattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactattatcttacatttttcctttcccctactgctcatttggaatggaatcaagcatggtgataaggttcttaattcttctctatcaattttagtaagcattggcaagttttagaattctaggaccttggaaaattgtggagaccctcttcctctgccctccctagtcttcaccccccaccacaacacattctttcaggcatatggcatatatatttcctaaaaagctgaaagatatcatttcctcatttaattagaaagtcttcctttagtttctttcttatgttagcataatgtctcaatattctactttaagtgtactccgttgtagaattggggaaaattagttacactaggcagtgcatgttctttggtctttagttaactgctgtatgccctataaatattaattgatgaccttcaggctttatgggatatgtttagtggttttttaatggttaaactgaatatttttaataaaaaattacaagaccatagaatgccacagaaccattccacttaccaggaaacttaaaatttgccagctgacctgggaacagatctggtcatatacccaagctatttaagaagaggaatattattcatcagaataaaaatgttatatcataatgctctcttacataaaatgagcttacagccagtgggctaactggatatcatttttctggtttcttgttagctcccactaccatatttgttacacagagtgaactaaggccaagagaccttccatatcattcttcctgtggctacaaactaggattcacagctagctcaaataaaaacagaaataaaaggagagagatctcatagtctgcaggaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataataataataatttaaaaatacaggactgcatctgtgtgttgaggtggtcagcactttgcatatcttagtccaatttcctgtgccactggtcatgcataatattatggctgtggtgttctctctgtcgtatctactgatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgacaaatttcaatgtcattttcaggttactcaagcttatgcttttttcctagttctctgtttcttttgttgccatccagtgatttatttttcctcaataagaatatttcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtgaaaacaatatttttttacataatttgttttttatagaaatacagcttttatcaaatgtctgggagaagctttaaatatgcttttgaacttcttcagtaacttttaattgaatttcattgtatcctacctcactagaaagaaagaaacctgcaaattttagcttcccttataatttaaatgatgccttgctaatttctgtgtttttgagatggagtctcaccctgtcacccaggctggagtgcagtggtgagatcttggcccactgcaacttctgcctcccaggctcagatgattctcctgcctccgcctcagcctcctgagtagctgggattacaggcatatgctaccacacccagctaacttttgtatttttagtagacggggtttcgccatattggccaggctggtcttgaactcctgacctcaggtgatccgcccgtctcggcctcccaaagtgctgtgattacaggcttgagccgctgggcccagcctgatgccttgcatttctgtctcctggaaatatccaattcttaaaagaggccatccccttgtgagttcataacacactgtgcccttagatcccctcctcaccctcccttcttctgtatgccctgcatctgagggaggtgtgggcagagctggctcttgtaggttgcatttcccaggctcctgtgtctaaagacttcctactgggttcggcatgagagatactggtgggaagtagggagggagaaaccggtgtatctcttcttccctttctatgttgggtagcatctttggtcctcagtgtcttcagctcccataggacagatccctgaactctatttatacccttttctttttcctgagtaccaagggatgctaagggtttcttgctgttaccaatcccggggttacagcaccattctcagttggctttaacacacttcgtaacctgcaaaacaatttcctgtcttaagtctcctgtgttaaatatttggagtggtttatattccttgtgttggtccctgactgatacacacaccgcctctacccacaatggccaatttatatccgatagtaaagaggcataaagaaagcccgcttttgatacgtttcttaaattgcctctgttaaaacagactttcttatcaggcaaatatcttttataagtttctggcttaaacaatgattataatttacaggtggatttaatttatggtagactggactgcttgcctagacttttatttgctgatgggcattactcctttttattctcttaataatgaattacctgaccttatacttattttgatttaagtgcttgatttttattgtcacttttaattttgtgttataaagatgcaattgtcattggctacataaatttgtttttttcttttctttttcttttttttttttgagatggaatctcactctgttgcccaggttggagtgcagtggcatgatctcggctcactgcaccctccacctcctgggttcaagtggtttctggctaatttttgtatttttagtagagacagggtttcacaatgttggccaggctggtctcgaactcctgacctcaagtgatccgtcctccttggcctcccaaagtgctagggttacaggcgtgagccattgcgactggccataaatttgttcttaacatttaaaatttatttaactgctgacatttgcaaaatgtacagcatttcaataagtaacatttacatgaggcattgagaaagtgagaagaattaaattgggaaatatcctaaatgatggctgagttcagccaaatcatttgaggtgtcttcacagtcttttatatataatgtgtgacagatgagggaacctactgctttttgggctctgtcagatggaggagaaaatcccacaataaatgacttcctttcactttgttggaaacatctttgcaaagaacagaggtagtgagtaaatgtaaagtcagaggcagacatgcacatggccctgggtgttttgaccttggtgactgtgcaatgagaggggaggtgtagtccattttataggactttgggtggtgttgaatgtattcagtagagaagcagaatgtgtatttcagattaaacaagaaaacttcgccattttcctcttctgtaacatttctaaatctggataacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggggctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgttaaatggttcgttatagtcagtgaaccacaaaagtagtctgggtagagggacagaatttagaatcatggaccagatttacaagccacgtaactgagtattcctagaaggccaaaatctggttgtttgtattctttgggtttattggaagtttggatatgtttatccatctgtgtttctgaaccctctggaggaaagagcacaacagtctaacatgtaaataagaaaaactaaatccacataggcccacagatacattaggacttcatttttttttttacaaagaaactgggtattgagactcctgctacttccttttacaaagaatttatggtagactggactgccttctttcctgtatcgttgcaaatggattgttggcttgggtatttatttttgtttcttttgaatatttttctctgtaagatagcaactgtgtgtgtgtgtgtgtgtgtgtgtgtgtgtgtgtgtgtgtgtgtgtgtgtgtgttctatcatatttcaggataaaatgagtcaggaagctggttgttttggttttttgttttgctttgttttttcgcaaagcaatttagtacctgtgtagttgtttcatgggctcccagnnnnnnnnnnnnnnnnnnnntactcttttccgtgtagtctttatgcagtagtttggacacagcagacaactctttcctttaaataatctcttctcttagtatctgtgatgccatgaactcctgacacacacacacacacacacacacacacacacacactctctctctctctctctctctctctctctctctctctctccccgtctccctgtctctccctctctctctctctgactaatccttcttagcctccttcttcagctccctttccactatccaaccgctaaaatttcttctttcttctacactttctaaggagccacgctgtacccctacctcaggactctcacacacactttctcttcttggaactccctttcctccagccatttgctgtctaatcctcactcttttttcttcccctatttctgtccatgtatgaggccatttgcttttctccaaacacagcttgtgctttcttcttcatacttaggctaattgtgtttcctgctgtgtaattgccaaattctgtttttcattgcctagctaaaaagccatgttgatttgtgaagctttctgtaatcaccaaagattttttaaaaattcaaaccaattaatatatttccttaaaactcatagccctcttcacattatttcccagtgttaattttatgtatatgcattatattccctattcaactgcaaactcctcaaaggcaagggccttgtcttcaacttaattctgtctcccacagaacataacatagtatcttctacatagtagttgcacaataagtatatactatcaaacaaagagaaacatttatattatagcttcctaagatttcctattctcatttcaaaagaaatggagaatttagagtctctaggattattgcccttggcctgtaaaggtttttatttgtgcccaaatatgtaacctcgagtgaactttgtatcagatgatctgggaaagtacaccgctttctgttatcaaacatttctgttactttgcttttcaagctgaaaaggggagataacttctgtttgctttgagcttttgttgatggttttctgctctgcctactaatcagggttgtattatttaccttgtttaaaaaggttcatctgaacattctctctctattttgaattgtaattggatattaattcactgctgcgggatacgttggtaaagatttttgaaattgcagggaaatgtttctttaatccctcaagtttgttaagtgctttcttataatggagatcataatctccgagttggtagaagggatgaaacggttactggggatatttttcccttgttagaaaattgctgtattaaaaaatacttcatccagttttttaatcctttccacatgctgtatggtccttaggaaataagtagattcttagcaccgatttcatgtttttaataaggaaggcattgagtaatgttcaggtcactgtgattcacagagttagtggcctggggcctttattggtaaagcttgaaagtagttttctttagcattgtgcatacacaggtagctgctagaatgctcacaggaggctgtgatttggggaaacaggcagtcatagaatatcttgaacattcagcataaattgccaaacagccacagctagtgaatggtttcaggggacaagggagaggagcctttaggcatgattacccacatctccctgatttgttcttccacacacagatcttaagggtcagttttgatctgcacagcattaagtttcctcatgacttttagatttcctttttcctctgctttttattcatactgaagaattttttgtttctttgtaaggtgtaatctactttggaaatgataacactatgaatgcattttctctttctgtagcatttatgacattgcttgctgacagttactgtttattaagtatttgtggcttttggagtagtgagcaatagggagaatattcaggtccagctaagggcataaggtagatagcaatgatttctcattcgaaagggatattttgttaagactagggctgatcttttctaatttaaccttggattggtagaagatggggtgtccctggctcattatttttcactgcccagcactgttcgacaattatcctgagtagaattaggggagggactagaggatctgttttctgtgaatacaataggaaaggcagttttgaattatccaaatggcccctaaattctgggggaaaataaaataacaacaacagcagttttaaaaataactacaacctaggttctgacatcccaaaaaggaatatttcaactataattctcagcattttagaaattaatttcttgacaaatatcaataggtatcattcagactttgcaaatacagagttttgaaatcagaattttgcatctcatctctcccctaaaagaagtatggcaattgtgcttgctgaccatgaggcttgtgaactataatacatacttataggcacaaacacagaagcataccctctctcaggcatcactcaaatctaagaaaatttgttgtcttatgttttagcgagtaaccagctcataaatcacatcgaacagtttttggatactaatgaaacaccgtattttatgaagagcatagactgcatccgagccttccgggaagaagccattaaggtaatgctatcctagcatctcttttcttcctaaacagttggcgactatcacagggaaagaggcatacagcatcctggaaatgagtctgggccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttataacacctctgtgcatggttgccacccagtgtccttaaaaatactaggtcacattatatctcttaaaaaaaataaaagagagacaagagaagcagaagagacttcagtgacatatcattcagtcttaatggagagattattattttttcttttccttttttttttttcttgagacggactttcactcttgtcgcccaggctggagtgcagtggcggatctcggctcactgcaacctctgcctcccaggctcaagcgattctcctgcctcagcctcccgagtagctggcattacaggcgcatgccaccacgcccagctaatttttgtatttttagtaaagatggggtttcaccatgttggccaggctggtctcgaactcctgaccacaggttattcgcccaccttggcctcccagagtgctgggattacaggggtgagccactgcgcctggccaagggatattttttgaactgtaaaaagattaagttttatggaacaattaggaaaatgagaatactggctagttatttggttctattaagaagttactaattttttatgtggtgttaatggcatgtgagtgtttgttttaaaagactatattttctatatttcatacaagaatattcataaatgaaataatttgactgaaatttgcttcaatataattggagggttatgggagaagaaggtcatagtatagaggaagcaaaattggtttggttgataattatttctttattttattttttatctttgagaaggagttttactcttgtttcccaggctggagtgcagtggcatgatctcggctcactgcaacctccgcctcccgggttcaagcaattctcctgcctcagccttccaagtagctgggaatacatgcgcctgccaccgcatccagctaatttttgtatttttagtagagatggacccatgttggccaggctgatctcgaactcctgacctcaggtgatctgcccagctcagcctcccaaagtgctgggattacaggcatgagtcaacatgctcggcctgagttgataattattgaagctgggttatgagtgtgcgagcactcactaaattgttctctgtttttgtttgggattttctacattaaatgttaaaaacaaagggctaggccaccgcagaaaaactgactctgggaagctctgtgccttccacagatggaaggatttctggtccccagtgaacacacctcagtttggaatgccagcttcccatgtaccaaagaagaacattttatttttttgtaataaataaggtgattcagaccaaactttgtttggtctggggtgaatttgtttttgtgtttgctctgacttgctgcctcctctaccccaacttgctaccacagttttcagaagagcagcgctttaacaacttcctgaaagcccttcaagagaaagtggaaattaaacaattaaatcatttctgggaaattgttgtccagggtaagttgtcatttgcctttttttttaaaaagtatttttaaaatacttatgctattttattctaaatatacatataaattctaaatataaactgtattgtataatgagttatgtgggaaacatgatgactttctacatggctttgggaaatgctcagtgttcggtgaactcaaactctcccttaataagcataaatacagagtgataaataataaataaacatgtaagttccatcttagactctttacgcagcatgacctatttcatggctgtgcctttctgtttgttgaatggagcagctgtgtgggcgaacattgtcccctttctcagatccttaggccatttcagtcctgctggttccacagccctttggttgacctcacccagattttatctccctgctacttttcatttaccatgttcttggactttccgtttcaacagaccagcatcttcatgtaccaaaaccattcagttcttcacttgcacagcaaccaatgcaagttaaacccagaaagaagacagcacacattctttcagtgttaggcttgatctttgctttttttcatgccctttgccccaccttttttaaaacatgacctgattttcttttagaacccaagtataagatattacttgtttaaaatacatattatgaaaatgattatgtttatgagataaacttttcacttatactagagatgcaaaatttgtttcaatctctttctgtgcgaattctatataaaaagaattgcatacctatctatccgccttctaatgggcaactcttcatcacacaggtaactgttttcctgacagttaatttttcagccctttaacttctgcactggagaacaaaaggaattggaatgggtagtgaagggggcttactcaaatcacttttgtgtctctgctgttgaccccgtaaatgaaggagattggttttggtatttattgaatgcctatagcgtattatttgctgaaaagaaacttacaggtcatatgcaaaatccatattttctgatagcttatatgccactgagagaatacagatgaccaaggccattcataggtacacatgggtgttaaatacatgtgctttttgaacagtttatcaggtatcagccatttgatgtaggaaaataggaagaagagcaaactaaagagtagattttctacccttgatttgctcttactgagctaaaattgattaactgtcctaaatgatagacatgccccttggtgaagaccatgttttcttcctccctagtcctctggccactctatcaatagccagtaacatggccacaagacaaaatgcatggcgtagttccatattgggcaccggatgtcttggacaaaagcatacagtcatttaattatcatttatttattgagcttctgctatgttctacagtaagtcctctcttaacgtccataggttcttgaaaattgtgactttaagcaaaatgacacataatgaaaccatttttttctcatcagtgttataatgaaacaatattatttaagtacctacttttgtttcacttaaagtcacagtttccaacaacctattgatgatagttaagtaaggacatactgtacattgaggggaatataaagacttataagacttagtgtctgcccttgagaaaatatattcttaggagagagaacatgtgtacaaatagttacataaaatacgacaagagccatttcaaaggaataaacaaagtgatctgagatttctaaagaaggggagacttatctagagttgatcaaggaaggcttcatggaacacgtggcatttgacatgcggcctttattgcttattacacaggcaaaaactggagaaaagataatttaagatggtcattgttaattggttgcctttatagttttatattttttgtagaacagagcacctttatagttttaaaaatctccagctcaggctgggcacagtggcacatgcttgtaatcccagcactttgggaggccgagacgggaggatcacttgagcccaggagtctgagaccagcctgggcaacatagtgggaccctgtctctatttaaaaaaaagaaatcttcagctcaaaggtgggaggaggtgtgatggaaacgaaaatgggattggggttgattctttgtgttttgattttactctctgaattactttttagatggaattactctgatcaccaaagaggaagcctctggaagttctgtcacagctgaggaagccaaaaaggtattgaggggtaaacctttgtctttagttgaattattatagtggactttattttcttgataccctcgaagaagttaaattttatgggtaactaaattagtgtactcattttgtattcaatatgtaaattgcttcaaccacagcatccccatgggagaaattataatcttactcagtttcctgtaggctgtggttatatttctggaactcacctgtaatcccagcttcagtacccctagagcatgctgttgaaccccatagtgcgcaaacttagcctcggccctggtaaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagccatgagtcagatacatgtggttatttagttcagtagtccttcattgtacctcaaggttgtgatgaaattttaatgaattaagttgaatagctcaaaagtatatacttcgtaacactcagtttcagttacagtcactgactgatgtagttctgctggcacctgacagctctcagttactaagcttctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctgtttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactagagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttagttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagagtgtgcttccagtactaccagcaaaactgaacttcactgtcatggcagataagaagttaggaaattcaacataaaatgtattgagtaccaccagctctatgccaggcactttgatatatattatctcatagcctccaaaaaaagtacattgcacattcacctagcagactctttcacatctagaaaatgccatttcctttttttccccacatttatcagtgctttagccaatgtagtatgtataccagatatttagataacactttgactgctaaagaaccattcacattgtatggtgtttgtctacaacactatatacatcatatctagataatggtagaaaataagagtagtagaattttacttgtatccaactcccgaaccaaagagcccagtattatctctgtaatcttcacaatgatctgctaagaattggcaagagcaggaactaccatccctgttaccactgggaagccaatccccagaaaggtaaagtggggttacactttgagctcaccgaggtagcaagaggattaaaatgcacgttcctttgcaccacaccagaccttcgttttcaagtggattaagttttgtgaatggaatcttggaccaatcatttctaaaatacagtactccctgtctgcttcatctcaacaaatgactttctggcctagagccaggtggtggttagaataacctggaaagtcatagagtagaccctgtaattttgactcaccttcagtgtacgctgtgttatatctgtcagttctcattagtatagtggtgagtacccccacctgtcactgtatcatgcctgactgtgagattatgcttttgtgtctgctttaatatcacatgaaccctttattttgttttccagagtgaaaacttgatcctttgtatgaaaaatgcttttatttatttatttatttatttatttatttatttatttagagacagagtctccctctgttgcccaagctggagtgtagtggcacggtctcagctcactgcaacctctgcctcccaggttcaagcagttgtgcctcagcctcccgagtagctgggattacaagtgcgcaccaccccacccagctaatttttgtatttttagtagagatggggttttaccatgttggcaaggctgttctcaaactcctgacctcaagtggtccgcccaccttggcttcccaaagtgctgggattgcaggcgtgtaatcccagccatgcctggcctgaaaatgcttttaaatggcatctgttgatttttggagagaagtgtagaagggagagtgtacatgtaaatgataatggggagaattgcagaggaagattctggctcaaggaagctgatttcttttggttttaatagaagagacatgctttagctatttctcttagccaagtgagagaagtattatcacttttgaccatgcactgaaatattcatttatattgccttcaaatgttcaatttggtcacttcccaaataatcatttaaggaaacttgactataatcactgaggttaaagaacaatcctcacagtctatttaaattcttttgaggtgtttcccataagttatttaaagttagcaagctgtcaaattcttgctattaaatgttgacatttgaaaggaaataattatccagggatgttcattttaaatgaaaattataactttacatttgtataacatcttaagagctattaccctccagtttttctagaaatatgtggattgtatgattctttgagaaatagaaggaagtcagctctgctacagaaatagaaagtttttgcatggcgtgagtttagacagtcactttcttttaagtttcctggtacctctcatttcattttgaaacctaggcataaatcattctttaatgttcatttttattatcattataacctgtcagttcttccactttttctgtttctagtttatatgattagatatgccattagcatttgatgtttggtagaatctttgtatagcctttgtgtgctcttcatctatcagttctcctggctctgtagtgggtggaagaggtaaagtgatgtgtctgagagctcacagtaagtcaccggccaggaatctagttctagcactgccctagtccttcattctcctttagtattgagaaagcagtgaagaaagaggatttatccccatggcattgggatcttttttttttttttttttttttttttaccagattccaagaggctgagctatatctaaataatcatttgatgtaagctctgtgaaaaaaaaatcattattttagcacttatttttcttgtaactgcctaatttatccttctttattgttgttgacatttatggattttccaccttagtatcacagacattcatagatagcaattggccattttaccaattggtgttggccattttaccaacacccctgtctagagaggtaaagttttctgtgcctcacagcaagctagtggccagcagaattgactggaatccagacccccagatgcccgctgtagtcgccttatcaccacaccatggcaccagctcttcacgccttcaccttataatgccgccaaccacatctacctagagaaaggatgctcatgctccctttttcaagagtacatctggttctgtgtgtgagagtgcacaggaattctccaaagcttagtgaaggattgaagacaaaggttaagaatcatttcttgagagcagttttgtcaaactgctggcccctgttggaacctgtgacatttttctttgcttttttctgctttcattttctgccttaattctctggtgtagtttgctagtacaagaaaagtaataatgaaaatatcacagtgttacccaatatttatttaaggcttgatacatttaagatatgatattaaattttttattgaggtagaacatgtgtacagtaaatgcacagatcttaactgtgcaacttgatgaattcttacacattcatgtacctgggtgctcaccacccagatcaaaataatagaacatttccatcaccacataagcctccctggtaccttcctagtcagaagcccccatcccttgaggtaaccactattctgacttctgtcacttgagagtcatctggcctgtttttgaccttcatataattggaatcatgcctttttttcatcaattatgtgattatagctatgtagtaatcccttttatgattttaccacaatttattcatccattctcctaatgatggacatttgcttgtttgtcctttggcagttatgaataaagatgctgtggatattcttgtacataccacttggtggacatatgttaagtgtattcctaggaattagaacatgaaacttacaataccataatgaattttttcatactttagtttatctgagactcaacaacccctaagataggtatggtaagtagtagtattcacattttgtttttgagcgaaattagttatgaaaaggtcaggtggcttgcgtaaggttcctgagaaactgacagggttatagttgtgttctccacactaggctgcaggatttccctcttgcaccatgttagtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtataggactggcagtttctatatagaggttattgatttcattactctgcttgtggccaggattatatttcagtgtacttgaaaagtagtaggttatccatttcataaagttctccaggtaaggaggcacttttatggtaaccccaggtaagtgatggtggtttgaggaagaaggaatatgtcactcacacacatgccctttctatctgttctctactttctcagcatattgcagagggaaagaacacatgagaaaagatgagaattgactcctacccctttctgcagaagagattcggagaatctcttgcttttattgagaaagcaggccagtcattgagttctctgctctatcttgcttccctgtcactgcatgggctagaattacttgcagttacaaacattaatgatgaggagtgatatgtggaagagatcagccttgcctggggcattgggaaggataatggatggcagcccagcttttaaacataatttgcttacacagaaatgtgaagcagatctgtcaggaaaatcagttgcagacgatacttagcacttaatgaaaatgtaggatttttgttgctgctcatttcttcctaggaatttggcctagtctcagagatgtgccatttgtgcttaagtatatataccatggtcatactgtgccaacaataagtccttatctaaggggtcatacaagatgtagtggactacagaaccattaagcctatggagtttttcagatgtttggaagataccagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttaatcatttatctgtatttggctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagagagtggttgagtcaacaaacaattatgtccatggtgctgacaaaggcactgcaccttaaggcagacacagcctccactgttatcactttgttacctgtgtgtgtttttgtatatgaggactagaagaacaggcagagctttcttgcttcctgaaacttgccacatgcagcctcatatttcatggttgactttggtttgactttttaaagagacatattttagtttatttataggtcttaggtttcagaggtcatgattgtgtccattgtaccataaaagtaacaggaatgtagagaatggcagctcttaccattttttcatgttgagagtgaggaaagtataattatactttttcctcttgggtggaagcaactacaggagagcataagtgggctggaaggctctctcaccgcgtgcctgctccatgcactctcagcctgaagaatgccagaatgcctctaggggccagtcagttgtggtaccataactgattctctatttactgtttctggcccccaaaggaaaagtagaagtgccccactttccactgccctctctaaaacactcactcctacaggcaggcatgctaccagaaaatcaccttctcgtgttaggatagataggcattgctagatagatatgcattgctagaacccagctcttagaggcagctgccacatgccttgaaggaaaaggctccccactgctatcccttggagggacaggatggaaaaagagtgttcagataattttcaagggcactcacctcactacccttttaaaatctgagtgtcattcctagatcctcacagacttcacttcctggactttgctgtattactatgtatctgcctttcagaagctccagatctagaacagtgatgctgaatggttttctcatccatttctcatctgcctgttttcaaacaatttctaacacaaattgaaagatttccataaaaggaatcaaacaaccttccaagctcactcatttttgcatttcacgtttcttatgagaagtcccccttttactgcttttgtccacagtggaatttaagagtagattattctaagctttttttttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaattattgtctgcaaaagacttcttcagtgctctgctgagaattgaacacccttatccattgattgaaaatggatctgcaagatagaacatcattcatttagctgaggagagaaaggagtgctttactttgggcttctaggacatcctctcaatactatacacacttgcatcaaacttgacatacaggtgctcatttaaagtaaccccaacagaggatgacatatagtttctggttagatagttaaagcccaggggttgtttgtgacttggacaaaactgagacattcttagaaccacagagagtggaaactttgatctctgaaatcttcattattctcatcagatcctcccagcaatatgaatcagctcagtaagtatggctccatcagcagcccctgtctttggcagtttggggaatttcttttgggaaacgtcagtctttttgtcatgccaggaaaagtttaaatcaagttagtcctttagatcttctgatactttttgacttagtttgaatgcagcaggattatttgtgcttctctaaccctgttttacctaaatctcaatacctcaaggaagaaattagtttcacaggctaaggagaggaagaactaaatgagtcatgtaatttccaaatccatttcatacaggtgaagtatatgtgctatgtagacttcatcagagcgtactgttttgagtagggacagcgtgttttgcatgaacacatcacagtcccatttccgtgaaatgagattggcagatctacagaactcccaggtgttctgccgagtgtagccctggaggacagcaagtgctgtattgtcgtcaatccaccatgggctgcttctcagaagcccagtaatcccacaaatgataggcttgtctgtgattgcaagtcactgactatggacccggtcacctttttcttctatgtcactgaaatttattgacttgaagaggagtcatcctctttgtgacccccccacccaagtcacaactcaaatgaccatacgcatttccaaatgcccccttgaaggtatgtgctgcccctcattaagtaccactattttaaatgttgggttttaatcctttgccagttaatttacatataagatttagaatcttggaaaactatttgaaaaatcgtgttgggattaggcagcatttttttttcccgccaagtccaggatggctttgaaaataaatggacacagatctctcctgttttgatgatgtgcagtgctaatgactggctttgcagttaattttgattcaggcaacagatgttccttttggttccctgtctcccatgggcgtcatttcatgttgtcctctgccttcccccagatattctaagttcaggacacaagcttctggcccatgcagagcagaggccatgaggggtcacagcatgggtacgggaggaaacactgggctaacccagatactggacttgagtcttgcctctgctgcttgctgcacagcttctgtcatggtgctaaacctgtgacctgcctcacaggcttagagcatgcccgtagaagtactctaaactaaaatgctttccacaaatgagatggtttcatgaaaacttcaaatagagggcctgggcagaacataacctttttttttttttgagacagagtttcactctgtcaccgaggctggagtacagtggctcaatcttggctcaccgcaacttccactgaccaggttcaagtgattctcctgcctcagcctcccgaatacctaggattacaggcatgcaccgctacccctggcttatttttgtgtttttagtagagacggggtttctccatgttggccaggctggactcgaactcctggccttaaatgatctccccacctcggcctccccaagtgcttggattacaggcatgagccactgcgcccagccacaaaacaacttttaaataggtctgctgctgtttttttattttaaccttatttcttctaagacc

SEQ ID NO: 17064 - DNA, 136480 bp, Human
  misc_feature (1)...(136480): n = A,T,C or G
attctgagttgagtcaaaacctcaaagacccctgatgggaaaagctctcaagtgaccaccgctgtgggccagaatgcaaaactgcaggaacagaacattcgcaggaacagaacacagtcgtattaagtgattttcccgagcaggaagtggcatctggcctgcggttcagtagggggaggaaaagggtgggcgcacctgcccctggctggcgcacctgccaggtagccccacgcggcaccgcgtgtgccgagcgcccctgaggatggaaagccccacgcggggcaggtggcacccacccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctagaaaatattggacggggtggatgaacacccaagtgcgctccaggagaagggatttggcaccccaaggggcttttaaaacggtaagcttctaggggtgtctttgcccccaataatccatagaaacaacagtcatctaaaaatagtcttgttttctgtcctaagctccttttaactttgttagtcatcaccaatcctaaaataaaacccgtgtaacgtctcccctagtagcggctataaacaaacctacgaggaggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctccccccccgacccccgcccaccggcctgggcgtcctcccgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaggagaggggcgggcgctcggcgactcgtccccggggccccgcgcgggcccgggcagcaggggcgtgatgtcacggcagggagggggcgcgggagccgccgggccggcggggaggcgggggaggtgttctccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaaggtaagccccgcgcggcctccgcccccggacccctgcgccccccacggcccgggccgcgccccccgaccccgcccccgtcgcccgcacggaggggtccgggccagagaacgaggtcggccgggtctgtgcgcccagggaggggcgcggcgcggaccgggaacggcgtcccccagctcccagcagcccggttccgagcgcgccttctgccaataggtgtctcctctgccccagcgctgagggcgcgaggcgaggccgccgcgggtcccgccgaggaagcggctcgcaggccggcgatttggggacgggcgaggctgggccgtcaggaccacagagggcacgtgggagggaggaagggaggcttccttgggagtgaaggatgccccgtgtcttcctgagcgaggcagagccaccctctggcgccaagatcgcggtttgggggttctgcgccccccacccccaccccgagctcgtggcggcgtctccctcgcgccgcgcccctgaattccccagggccgagcccgtcacgccggctcctggacctgcaggaccaaaagatccaaagcgcggccgcagcacagccccgaatttaagccattttgaaatcctataggcaggagttccagccagagaagatgtttcaggcaagtttgaaaaggaaccgccaagtttcgagctgcttctttatagtgaaaaaaagatggcacagtgtgggtccctgaaacccggtgtggggggcgctgagacccccctgcggcgcatctcacattccagtcccccaccttagcccgtccccggcacacacccctggcgatgccgggtgggctcctgcaagtggctttgaaaatacccttgcagaggtgtgagcatacgagttagggattagggattgcaatgctaatggaaattggaagacgcttttccaaattccttaccagctctgaaatattttatataatttatttaaagagcgccagcacacctgccaacatatgtacttcataagggcagacgtccttccgagcgctgccgcttcctgcgcgaccctgataactgcggggcttgcttgagaaccgggctcccccagctctggaaaactcgctggtcttagcagagctgagcacagggccgtgagctccacggaggggggtccgtgtggtcggtgccctgacgcttcacgggacgggaggtagacaccacttcatcccaatgttagaaaatgttgacatgtttaaaccatgtcccgtgtcagtgttttacacaatgtgctcttgctagtagcagagtttaaaaaatttttttttgttggagtttcggttttaaatcctgggacacttacgccgcagtgttcattatcactccctttagaaaggcaggtctttccaagttcagatctctgtacctgaagagccggtggccgacctgtagtaaggagcccctttcttttacgcaaggaaaaaacacgacggggcagtggctagttttcgtgtttcctactgaagaaaataagctcgaaaaggtccctgctgcaaggcagtgcgccgggcagcgacgcccgaccgacatgggtgtattttatgagggctgcagaactgggccagccggaaagtgtgatctagtccttgatacacacaggccggcagcatggggacacgcgtggtttccacaccagccatcgctgagaccaccgggaagaactctgagtccttctgagtaggccccacgaggccattcctggcccatctgaggacctgggcgcctcccctgcgtccctcgggtttcgggaccatctgggtggaagctcattaggcgtcgtggttcctgaaggccccgggcttgcttcctcatggagaacgcagagaagtacaggcctgtaagtagccacccagtcagaagtcgctccagacacaatgccccacgggctggggccaaacaaagctcaccctgttctctgccacttaacttcacagcgttgtttcccagctcagattagaaaatggcagggcgctggcaccccgcttcatcacacccagcggggcttctgtctccgcagacatccccagcctctgggaggatgcgtccaagctaaacatttccatggagacacccagtgtctgtggaacgggcagctttgaatctggaccaatagctctgaaccatttgcaggaaggaagcccagcactggggcgggggaagggggggctcctaggagcagcaggggagccgccccaccgaccccttctctgggatggagaccagtgcagtcctaggacagcagcagtgagcctccatccctgcagggcccgcggcctggggccaccagcaggcgggacagtttagcaaaaagttttagtctaaacagatgataagggctgtcatttgtgtataattttatggtgggggtaaaaaggtggctggagttttaaaaacaatgtacaggccgggcgccgcggctcacgcctgtaatcccagcactttgggaggccgaggcaagcggatcacgaggtcaagagatcgagaccatcctggtcaacatggtgaaaccccgtctctactaaaactacaaaaattagctgagagtggtggcgggtgcctgtagtcccagctactctggaggctgaggcaggagaatcgcttgaactcggaaggcggaggttgcagtgagcagagattgcaccactgcactccagcctgggtgacagagcgagactccgtctcaaacaaacaaaaacctgtacaatggaaagagaatgaaacgttgtggcttctcaacagaaaacagaacttccacttgcccaaggtcggcaaaagcagcaaaactacaacaaaacaacgctccaacatccatcccaaagtcagaagtattattagaaactaaatcaggccacacggaacgatggcttatcactggagaaaaccagccagtgaaagggtcgcgggagaagcccggggacgaccctgggactggagggtttctcgcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgggggcggggggcacagtggatgccagtgaacatgggtggtcagtcccagagctggcgtcttgcagctggggcagatcctggggatggtgtgtgtgtcctgaccagaggccaggctggaggctggaattggcgtcaggatgcccagctccagctccaccccagtccctgcctgtggctctggggaaagaaagacctccttattgatttattgatttattgatttgacagggtcttgctgtgtcgcccaggctggagtgcaggctggagtgatctcagctcactgcaacctctgcctcctgggctcaagcaatcctgctgcctcagcctcccaagtagctgggactacaggcgtgcgccaccatgcctggctacttgtattttttgtagagatagggtttcatcatgttgcccagattggtcttgaacttctgacctcagatgatccgcccacctcggcctcccaaagtgctgggattataggcgtgagccaccgcgcctggccacctccttgatttattgacattactgttctctctccggtgcaggagactgcgtggctcccgtcctcttgagggcatttctttacgatggggaaggcgggactggggcctggctagcaccatccccaaggcgctcagcctcagcggaggggcccttcccatacgaagacatcctgagcaggtctcacctcccacccctgagagcttctggtcgcacctgtgaggtgtggctccatcgcagctctgtttcttttctctttgttatggctctgccccctgagtgtctggaatttccagaaagcagctgtgactcctgggattgaggccacggtgtgtcctcttaccaggctgccgtgccgtgtttcccacctacctggggcgctagaaccatttctgttagtaaatacagtgggtttgtattggtattttgagaccctagatttttttggcatttatccgtgttggtttctgaaccacgacttagcggaaagacagcactgtccttgaataaagtatcttccagccagtgcagttgcaccaggagatgaatatagaatttccatgtgcttgtttgtattatttagaggcctgggaatacccacctctaggcatgtaatcatgaggttccaagatgtcataaaaagtcttttcaaatcagaaatccagaggcacgtctttcctgttaaaattactgatttccctaataatgattttaaaaaatattttattgagtgtaattaacacataatgattcttaggactagctgtgtaccagaatcttctgttttgttctaaaagatggattcgtaggatatgagccagtatcagaatctccatgagggggatttcacagtctgtgttttcatccaatccttgaggagttttctttgtagctggtgattagggcaccttgacagtgataagcctgttaaaatctgtttacatatgtaggtccttagatctaaaacacatccaccatccatcatcatccatccatcatcaaaccattattcctccattccctatgcatccatgcatcatcatctgtccattattcctccattccctatccattcattcatcatccatccatccatcatccatccatccatcatcaaaccattattcctccattccctatccatccatccatcatccatccatcatcatccatccattattcctccattccctatccattcattcatcatccatccatccatcatcatccatccatcatcaaaccattattcctccattccctatccatccattcatccatcatccatcatccatccattattcctccattccctatccatccatctatcatccatccatcattatccatcatccatccattcctccattccctatccattcattcatccatccatccatccatcatcattcatccatccatccatcatccatccattattcctccattcctcgtccatccatccatccatcaccatccatttatctatccatccattcatccaccatttacctatcatgcctccatccccaatgcatcattcatccatccatccgtttagctgtccatccatccatcatccatccattcatccacccacccataatccatctctttatccctcattcctcccttgtttgtccatcaccatccatctacctactctccatctacccatcatcccttcaccccccgtccatcatgatccatccatcagtttctttacctgtctatccatcatccattgtccacccacccaccaaccatccatccattaaacaaattgaacacattttatgtgccaggcacagtctttggctctgaaaacagcggtgagcagaatagactaaggcgtccagatgttctgtcttcatggaacttaggtttctgtttgtcaaagagatgacagtgtgggatgaatgagtaaaaacaggctgttagattgtgatacgtatttaggagaaaaaataaactagagaaggatggcccacgtgttgagtttggggtttaaatgaagatggggtggttgaggaaggtggtttttgaatgaagagtggaacccgtgaggacccagtcgcctctctctgggaaggacgttcggatgaagatggggtggttggggaaggtggtttttgaatgaagagcggaacccgtgaggacccggccgcctctccctgggaaggacgttcgggggcttgtgctgctgttaggggaggaggggaggtgggcagtgaggggctcacgggagccttgttggccaggtgggactggggctgtcactccaagtcgcccggagctgtccggcagcgtggtctcagggacgtttgctgaggcccgctccttggggtccgttggtcgaggccgggggttgctggccggccctgagttcatgggtttctgctttgtgatgcccagcccctcatgctcccatctgcttctttttctctctagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccgtgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgaggtgagccggcagcgcggggcgggacggggaggcgaggggaggcgcggggcggggcggaacgcggggagcgggacggggggcggcgcggggcggccgtgtctggggacgagagtcaggacctgggtgggcaggtgggctcctcgtggagctgggaggcagagtctgtccccatgtctgcctcctcatgcagacttttccttgtgcgcctcgcctctgcctccgtctgcgcgtttcccatctgaagtctccagatcctctcgggccctgctgatggcctcgtgttcgctcagtctctgcaaacacccatttcaaagagggtggccctgctggcggtcagggcttccacgtgggaattccgggagacgccatccgcccctaaggagggctcacacacgcgcagtttcttcctcggggaattgcacgtgcctggcccccctcggtggttgcctgctgctcccgcttcctcccctgcagtaattgccttccctgcctcgggtgcagatgggaccgcagctcaacagtgccccagagcacccagtccgccacgctttggaacagcacggcctcctgctccccagagacgccggctgtggcatcaggctgggggagctcacgcgccttccttctttgggtcccaggttgttggtttttctttttaaccgtgtgaggggctgctggaattccgctgggtccacttaaccagcttggtgtttttatctctaacgaaacagctttcccagctggtgggctgtgagtggcccctgagagtgctttctgctctgggatttttatctgaggcatgaaaacgtccgtgcaggaggtcgagggcagtgccccatggcccgtgacgtcagggctgccgctgtgtcctcaggaagaggcgtttgccacgcgcagcccggggtattccaggctgggtgttttcctgtttttgtttttttttttttttcgtccctccccaccccccactccttttttattagcgagcactcagggggcgagaccccgcagagcggagggcaggtgcagcccccatgcctgcagggtgaggaaggcaggcagtgagggtgctctgggaggacccgtctctgctctgcagtctcaggccatgcttcagccatggctggagcacgcatggacagaattagagctacaagcagtaacaagcctccaggctgggaacgaacccacccaaacctctctgaaggcttgtggcaaagaaacagtgttagagctgacagttctttgagcagccccatggctgattctgcctttctactggcgtgatacttagaatcgtcgtcagctgaggtttcgagagaaagcaaggattacccctgatttttcttgacttgcagtgggcgcatttacctttctatcccaacttctgtttttaatacattaaggtttaaaaggctggcgtattctaggtgatcacaacgagcctgtgtcaggacccggattgtatttacaataaaaatcccattcagttggaggcattgggaaaatttaagaactgtttttgcctgctgtactatcactgttattgtttaagtaaaagtacaagcgtagtggcactgactctccagcccacagtcatgtacaacgcgcttcatggtctccaggcttacggacggtgacaaagtcgtccatcaccgcggaacttcactgaactggcgagataagggaagagtgatgtcatcaaggtcccaagactgggacttggcatgaggagtgtcgtaatgcagttgtgaacctttgggtgaaccccacgtatttgtttcctggggctgccctgacaaggtcccgcagacgggtggccttcatagcaggaaggttttctcgcggggtcctgagactggaagccgagatcaggggctgttcttttggaggctgtgagggagcatctgcctgacctgtctccctggcttggaggcgccgtcttctccccatgactcctcatctctccatccaccgtgcatgtctgtgtccagatgtccccttttgtgaggacactggtcctgctgggttggggccaccctggtggcctcatttgaacttgatcgctctgtaaagaccctctctccagacacagccccacgctgggcaggactccattatgtgagtttgcggggagcaccgttcggctgcctcagccccggtcttactgtcgcagtaaaaatggcaggcagcctttgaaagcgcaagctcgtcctggttccttcttcgtctcctgggcggcaaggtgtccgcagggatgtcgtgttctggcaggcacagcccctcctgtccaccttggacctgtgtttggtgtggaggttggaaagcatgggtggctgtttattttttcctctgcttgggggtttcaggaagaattccgtgcccacgtgaccctgttagctttatctcctggctgcagagcgcccagttaggtgtgatgcctgtaacatttctgagtgttcacacaaacaaagctcagtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctctggcaggcgtggaaaatgtcaccaggatctcaggctgcacaactagaaagctgtatttttaatgatctccaaagtttgggatggagaatgcacgacatgcccatcttctccccaccgtggtacagaactgctgctccattaatcctgtccctatgccagaaggagctttctggtggaaagtgtgctgtgtgcatccttcccagggaccgtctaggattgttgtcctttgaggccttttgttgcttgttcagcacctgtggcccccagtgctatgcagagcctctgagaggcccacaatggtcaaagaacgatactgaattcttgctgcaattgaagccatgataatgtttgtgaagttagtaagagtaggtgatagaaccttgatagttttagagtttggagccattttagagctcagcggaatgatgtgtctattgtcaaagcttggggggactggcacaggaatcacaggccacctgctataccccctaaaaattagaatcttaagctgtgaattctggcatcagaaaggagtggttttcttcccgccttgcttctttccaggggtaatgacggtgatcatagcaagtggcctcccagggcacctttccgtgtgctgttgagggtgcaacaggaggcgttgccgggctgcgtctggaggaggccagggcgagagtgcacgttgaaggctgtgcgggttatttataaatagtggttctcaaatggtagcttttaaagatttcatattgaccgacaggaactaaagtctacgtgattgcttcctcattccttcatcgttcggcctcctccacctgggcacctgccacaggccatgtgcgtccatgtccaggtctgtctgtgccgacatctgctctttgggcatcagcctctggaaagtgtccctgtcagagtctccacgtgtctcactctccgcacccagacagtctctggagttgcctttgtagaggcaaggttgtaggggaattggaaaggcggaggtattttgactgaatttattggtaactttaacagcacaattcttgaattcaatttctttttattttatttatttattttttttgagatggagtctcgctctgtcacccagactggagtgcagtggcacaatctcggctcactgcaagctttgcctcctgggttcacgccattctcctgactcagcctcccaagtagctgggcctacaggcgcccaccaccgcgcccggctatttttttgtatttttagtagagatggggtttcaccatgttagccaggatggtctcgatctcctgacctcgtgatccacccgcctcggcctcccaaagtgctgggattacaggcatgagccaccgcgcccagcccttgaattcaatttctacacatgaaacattgcctcttagaactgaatgtttaaaaagaatttctaaggagtgaggtaaagaaaaagaattcctaaggggcgagataggctaataaacaatgtttacttagagtccgcttggtttcaatgatcagaaatagccgctaggttggtgcaataacgtatattcaaatctcttggccaggcgcagtggctcacgcctgtaatcccagcactttgggaggccgaggcaggtggatcagctgaggtcaggagttcaagaccagcctggccaaattggcgaaaccccatctctattaaaagtacacaaattagctgggcatggtggcgggcgcctgtaatcccagctactcagaaggctgaggcaggcgaatcatttgaacccaggaggcggaggttgcagtgagctgaggtcgtgccactgcactccagcctgggcgagaggagcgagactccgtctccaaacaaacaaaaaaaccctgtttatttcagacattaagttttgggctgcaatattgaagattttagcatatcggtcacttttctgctatgcatagtattagtttcaaaaggtctgagaaaacgttcactctcttgtgtttcataagttatctgaaagtttcacagtttatcacaatttggaataagatcagctaacccccagcacagtaacaggtggactctgtcttctctttcgcagacacgagtcctctgccaggctcagtagcgattcctcctgcgtttgaatgccctttgctcttgtggctctggtacctgaggggttcgggccccggcagtgttgggggaacagtgcaggcttttgacagctcccaggtcctgtagtggggccatctctgggctctggagccagactgtccgcgggcgctggtgggccctttggggtgatggtgaacatagtctctaaggcgttgtaccgaaccccagcatagcgagacgtgtaaggtggtagccgtggggtcttccccgagcttcccgctgccatcacctcctgggaagacggatagcaaagaagccgagggtgtcgagttgccccatggtttgtaaaacactggcatgggctggaacggctcaggactgactgccactgcgtctccctgtaagcccctccctttctggggagggaagccccccaacaacccacagccagcctcgaagccacgtcgccctggctctggttcccgctaacccttgctggggagtcccccgcacaacctgtcctgctgtttcctgctgtttctggagctagacaagcctcagctggcctcctggctcccggcatgggtgtcaggccctggggagtctccagtccctcctgtgggtactgggctgggctggctctgaagggtcttgaagaacgtggctgtgtgcctccctggcattcgcggtggtggctctggagcttgcgtttggctgagcaggccagcaggtgactcgcgcaagccagacggtccccaggaagccctcagctgtggtgggagatgggagatgggctatggtgggagatgggctgtggcgggagatgggctgtggcgggagatgggctgtggcgggagatgggctgtggtgggagatgggagatgggctgtggtgggagatgggagatgggctgtggtgggagatgggctgtggtgggagatgggagatgggctgtggtgggagatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggctgtggtgggagatgggagatgggctataccaggagatgggctgtggcgggagatgggctatggctgggcctgtcctctgtggtgctgtggatgcgtcctattcaggagctgcctaccaagtttcattgcgatgttggaatctgtccttggtccctgccaccatggggtgggtggagcccccagcaccctgccttcttcctccccttcctgtgggtctgcagggctcggggtgttgatggagactgtgggggtcgggggagccagcagtttcgttgtgtgatggcaggaagaatccgcgtgctgccccaccatgccttgcgacgctctgtggtagggagctgtcgggtcacagtcaggcgcttaacggccacccgactgtggacgcagctgaggccatttgtccagggtggcctagtcacaaccaacagaactggactctgccatgatgagcagaccccgcaacctacactccagactccaccggtgctgggaccccgactcccaggagacctggcgagctcagccctcttgtcacaaggcctgtacggggtgggggcacgtgtcacggggaccctcggcccagactggccttctgctctcgtcaccaagatgtggagccttctggggtcagagcccagtcgaggggctttacgcagcctgtggtgtccttggagccacagctccctggagaaggcactgcgtctgccagcctccgctggtgaggggctcagagttgagaagatcatgcctcctgattgcacgagcaccctggtcttggctcatttgctccttcttgagccgcttcggtagcatttggcagcccacggttttctgcctgcgttgtttagtttgtttctgctgttatggagttcacagctgacacttggagggcggggtttgcaacaccagtttctgatgggaaggactggtgtgagggtgtgaggaggctgcggaggccgagggcctgtgcgttctcccaggcgtgtgtggaagggctggggcatcttctccctggtccttctcaatgttactctgtccatgtctgttgttagccatgaggaggagaaggcactctgttcctggaaaggagaaaacaacgtggctttttgctcagatatttttttttgagccagggtcttgctctgttgtccaggctggagtgcagggtgtcatcacagcttactgcagcctcgacctcctgggctcaggtgaccctcccacctcagcctgccgagtagctgggaccacagacgtgcggcaccacacctggctaattgtttaagttttgtggagacagagtcttgccgtgttgtccagggctgatctggaactcctggcctgaagcagtcctcccgacctgtcctctcaaagtgctggcattgcaggtgtgagccagagttttacagtcagatcatggagatctgaaatgttgccccatctcaccgaagaccgagtgcccgggagcccccctaggagggtcagaacctgcccgggagccccctaggagggtcagaacctgcccgggagcccccctaggagggccggcacctgcctgcccgggagcccccctaggagggccggcacctgcctgcccgggagcccccctaggagggccggcacctgcctgcccgggagcccccctaggagggtcagaacctgcctggttagctcagatgcccccgtggagacagcgtgagggcggcagggagctggaaaccttcccaggttcccaattttgagatttcctaagctgcctgtggtccagctgggaggaagtgtctggtcctgatgtgcgtcggtgaccacagacaaaacaggatttgctcctgcgccaacgttggcttttgagcagcgggataggtgggcctggtggtaggtgcttcggcagccgggcagccgcagggacttcctccctcgggattaaacctgagtcgggagttggagggcaacagttattcacattcaaaaccagatcttaagtgcaaattaacgttttttggattcttgagcaaaatgttttctacattatgatgggattttcttttttataagtgcttctagaacatctctggaagctgggttagacgcacagggcttagtcggctttggggagagacagtagttgtaaaggccacaccggacgccgtgtgcacctcccaaggtttcccatgtgagaccatgtggcctgcatgctgcgttccatcagcactgggctgtgcgacagatgtgtttccaggcgaggttgctgcagaggggaagagggggacgtgtttccaggcgacgtcgctgcagagaggaagagggggacgcgtttccaggtgacgtcgctgcagagaggaagagggggacacgtttccaggcgacgtcgctgcagagaggaagagggggacgcgtttccaggcgacgtcgctgcagagaggaagagggggacacgtttccaggtgacgtcgctgcagagaggaaggagggtcgcgtttccaggcgaggtcgctgcagaggggaagagggggacgcctttccaggtgacttcgctgcagagaggaagagggggacgcctttccaggtgacttcgctgcagagaggaagaggcagacgcatttccaggcgaggtcactgcaaagaggaagagggggatgcgtttccaggtgacatcgctacagacaggaagagggggatgcgtttccgggagacgtcgctgcagaggggaagaggtggatgcgtttccaggcaaggtcgctgcagagaggaagagggggtcgcatttccaggcagcatggctgcagagaggaagaggaggacgtgtttccaggcgacgttgctgcagagaggaagaggaggacgcgtttccaggcgatgtcgttgcagagggcaagaggggaacgcgtttccaggtgacgtcgctgcagaggggaagaggcggatgcgtttccaggtgacattgctgcagagaggaagaggaagatgcttttccaggcgacgttgctgcagagaggaagagggtgggacgcatttccaggagacgtcgctgaagaggggaagagggaggcccctccagcagggccacctagatgtttgctttgccccgcgtggagtcatattccaggaacccccgaacccacctgcagcttgattctgctcctcagggccagaggttctagtttatgggaggagtgttttctcactggaaacatggagcccacacacacttctacgctggaagccgtgatgtgtgtcaggaacgtgttctgatgttggtgtgcaaaatcagtattgtgcctttgtcccctctgacccccatcacggcagttctgaggcttgtggggcaccccagctcctctccctctgcacaggccactgttcccagaactcgagggttccctgacaccaagatgacatgtggcacagacctggaatcacgaggaaatgcccgtcctcctcccacgggcagacaggtcgagtgtgtttccagagaccgggccgtccgtggggcagtagcgcctggatgacgtctgctttcgcctggagccctggctgcaaggggcggtgccgggcaagggccaccccaggggtctgggagtgcagtgtcgggcctgtggaggtggagagcagggatcagcctctttttgtggatgaggaaatggagacacgtggaaacttctggtaagaagctgtcaagcctccaggtttcggttctggacaggtgcggggcaggtattggagcactttgggctctgaggtccacgtggcccagcggcctccaggagtcagctgcaaggcggagtccctgtccacaagctgcgttgcaggcacagagaccaggagagggctgtgaagcaactctgtgtttactgggctgaagcagcagctcttggcagtgccgccaccatgggctgtgtcctgtccccgtggcgacatcacagctgagcgcgaagctggaagcttgggcacgtcttggtgctgggtcttctccgaccccgagggccaagggtgctctgtagctccaggcgtcagagtctgagcatcctttgttttggcaacatccaggacaggagtctttggagagtaacacatccttattttgaaagagccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcaggggagtgagggagagggagggtgtacggcatggggcctgctgcctggggcgctgggatcccacagcgaggccctgttcccactgcccaggggcactgagatcccacagggaggcccggttcccactgagcttgggttcccaacgggctccttttgcttcccaagcaccctctcccacccttgagctgcaaggaatgtttcagagccatggaaggtgctttctcccatctgtagtttttctgggagggagaaaggctgacatcgggggctttgtagaaagcgtgctctggcccacacgttaacatttgggaggaggcctacagggagctgtcggctctgggcgagggctgggggctgcctcgggggcgggggttcagggtcttgagctcagcttctcacccatccggggcagggcagggcagatagaggggtggggacagtgttgggggctgctgggcctgggatggcagggcctgtgtccaaagctgttgtgaggctcacgagatacaggggtggacctgggagggttggggcgcgtacagaggggatgacttcgatttttccaaagaacagggaagggtctgtgtcctggtcgtactccaatcccgtgtggtggagccacgggacgccatcagtttttatgaaatccccaaatgtgtcctttaaaacaaaacctctgcactccggcctcacagcccagatcccgcgcgctcccggtctgtggctttgactttggtttgagttcctgggctgggcttacctggctggcagggccgcagctgtggcactccctgtctggggacggaggctgcccatgcacccggctgtccaccttcttcccaaaggcggcgtcctgggctccctcccatgcggacccgggatccacttgcccagccttggggaggacagatggggacagcagatcctgccccagggtcattgcccgtggccacatcggtcctgggaactgtgggtaggccatgggccgctggtgcctgcaccactgtcctggtggaaggggctggacctgggactgcctgggacaagaggccaaggcacagatggctgcaggggctgcccctgcatcctgagcctcacccggcgggcaggagggccgggctgggtgtccccatctttctgttcccaccctggccccagtcacctgcttctcatccaccgattccatctttcctgctggcttgtgaggcccgtgccctcctctgggccgccttccctcccatgggcacagagcttgggtcccacgtggagaggaggccctgcccgcagcctcagagtcaggcggccttggcttcagggagggttggacgggagccagcccattggacagtagcccggggcctctgggtgaccctccagggtgggacagcagtggtcccaggcccccctctgactcctgaaatcctaaggttgcccgggccgccgagccctccctccactccccggcctgctgggcaggattttgtgaaaggccttgtcttgggtcgtggaagaaaaccacgtggtctgtggggtcatccctggggcaggctgtgggagggtgaaggctgcgtccagcggccaggcccagccagaggtcgggaatcatgtcgggggtgacgcacagatgccgccgcactatcaccgagaaacgcggcgtgtgcgggcccacctggcctctttaggccgggctccgggctgccctccaggaaggccgacctctcctgggcgggcaaaactttctcagggccgagttctgccggcacaggtcagggggcaaagctggcctccgaggagcctctgaccgctggccactgtgtggtcttggggcagctccagacacacaagcccagaagacccagaggctgcctcacgtcggagaaatgcgctgatcgtctctctctctctttgtctctccatctctgtctctctccgtctctgtctgtctctccatctctgtctccctgtctctctctctgtctctgtctctctctgtctctgtctctccatctctttctctgtctctctctgtctctccgtctgtctctctgtctctccgtctgtctctctgtctctctttccgtctctgtctctccatctctgtctctgtccctgtctctgtctctctgtgtttctctgtgtctgtctctgtctctctccgtctctgtctgtgtctgtccctgtctctgtttctctgtctctctctgtctctctgtctctgactctctgtgtctgtctgtctctgtctctctgtctctctccatctctgtctctgtttctctgtctctctctgtctctccatctctgtctctttctccatctctgtttctccatttctctgtcgctctgtctctctgtgtctctctctgtctctgcctctctgtgtctgtctctccgtctctgtctctctgtctctctgtgtctatctctgtgtctgtctctctctctgtctccatctctctccatctctctctccgtctctgtttctctctctgtttctctctctgtctctccatctctgtctctccatctctctgtctctgtcgctctgtctctctctgtctctgcctctctgtgtctctctccgtctctgtctctccatctgtctctctgtctctgtctctctgtttctctccctgtctctgtctctctgtttctctccctgtctctgtctctctgtttctctccctgtctctgtctctctctctgtctgtctttctttctcactctctttctcttttaactaagggaaaagccgtcacacaaccaaatggccatgaggcccgcggctgccggctgaggagggctgcgggaggaccctgaaaccctcgccctcctgaagctgctcctgtggagtcctgtgggcgggtgtggccctgccgagttcagagtctgtcgcttcgtctgtctggaaactgcaggagtcatgagcagccttcacggttttcacctaagcaatgagcacgtgcgggctttaaccctcggaaaatcagaattaaaggattttacccaaaccacttaaacaaaggaactgcctctgctctgggcttctgctgccgagggcgcgattccgggattctcatcgttcaccggcggagtcggggcgactcatgaggagagtgttttcagatgctggggacgtggcctttctaagggagagggacatggcagggcctcaggctcagctctttggaaactgaagcccattcaccaggtgggcgggggaggagctgggcagaggttgagacacaagacctgagagcagagcaaagtttctcatttttttggttgtacaaataacaaacaccgttcactgtagaagacttttaaacacagataaaccacgataaatgagtcctgcaccagcgtggcagctcacacctggaatcccagcgctttgggaggccgaggcaccaggatcgctggagcccaggagtttgagaccgccctgggcaacatggagagaccccatctctacacaaaatataacaattagccaggtgtggtggtgcgcctgtggtcccagctgctcgggaggctgaggtgggaggatcccgtgaggccactgcactctagcctgggtgacagagcgagaccctgtctcagaaaaaagaattcgataatcctgcgattgagaatcagacagtgatcatttcaggatatgtctttttttttttttcctccccctctgtcccagcgcagacggcatctctgtcgcgagctttcggctgaaaaaaaatccctcacgcccttcccaggcgagggagacacaggttcaggggcatgaacggctcctcccgtggaaaggactgtgtggccggctccccaggccacgggggccactgtcctccatgccacgtcccatgccgcttccaccgcagcgtgaggacagcaggacctgagccacgagccacactgctgtgggacccgtgtcgggactcgcagggcctggcaggtgtttccatttgacctgtgggctcacactcggcagttctgggccccctggtgtccacctccatgggagcaccgtccccggacccccagaggggcggcaaacacaggagtcctggggagtgttgccggggcgggaagcccggacccccctgtgactcagctgcagcctctctgggtgttgctgcgggtgtggaggttgcatctggctcagtgagaagcatttttaaacttgattctgcagccactgcagattcgcgggaagctggggggaggcaatgccccacccggcccccggggctgccccatagcagccaccatgccctggccccaggccccaggaggaggatcctgccgggagcgccttgcattttgcctaggaccttcttaactctccagactcatcagggaagctctgcaggagctcaggataaacaggtccttggcttgaagcctgccggcatgggttgggaatggtgggggctccatgtctgcagcagccacggcagaagctgtggccacatgagctgggctctgggtgcggctgtggccattgaggagggagcatgtcccgggttcttaggttaagtgcgtcttggcaggggggcccggggctgcagcccttcgtgtacccacgtgtccgatgtctctgtgccatgccgtgacgttgtccttcacgtaaagttttcaagacccacgtcccattgtctgtgaaatcacaaggttttactttatggactgtgtggaatggacccagggaagggggaccagtatatgcccaatttgccagcatgtgcaacagtgaacttccctggacagctggccttggtgtggcagtgggtgctgtacggctggcctctgtgcagtgggttggggggagctggatggctggcctctgtgcggtgggtgggggggagctggacggctggcctctgtgcggtgggtgggggctgtaccactggcctctgtgcggtgggtcgggggaagctggacggctggcctctgtgcagtgggtggggggagctggacggctggcctctgtgcagtgggtcggggggagctggatggctggcctctgtgcagcgggtgggggagagctggacagctggcctctgtgcggtggaggctggacggctggcctctgtgtggtgtgggggctggatggctggcctctgtgcagtgggtggggttgggggggtgctggacggctggcctctgtgcagtgggtgggggggtgctggacggctggtctttgtgcagtgagggggctggacaactgccctctgtgcaggggtcggggggagctggatggctggcctctgtggggtgggtgtagggggagctggacggctggcctctgtgcagtgagtcggggaggggggtggctagacagctggcctctgtgtggtggcagggctggacagctggcctctgtgcagtgggtggcgggggggtgctggacggctggcctctatgtagtcggggaggctggatgactggcctctgtgcagtgggggcaggcgctggatgactggcctctatgcagtgggtcggggggcctggacagctggcctctgtgcggtgggttgggggggcctggacgtctggcttctgtgcggtgcgggggccggcctcgggccggtgggcaggctggaaggtcagccaggccctgtggtgtctttagtgagaaacaggaaataaatcaaggggatgttgtagaagttttaccgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagagaaaaagaaaagacaaagtaccaaattatgtgtctcattttcttaagatgtatcattttgtaaaaatgtttatagaaatacacccagtgggctgggcacagtggctcacgcctgtaatcccagcactttgggaggctgaagcgggcggatcacctgaggtcaggagttcgagaccagcctggccaacatggtgaaactgtgtctctactaaaaatacaaaaaattagccggtgtggtggtgggcacctgtactcccagctactctggaggctgaggcaggagcattgcttgaacctgggaggcggaggctgcagtgagccgagatggctccactgcactccagcctgggccacagagcgggactccgtctcaaaaaaaaaaaaaaaaaaaatggagagagagagaaacagagaaaaacaccctttggctctgtgggcgtcggtcaccgtccagaccgggtggacgttcgtcggtcaccatccagaccaggtggatgttggatgcaaatttcacccgagcttttttttttattttttcagttgtgttgagtgtcacttttttaaaaaattgacttatgttgaagatgagtttgaagttgttggaattatctcagtcctgagcttagggcttcagcaagcgagttgccgttccgggggatgggctggtcagagacccccgactgaagcacgcctgcccgaggctgccccaggcgtcgtcccccagaaggaagcacgcggagtggagtggggtggagagcaggcagcagcggtcccgtctccgcagcagtgcaggctcctttcccgctcatttgggctcttttgtctgaaccagagacacagatttgtagagctgccaaattcatgctgaaaatttctaaccaaaaccaatcatcttaattgtctggattatgatatttattttgtaaaccattcttgctgtaagccatgcacacactgtgtcactaaatctgcaaatgattccagagccaaatgcagtcctgcaccgcggcgtcgggtcaacggcggacttcacctatgagggttctcgtgagatcgtgagagcgtagttttactgcatcttttccatgtttaaatgtgtttagattcacaaactgtgaccgctgtggggcagtcacccacggtgttcagtgcagccacatgccgtgcagacgtgtactggggagccgtgggccacgccacgtggctagggtgtgcactggacacaccgagtcggttcacacgagttcccacgacgacaaaatggcctaaggacgcgtttttcagaatgtgtccttgtcataaagtgacacgtggctgcgtttacacaaacttattcttatgtaatagtcagctgcagagtggtttagactgccttatctttaggaaatgtgtctgcctttaaccagaccagcggtggggggaggcggcttttcttttcttctttcctcctctctcctctctctcgctgtctcttctctgtctcttaactttcctgggaatccagtgagcccagttttttcactgtgaattttgtttttggtttgtttgttttgagatggagtctcactctgttgcccaggctggattgcagtggtgcaatttcggctcactgcagcctccgcctcccaggttcaagcaattctcctgcttcaccctcccaagtggctaggattacaggcactcgccaccatgcccagctaatttttgtatttttagtggagacggggtttcaccctgttggccaggatggtcttggtctcctgacctcaggtgatctgtctgcctcggcctcccaaagtgctgggattacaggcatgagccaccacgcccggccatgaattttgtttttcatttgtttctttttcaattcatagcaaaagataggtgcaaggtgcctgagacgggcaccgcctcgcatcatctgcgactttgtttggtgcctgcctgtccaggagcaggtgtggccactgcagaggggcccttcattgcccagccctgcagctgccccctctcccttccccagaaactcacagctggccgcgagctctgtgcagagaagtctttctctggaggctcttgtccttcctgtgtggaggcctgggtccagccgcctttccttctgcctggcagcgttagctgatactgggtgtccatgctgatcacctcacgtgggaaacagctctgacagtacagcccatgaagctgcgtcttggagattcctctgtcagggaagctgtcgtggctgagttggggtccagcaggcacccgcagggcccaaaaccccacagagcggaggtgggtggtgagcctgccaggtgcatctttggataaatccatttctgagttttcaaattactatgaagcttccaatgtcacaaaatatgtagtcttgttcttgctaaggaacattttaggtgtttgtatttttaaaaattacgtagttgattccattcaagctgcctcctgggctttttcctctttaaacgagtcttctattctgcccatcgtttttagtttgtttgttttgagacagagtcttgccctgtcgcccaggctgaagcacatgcgatcttggctcactgccatctcaacctcccctggctcaggcgatcctccccgctcagcctcctgtgtggctgggatcctccccactcagcctcctgtgtggctgggatcacagatgtgcaccaccacgtcctgctcatgtttttattttttgtttcgtagagatggggtctctccatgttgcccaggctggtctcgaactcctgagctcaagtgatctgttccccttggcctcccaaagttttgggattacaggcatgagccactgcgactggccttgtttttgttgttgtttgttgtttttttttagatggagtctcgctctgtcgccaaggctggagtgcagtggcgcgatctcggctcactgcaacctcctcctcttcggtataagcaattctcctccctcagcctctcgagtagctgggactacaggcctccgccaccacgcccggctaatttttgtatttttagtagagacagggtttcaccatgttggccaggatggtctcaatctcctgaccttgtgatccacccgcctcggcctccccgagtgctggggttacaggcgtgagccaccatgcccggcccttgttttgtttttaagtcactttgggttcacagtgtgtcctgaggtgtgggggccttcggggggctcgggaggcagtttcctttaacttgcagatgcccctgctctgcgactgcatcgcatggaacctgcccttctcgagaagctgccccgcatgtcccatgtctctggggcttgtacttaaaactgacgtagaatgatggtcagcagctctaggcaataattgagtcctggccagaggggctggttctgaagatgggggagtcacaggccctgtgtggagggtgacctcaggagccccggcccacggtgctcggggtgagcctgtgtggtgaggacagtcggcgggccctgggtctctgcccacacggaggtgaggacggtcggcgggccctgggtctctggccacatagcggtgaggacagccgttgggccctggactgcctctgcccacgcagggtcttgcacctgatctgatgagcagtgctggtccagggagggtcccaccgcatcctccgcctgccttggcccctgcagtaggcagtgctggggagacagactgagcgggagaggaggctgggccggggctgcagcggccacagagccttggccctcccagaaacggactctgatggcagaggcgccggcctcttgcacagggtggaaggtggtgcctgcgtggatggtggtgcaccggggcaggccaccccctagatgcaagaaccccttgggtgcaccgtgtggcccccaggagtgttgagacagtctgcctgggcctcctacagaacacagttgggaagacacgccgagggcacgggcaggacctcaccttagcctttcacaccaaacattcatctcctgaaaagacaggggccgtggggcccccagctgggctgtaggctctgaggacagccccagcacctgtcacccgccaggtcatgcagctcgtgtccctctgtgcaaagtaaccgaacagcctcccacagccctcaccgtcgtaccccgccctgctgcgtttgctcccaccgccctccatggacgccgtgtccctcctcctggccctcagtcagggccttctgtttgtcttgcagcaatcatggaatttgggggctggcggcgctgcgcacatcacaacttccaaacccactattttataaagggcccagtcagtcacctgtctcatggcagccacacagctggttcatagcgaggagaggtttgagcttcctggttcttaggccacagcccatccctcttagattttaaaacagattttcaatgagttctaaaacctgtcttactggagggttaagtaactgatagaagcctgtcatgaaggaagagaagcgtgttaaggttgtgcttggaaaatgtttccatcttagagaactggccgggccgtggccacaggtcacgatgagtaagcactgcattgacacaggcttctccatctccatgtcaggacgtgcactcgccgatgaagtgtccacccaagatggcgacgggtgagcacgggcacgtgtggcccgggcgaggtctgtgtggtgctgaacgcctcctctgctctgttcccttccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcaggtaggcactgcggccagactcgcacgtcacttggtgcttttgtggtcaaaaagtaactttggagccacagctaactgtgcttagactctcccagccaggccagctgaatgctctgtcgtggttagtcccgggcggctgctcaccgcctctgagctggaatgggagcatgccacagctcctcctgcttccacacgtgcaggccctctctcgttgttttcagatttgcccgaagcagctctcgtatccgtggatgctgcctgtggtgtggatgttttgggggttgattctcccctctctaaagcctctgaacttggaggcaggagttctcaccagcagcaccagcctcgcctggtgggggaccctcagaaatgcaggttctgtggcccacccaggcttgcaggatcccatactctgggcttgggtgctggggggcaccagggctcaaggtgctccccgaggagaggaggagtggcttccagagcgggcctgggcctggcagccacatccctgccggggtaggcctgggcctggcaaccctgcagccgcgtccctgctggggtgggcctgactcccccgggctgtggtgtggcttcctcaccttcctcacaccttgcgggaaagccacgtggagttaggctgtcgagggaggggtgtaatgaccgcgccagggacgggcagcgtctgcacagagccatgctccctctgcaccccaggtgttgatgtggatcccgggtagccgtgggtgttggcattttcttcgttccacctgttacctcgtcagctataggccccaggccctagatctgctgctttggcagccacagagcagcaagtgtgtccagccccagggctccaggctacgcggcagcacagaggatgttttccgagcacaccccaacagcaaaaaaccgggtgccccagccccgttatttagggaatgatgcaagccggaaggggtgttcagcagagtgcctcgtatttttattttcttccatttagataaatagtggagagaaggtggccgcagggacaaatggctgtttgccaacgcagcagccggcggcagggaattagcgggcagggcgctggggtgaggcgttttcgccagcacttgcagatgatgttaatgtgatgtttgtggcctgtgtgcttgatgccaattagtacctccctcgttggtgcttgaagcaaggaaatgcgggagacacctgagcgcacagtggcccgtttgacatttaaagtctccaccctcccaggtgggaaaggtcagacagcgctgcaccacgctccgtcactgcaggcctgcacctccccatccctgcctcggtttttactgaccgaaagcttgttattgctcagtgggaaggatattagataggacaagaaacgaggctgtgaaaggaggagtggaaataaagcaatagagaaataatggcccagtccaccctatttgctgtaaattatgtcggtgaggggcactgacgtcgcccttttcactgtatctggatgaggggcgggtgtaggaatcgaggctgttacttggagggtaaagcaggaccatgagtgtggagagagctctgaggtttctgtttgttttgttttttggtttgtttgttttttttttttttttgagacggagtctcgctctcacccgggctggagtgcagtggtgtgatctcagctcactgcaacctctgtctcctgggttcaagtgattctcctgcctcagcctcccgagtagctgggactacaggcagccctgggttttaatggatgtattttcacctgcctgtgagtagcgccggtgcctggtgccgcccgtctctgcggacacagctcagtgcttgggtactctccctgcgtcttctggaatcttctggaatcccgtctctggttctgccatctgggtgtcttgggctgagggtgcagaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacgggagaggctggctctgcgtttccacagaaggagccctttccattgaaacgcgggagaaaacggtcccctgcacggagaacgtcaggagctgtcagcatatctcatttgtagaaattagtaatttaaagagttttgtgatgtatctgtggcagagtggatttctgtctctgcaagtgtgaggtaaaagcagctaaaaagagggggttttgggggttagttttctctttcagttggtggaccacaaattggataaaaatagaatttgtgcataatttaaaaacaaacgagaatagaaagctctcagttgccgtggaagctcctcgtaaccgcagacgtgccctcggtgccgtcgggttattttagtacatcctttgacgcggcccctttcccgcttttcagaaacgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggtatccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggcctttccttcagagggaaggaggccagccccctccagtgagcactgagcgtgccccctgccgtctctgtggggatgtcattgttcccacgccggggagagaccaccccaggccagcccctattcttctggccacattgccatgatcacaccgtccgcaccctgaggccacccccattacggctgccacggcgctaaaaacaccagcatcaaagcaacagggccgtggtttagcctggaagagcggggccctggagccgtctgcgagggggtctgggtggttcaggatggccggcagcccctggtggacgtggtccctgcggggtctggcgggacctcggccatggtgatgggtgcgccccctctgcagggtggggcctgcgggtaaggacagtcccgccccctgtgcgtgtgaggggatagtggagagaggggtctggcgtgggcctcactgctcctgggaaaccaaagatgaagacgcctgcttaggactcaccttgccctggtagaacaagtgactcagacagagcctcccagaggcttctggccaggcagggagtgaccagcagcgcagccagcctcagctcctgcccacacagcccccttgtcaccggctcctcctgcccctgctccagcaccttggccaccagttctcggtgggccggtctggatctgccgatgccgggacctcgccaggccgctggttgcaggggaggctgagggggcgtccgcctgctgtctgcttctcaccagcatttccagtgaggcatgaaagtgatgcgtggcggatgtttccctctggcctcagctttcccccaaatcccagctcacactgagtgtcctgatggtggcacctcgggcagccgccaccctctgccctccaccctctgccctgacggcaggctctgcctgagggggagggtctctctgtacacacagtctcctcaccctggagggcctgctctgctctcaacggagctggaaccaggagttcgcgagtgctctgggtggctgctggcttttctccttgtctcacctcctcatccgcacacagcctctgccctcagcgctgctcacctcggtatgtaggcagccggcatcaggatggtctggggtgagacaggcagtgttcttccccttctctggccagggagggtggagaagcacccgggcacagccattgaggccttttcgtgcaactcattgcctttctgggcgtgaaggtggaggctggtcctccacctgcgtgttctccatctgggggactgtggtcccggaggagacctggagtccggctccccgctccgtccgaggaggagctgagcggcgtgagcagtgcccgccctggtcactctgccttgctttcctcctctctgtttctggttgtgcctccttccttccctcctgctctctttgccgtggactgcagccccctcgccagatgtgttcctcacatgagtcaacccgtccttggcctgcgtcctccactgctcgtggcagctacactctcccggaggtggccgggaagggcccagggccttgagaagatgtctttgcagcacgtccccggccctcggcctccacctccatggcacccaccatcccacgggggcacgtggacctctgtgggatatagcctgacctctgacccaggggtcaaataactcaggtctgtttaccaagtcaccaaaataacctgcccgatagcatctcacccatcacacgggaggccgggctcgtgtgaataattaataggtcactggaatgtgaaacgagaagcctcggcccgttctgaaacagcattttaggtttgcagcttataatattgtcagttaggagaagggccaactgagtctgcaaagaggtgagggcgggtggtctgggatcctgcctcagccgcgcgggtgagaggggcgggcgggtcaggcgaagactcagagtcaggaggccagactggccccagggagggctcctggccataccccaagctcaggacgcagggtggggcgggcccgctggtgcccacagtggccttggtgggcctctccttccattgcccagcttgtaggtcaactttgcctccacagatccgtaacagacgttttttctgtcatgtaagaaacttgacagctgaagaccaaggagtggagcctcccgtgaggcagctcttcttttccggttgttaaaatgcgcgtcgggccagtggttctgactaattctcactttgtgtggtaccttcagctggcaggggctcggggagtgttcagtaccgtgaggagcaggttcctgagagcccgtgaataccgtggacagattaccacagcacgcactgttccacgcagggcctcatccacgctttcttaagtggtttgccacacacaggagctcctggttctccatgtcccctgccaggcagggctgttaaactggaaagccggggagggacgtcgctgggacacattgttatctgatcagagctccgaggccccaccaggagctgtgctattgcagaacctcaaacagcagccgctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcacggattaattttttatgagtctgccttggaacctagacaacagccctctcctctttcagcacaatttcagggcgaatgaccgtcacttccctggactgctaagcgcataaacgcacagggaatttcctagttccacatacgccgttgttcccgcagcccatgcagctgggagagcacacatggttgccgtcgggctgtgtctgttttcccaggagcaagaactctcagaagtgcagtgttgaagcccgagccttccccgtgtcagcttttatgatgaacgaggattcaccatttatttctcccctaaagcaaagcccacgggctctgttttgagcgatggggacagatgctcggtgctgctgggaaggtgttcacggggcagattcgctgtgtcaggagaccaacgtggaatgaggtcggcccagccagtcactgcttaaaaacagtaatgacaatatttgagaaaatgggtggaattttgtggagatttactggcacggggaaggcgtgtggcctctggcaggtctgcgacactgatttctaactacctgttccacagctccactgcctggaaaaactggcaaaaatgtggcctgggtctcctgacaggcctggccattggagtgggggtgtgcagctgagacaggaaatacgaggcgcatgagtgtccccaagcccagatcctcagcctccaaaatcttctattagtaatttcagagctttggcttcttggtgctttgggaaaatttaagatgacgcgtgggctctggcacggccgttgctagtgacctctcctaatagcgcagaagggcctcccaggaggctttcctaggtagagaggggtctgcacgcccactggaacatgctctatcccagcctcagaaaacccacatttggtgcaggtgggacaggaggagtggacacgtcacctggagaccacatgagaagcggccatctgcagcagcaatcaccccgtggggaggcggcgccctggcagctctcatgtggggcctggtccttcctcgctgcctgagcaatgggccctgcttccccgcagacaccgtggtgcccctgggccacacccagcaggtgtccagtgaccgagggtggtgttggccatggcaggtccctgcccgtttctccgaggacctggggctgtgacccagctgggttctcccgggaaggagcggccactgtctgcactgtccagtgctgagggtggcagccatttctgaagcctcccaggtttgtgccctgctgtgtctgaacagctccggagtgcagggtctctgtgtcagtgccggttctaagaggaacgagatgtggtttcagagacactcctcttctctgaggagctgctgggcgggacggctgcttgctttctttgtctgtgacgttggtggctgttccttgcccaggccctgcccaggccagacgtgggagtggcggctgggagcacccatgggcgtgtgcccgtctgggctgggctcgtgtccgtggacctgcctcaagccacacctccctcctccaggcaggacaccgggccttgtctgtggacagaggcgctttgctgggaacagcacagatggcccctgggccctgcggagccgagacgcaccatcatacacacttggagcacatagactgaccaggtctcaccctgcgaggctccctgaggccatgtcctagggaaatagaaggtttcacccggagattggggagtgcagggctgtggcgctgcagggtgcgggccctgaaggaggggcaggggtgctgctggatggtggctcttccaccccaggattcctcgggcccttcacccctgtgtgtctggactgggtatcgctgtagctgtcgggctctggaggtgcacatggctgctgggcgggcagcgctcctgggcctctctcccccgtgatttcggttttgatgtgtttgagccactgaccagcaggcttaggggccattctggagctgggagggcttgtgggggaggcaggatgaacaggggctgcttgccggtcctcaggccaccctgccagctccttgatgtgtctccctgagatcagccagggcatcccggctgtgggtgggctgtgacctgagcccgtcaggccctgctggggtagactggggagaagtgctgagcggaaaccacctcacttctgacaaatgacaagcgctcctgccgcttggtgtcaggcgacgcgactctcagtggcacggatgtctctagaaggttgccgtttctcccttcgtggccgtgggctgtggattctgtgtgcttctggccctggggtcacggggttgcggcgtttcccacttgcctgtttcaggagttgcattctagatgattctctctccatagaaggtcgaggtttctcagcatggattaattgattagatttaattaaatctaaacgtggtgtttccgggcagaatcttcttcagccaaagtgagcgtggccgtctcttctctgggcgcttccaggtgcgttggggcccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggcccacaggtgtggccgggcggcctttctcctccccacctctgtccaccctcgccgaggcgtcggtcctgctgagcagcctctgctgccttcgtgcaggtgacagcgcacgtgccattcacgggcgccatgtctccaagaagaggggctcctgccgcgtgcctgttctggggttgccactcaacatccttccagcaccttctctgggcttccggtttgaatgatctttctccaaagtcggcggaaggggctagaaaagtagggacctgggaagaaagcccagacaccttggagccggggtccgggaaacaggccctggcagctcagcgctgcttctctggagtggggatacaatgttggttcacagacgtgcggtggcggcggcgggtggtggcagcagtgtgcggttgttggcgccacgtgctcacgctgggtccctcctggggagcttctgctccggcgggccacgccttgctgtagcctgcaggtcatctggttggtgtctgggggaggtctggggccccagcccggagctcagctctgagcatcaagaaacccgagtttctccccactcccacccagacagctccccactcccacccggacagctccccactcccacccggacagcagcagctgtgtttggaaggggacacaccagagcttcccttgtagcaagtgaggcacgctcagctggagcctggcagtcctgcagctccgcctgcccccttttgaaaaccaaaaatcccaagagacttatgttgaaacagcccttcccggtcaggactgagcctgtggctgagtgcagtttttcagtcgcggctggaaggtccctgtgcggggcggcgagtccctctagatttgctttacagccacaaattcagttttatctgtggatctgaacacgatctatgaatcactaggaaagcaactgtgttcacgggaaggattctcagaattgagctgacactccgtggtgtgaactcagtattgtcagcttgtgcaccgcgcgtatggacacacacctgcacgcactgtcacacacacttgcctcgggcccccacacacaccgccctgagagctaggaagacgaatcggtcagtcacacggattctgcagacagcttccttcaccaggcatggtagtgagggcagcgcccactactcacccagggcctctcgtgcaggaaactgcatggacacgtcgtcctgttcctgtcatgggaaggggcctggagccgtccctcggggggtggggaggagctagtttcccagtcggcgcccgtgcattcaccggtctgagaatccactcagcaggcttgctatgtaacctccgccgttcaggcctcagcatgcagcaagcccgtggggtcccgtctgcccagcctctgcctcggttcctgccgggcacatggacgcttcccttgaatccttctgccgacggcatctgtgggagggcaggtacgatcgatcctggtcctgtccccctagccctgggcgggtgtcccggcacctccaggcacaaggccccttccccaggctgcccagagaccccagccccgaggtgctggtccgcccaccctctctgggaagggctgtgccacatggcgaaagctgctgtgggtcctggtacctggtgtccctgcctgccagggctcatgatgccaacagtgccaggtttgtgggatttgggggtcaggagggcctggccctgctcctgcaaggccgagatctgttcccttggagggttgagggagtgttggctgtagggttcctggaggcctctctcatgcactctgggtctgtcaggaggctggcaactgtggccaaacaggtagaaataaaacctgaaatgagaaaaaaacttttttctagaacttcccagagagcagtgagctggtgccagtgggtcagaggcttgtcacatgtggtgtgtgtgtgtgcgtgtgtgtgtgcacgctctgggggggtgtgcacatttcccagtgtggctgtgcgtgtgtgtgtgcccacgtgtgttcacagaacaccaggctttgccccgactcctggctcaggcctgagtctccagccatggcgtccccgttcctcccgttccttctctgcactgcacactgggaaccaggacaagaggtgtgcggcgtcaggctgtgtccttcccccacccaccccgagcccacgctgctctggagggagaccccagcttcccccgcctaccccgagccctcgctgctctggagggagaccccaggcccctcaggccctttcccgcatctgaaggggccagggcagggcgtccggcagatgaagctgccccttaaagccaggtctgggccggtttacagggaagcactgctcacgtacaacctggcagaccacaccagcgccgcacacacaggcacccctgtgggcacccacgtgcccgaccccgcagaccacaccggcactgcacacacaggcacccccgtgggcacacacgtgcccgaccccacagaccacaccggcgctgcacacacaggcacccccgtggccacacacatgcctgcacacgcacacttctggtgcacacgcccacactcacggaggcttctgcacaccacacagccagcaggtgaggaagtggacgctgcgtggctgtctcttggtggcttcacctggaatgtcaccgtggaccccagagcccgaagccccggcaagcacagaaatcacaccggcagcctgtcccacttcgggcaggtgaggcctggctgagaaaagggggaaggagagggaggatgcgggggtgtgtcctggtcctccacccgtttcgggtttggggtgctcccttcgactactggctccatttttgatgtcttttacttttgtttcgatttttcctggtatcttgagtaaagtctccctggagcatcaaattggatttttcttacaagtaccgtgtgctgttgactcatctgctttggtgtgccgtgggtcacgtgggcctgggctgtgggtaaggtgggcctcgttcctgcaggaacacctggctctgcagcagtggctgccgtatcatcctggccaggcccctgtaccgagggtggagccacggggtctctgatgccttccttctcgtgctttggtggagaatgtggctggacgtcctcccatgacagatgcactctcctgcctggttccctggccccgggcccagccctgagagacgcaccacggccttcacctggaagtgtcacctctggctgctgttgtgggtgatgaggattccagggctgagaagaggaccctagacgctgttcacacagcgtggcaatctctcaaattaatccagcatggggggaatcggggttgaaaccggtttgtgagccggattttctgtccctgtgtacttccttggggcaatttgaaaaatgcagattttactcgtaggccctaaatggataatttccctttaggctgacggctgctcctgtgccctgcctggagagaagcctgactccaggtcgccttggctccgtttctgtgcagcagctcagactatggggtggagggtgagacattcccacccgtgagctgcctctgtccaccccacacctccctcccctgggtgcacgcagctgagttccacgttgaataaatttggcctcaatcatccactacccaccatgtcaccgtgtaagtgctgaggtcagcacaggagctaaaaacaaacattgtaacgtgtaggagactcagtagctcttatacctcggcagtggaataagaataatacattttgtttagttaaggttgaggcagagggaggtcattgttgtgacagggaattttataaataggattctgacaggttctgtactgtgccagaggcagaaagcccatgcagtggggcccgtgacgtatttaaatgacttttcttaaaatgaacttcatgttttaaataatagatgtttacctcccaggtgaaaccttaaatattcccattttcactgaaatggcatgttttttaaaggatacagtcataccccaaattcacagcattccacacaccatcagagaactgccacagggatcctgggggaattttaaattgtagttttaagaccacgtgaccctggagctgccccggtgcccctcccccaccccccgaggtggttttggtcagcgactcatttacatttttttctatgtaaattaaatttttaggtattaaatctcggaaaatggaatactgcgtggcagaatccgcctcttaatctgcttttctttttacatttcccatcataaagatgtttgagtcccacagagagttaaggtatctcgggaagttcattaacttggcaaacggctggagtctctcttccgaggagctgagggctggacaggcaggtcccagcgtcccccgtcctgactgtttgtgtggagacactcatgtattcatatgggaaggggggctctattggaaagggaagggctttttgttctgcagagttacgtggtcttagcagtaatcactttggagtgggctgctggtggccttgggtgcagagactcctgtgggcatctgcgcacatgggggctgtgtcctcatccctgtctgtggcttccccaccgtgttcccacgtgatgccttcgttcagcctctggctttgtgtttcagaccccaaacgccccttcgatgtctcagctgggacctgggtcccggctcagcctcacgcggcgtcccagtccctgcccatcagtctgggcctcacggtcaggccctcagtgacagcagccgtcgcttcactgtggcctcgtccctggagggctctgagttcagccgtcgcttcactgtggcctcctccctggcggggctctgagttcagccaccggtgagattggtttgttctttactgtggtgaccacacggcggctgaggctaagctggagccacggagcaagggccgcctcttcgcctgcccgggcccctctagccccatcttccctctgcccactgacatctgagaatccgccgtcccctggcccgggctcccccgccttctccctcgcctcgctggccctgagtgggcagcaggcatctgcgtggtcaggggcaggcgtcgcattttcctgtggctggaacgtgcctgcaggagcccaggcctggactctgcacgtggtcatcgtgctgcagttgccgtctgtggtcaaagattttaaagttagtttagtgagaaaatcgactccaaacgtgatcagaggggtcgacgcgtcccaggatgagtggttcccggggctgggcgttgccacgggccttgcatggattttgctgatgaatctcagggctctgaggctggcgctcatcgggccccacttgggggatgcagaagggaaggcactctgaacgaggggccctgtgggaggccccactgcgcaaagggtttgactcctgcggcctccctcaaggcctttgtgcttgctttgagaatcaaacgttcctgttccaaaccaaacttgcctcttgcatatggaatcagactatagtgattgtaaatggtagcgttaaagataaaaacaaacagttctaaaaatgactcactgctgaaggcggaaccacgcgtggtgcagagaaggagggtgagagggaacggcaccacactctgtgtttacctctcaagacgctgatgagcaactcatcccacagaacagctggtcctgaacatgtgtgtgccctgccgtgaggcgcacaccttcccagaggcgtgagtggggcccggccactagtgtcctggcggaagcaccggggctgctccatttgtctggagtcctgtcccagtggtgtgggttttgagtctcacccacacggcgccggccgagaagccatgagcggctctgcagggtggtgcggactatagacacctccatgcatggttgccctaggcagtgtctgccgccagcgtctgcctctggacactagctgctcagccaccaggacggcgttgagcgctcccctgcctctgcaggaggagaggggcagggagccatcaggaagggtgctggggcctggggcccgtcgtgctgtgtgtgtgcaaacgcagtgtggcgtcccctgatcaggagtgggagctgcgcgctgcccggttccaggttaatggaacacaggaaggtgggtcatgtcctgcggggcctcatctggatttattggtgaagcgagccttgcacatggctcagcgagggctccgctttcctgcacacgccccctgccagcttcactgtggcctcagaatgggcacacacagcaagtgtggatgcatacgtgcaaggcccgtttcaaagcctaaaactcagtgcccaggtccattgggataacaaggcattttctaatctgatttacaaagacaccagtatgacatggcagagaaataaaaagggggcagggcagggggacacaggcctcgaacccgccgcaggttttctctgcgttccggtgactcccggcggtctgtgctctgggtgctgagcaggtgttttctgttctctcgccagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtgtaagccgcgggggacctccggcctctggcagggggcggtaggagggggcgtgcctccctcccagtcccggggggtctggccagccccccgcacttccaggctgcgtggccaggacacttttggtttaacagccaataagtaaacttcactcttgcttttgacaatggatttgcttctctctagggtttcagccctgtgtatattgccacttaaaatgtcagatatgcagctataaatacctccctctgcatttagcttctaaacaggacccctatttctttccgaatacagcagtgtaatgagaggatggttaaaacgtgagcatcaaaaaattaaagcagtcagcacatctggatcacgttgacctttaggaggttccgacaacacggataggcctgtgctgatgttctgagtctaatttgacactgtaatttgtttaaaagtgaattttttagtaaggtgaggacgaaacatgtaacttccaaataaggccttactcacttaatcctagcttgtgctgggcacgctggccctaacctgtgaaggcagccgaggaggaggactgctggttcccgagagattgatgtggtactgtggggggaaccgaaaacagacacatctgtgggtgaatgagtgcaggttgagctgggacggctggaacgtgcagaccagcaggatggagccaggccggagggcagggacggcgtcctgcgagggtgacccgcaggctgggagcccgtgtgatggggaagctgtgtgtggggtgccccatccaggtggagccccgggggtgggtgcagaggtcctggggctgcaggagtggggaggagtcccgcacggtgagggagagcgtgtaggagatggcggcggggggccacgttggggattttaataagtgattcaaagcctgtaagtcaaaaagggaaagctttctctccacgttgacttttcaagcactgggaggaatgtacgcacctgggaattcattccaaatccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgcgctccagccctgtgctggctgccgcctcgtgggtggtcggggagtctgtgtttattctcattctcttaacttactgaaaaatactgctttttagtgcattgagaatgtatacatggaatgttttactggagtctagttttgaatgaaattgttaagaggttatatgaaaccatagaaaaaatgggttttacacacaaaaaatgagggcttttaaatatagtggaaataatagaataatttattctaattatgatttattatatattttatataattataaatatataatatttaacctaataatatataatatataattattgtaaatgataataataaattgagctttttgggaactactccaagataagtgagaacagcaggtgcctctggcccctcccctgggccgctctctgccgctctggtgacatccccgtatacgtggccagcgtgggccctggaggcagccaggacttgggacagctccgactggacccgcttggtcaggggtggagggtggaggctggaggctggaggaaggtgggaaggggaaggtggaagtggcttttctcggggctgcctctgcttgccccctcgcctgcgccaatgtcagattctctcctgcactaggcaagggcctcacgtcgctggcttcaaggtcttgttttccttggggaaggggagagtggccagctgcctggcacgagctcgtggggctgggatgagggccagagggtctggggggccaggcctttatgctcccgcgtcagccattgaaagaaaagctgtgggcttttgttttgggcagcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctgtaagtggacgtccacgcgcccacaggggaggaaaccgtcccgtcacatgcgcttcactgtctcaccctctctcagcttttcgttcgtgtagacttgggactgaacggttcccaccaaacccaccacagtgtgtggccacgaggggtctgagttgatcatggctgagttattgcctgtggcctcccgggggcccctggcgctggctcctctgatggctgagcatggccagggaaagcggtgtgggccggggcttcccctcacgctgcgctgacctttgcgtatttgtgcgatgactgtgatttgagtgaaattggctgagtcttaggaagatattttgatgacttcttcagaacgaggtggagaccatcaggatgaagtgtgcacggcttctcccctagaagtagtggcatccgcaggggtcggcccgcaggtcgtggcggtgcttgctctgggtgggtcggctcacgtgtgacctgctgggtgccacacgtgtgccccaggccgcccactcaggacaggccctcactgcccctctccttctgatgcagcccagcgctcagctcaggagctgcctctggtggagaagcagagcacggacagctatccggtcgtgggcgggaagaagatggtcctgtctggccacaacttcctgcaggactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatactcagggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggctctcgtgccccaagggcacaggtcacccctgcctccaggtgttgcgctggcccagcctggaggctccggggctgaacttggaagggcagcaggggtgtcctcggagtgatgttcctcctggggccgtcacgcctgtggttctgtgctgcccacgggagactgtcctgcggggattgggctcacagagtggctcccagcccaggtcagttccatgcagacgccgggccccagcactctcatcccagaggggtggcctcgccggctccgagcagagtgtgtgaagacagtgggctgcactgatgggaaactggcattgcagggagagtgggcaccagtgtagctgggcacagggaccctagcccagccctcaagggggttcaggcagagtgggcctggctctccgcaaagcctgccgtgagctccctggttttgggggttcctggtgccttgctgggcctctgcccagggtgcgccaggtgaggggcatgcccccacaaggcctgttttgtgatatttttttccttttgtacacttaccaattggaattcttttgcacttactccaatccctggaaaccgcggaggcattcagccttgataatggggtcttgatttgtacagtttgccggaaacttaagtgcttcaatcaaaatcggctttagaggtctttgactctaacttggcttcctatagaatcagggcttaattggaaaacatgttttaaattacagagaaaaccaactaagggcagtgaccgggaaggcatttgcattgcccgtgccttctcgggaggaggctaattttgaaataattttcccttcagagctttcggtgtgtgtccacgcgttggcggagaaacacttcgcccacagtgtagggcctcgcttgggccaagactggccagaaccgtggctcccagcttctgcttttcaaagcccagacctgagcagcctccttgctttttcttctgcccagagaggcctgggcaccttggcagagcctccccccgaatgcagtccgcagaggtgccccagctcctgccctagccaagttactgtgctgagttggtgccacggcgccatgggtaagggcagccaccagcctgcgagggccaggagccaaggggatgcaggaccagccctggcctcatgcggccgcccctacaggcagcccctcctgccttcatcatcactgtgagctgtggggtcagcaggccggaggggtacctgttctgcccttaagctcggctgccacagccacacttctgggcaatgccagtttgtctgcccatgtcctcctcttgtcccatgaggtcagggtgggtctctgaccctctgccagcaccagccggcgtctggtatacagcaggtgagccataaatgaataggtgctgtgctcgagagcacgtgaagctgtgaatactgcagggatgaagccagaccacgttgataattttattctttatagttgaataagataatttgcatattcatacacacacaagcacattccatgttttcaaaagtggagaacaaatgtccacataattttcttcctccacttccggcttctcaggcgggagccgttgcttacaacacgtgctgatgtgcagtgacaggttggtgcagcagaaagccccacatcctcatcctggcaacgagagaaaccactaaactgaatttaaattaaaaacacagttgccctctcgttttctgatgggatcgtctggtctgtttaaagttctgttttagactgctcttgcagatggaaccagggccgggtgtgagctcaggaggggaggttcctgctgaggaaatccgtcagtagggcagttgaagtggcttctccaggaagggcccctgcgtctctcgactgtcctgctcattccgagggtgcagatggttgtagctgttgggaatgttggctctggacacaggccagggtcggctccaccctgtccttctctggagtacgtaggaagctcattgtccaggccagctcagcctctgcgtatcagccaggccaccttcagctgctatgggttcacagcatctctgagctttgggaagttttagatggagcggctccactgccctggaaggctgggagaagctggtgttggcctcatgaggaagggagtccccgcagcagggctgcattgcggggagccggccgggcaagggcatggctcgccgtagcctgggtgccgggtccctctgggatgctccagcagggcaggaggagggtgggtgtttgagtctcagcctgcgctccacggagcttcctcccaggtgtctcagggcggcgcaaaaggccgggagcggagtcagcctttctctgaggacttagtttacagcttcctcggaaaacgacattttccgatgatgaaaatctgtgaggaatgttcttccaggaggcaggttggctgtggggagccgagggccgggtgttggtttagaagcccctggtagcatcacaagaacccccagtttccaaggctgcaggggttcagctgcaggaagtgggaaccacacccctctcccacccacacccctccccaccttcacacctgcacccctcccgcctgttaaagatcactgtgtctgtgttccgatgtgaggcacctctctgtacacgcgtgaacgttgaagctgctgagggacacactaacgttcaacataaacgaaacgcccgaagaacgcccgcgtgaaacgtgagctcgggctgtgtctagagcctggctgagatgagacagaaggcgcaaggttctgagatgtggatgcatcaaacatgagccagttctcgatgctggagctgaacaacctccttttcttaagtcacgcgtctgttctggtgccgttttttaaaaacatcagcgaagcctgttttggtgtcgctgcgcggaagccacactacgacgccgggggtgaagactcccactccgtttgccagcgatcgcgcagcgggcagggctcagcgggtggggctgcacgggtctcgtcagtggtcgtttctgtggccgccgtgactggcaggccagctggggcctggacggccggcgtctccttctccaggtaatcagggcccctctacgtggcctcccggggcccctctggggaggcagcctggcatctcacaggcggccggggctcccgggaagcagagacgggctgtgccagggctcctaggcccaggcctggacccagtgccgtgccagccaccaccccaggggccctgccctggttcgcagggagacacacagaaatgtgggaggccgggtggcctgcacggtgggagcgagtagacagagcccctcccggaggcccccagcccagcacatccagagccctcccctgagaaaccccagacagccaggttcgccccaaacccaacatggtgggaccccagctcgccccccatctcatggccgccccatcccacggccgccccatcctctggccctggatgttaccacgtggagaagacaggcctgtgggcaggcactagccacactgcaggagacgcaggctaggtttccagatttctccacacagcagcaggcggagggcctgcctcccacctcactgggagggccaggactccaaatctgggccaaatgtatgttgttatttttcaaataaagggaccaaaggcccgggcctttccaaggctgccctgccatgggaccgtgaccggtgtggttcccaggacttccacaagctctgacaggcacctggccgttgttttgggaggctccacccagcagccacagagcttagctggcagctggcaggacacttgcaaggacacggaactgtcacggaaccaccgtggctttgggctgtcacggaaccaccgtggccttggcagctgctggtcctatgccgggacacacacattcaccgcggcgagtgtggggtgcatgtccccaggcagaggccatgtcatccaggtgcaggaagcgccaggcaaggaccctcctgtccgcccagagagccgggtcagaggagtccccaggcctgaagccactccctccgggctcaccttcaggttccttcaaggccagggggaggttcacccaccccagggtgtcgcggaagccccgaggcccctgcaggccccgatttccccagtgaggcatcagtgcccgctggccaccctgcccctctcctcctccagctgcccctgctccttgttttcctagggtctggttctttctcgcgggcggggaggaggtgagggtcagggcccctgtaaggcagactagtggcactgcccctttcggcccttgctgtccctcctctgtcccttgtggaaggtctcggcctggggcagaggagcgggccgaggaggaaggtggagtccaggtgggtggtggggtctgtgttctgttttagtcgtgcgggatgtaggccgagggagatggacccgggggatggctgcctctgtggcatctccgtggtgtgccctctgacggggctgggtgagcaaggaggacacagctgggaattcccagctccagcgtccgcggcacgggcagcctccctgtgtggagcagctcagctgtcacctcctgaagatgttggatgctggccccgaaggcagcatcgcaatgacaacaccttcagaggtgtccatcccaacagtttaaaggccaaatgcagatctttcagatttgtgttttcagggagaaggtgacattgctgggcgcctgtgagtgtggacagacatcactgtcgccgtgtgctccgagagaggagagttggggctgctttgtcaccacatggcgtctttgggagcaggacaggtggccgggctgaacccccaggcttctctgtttgctcccagagaccacacagggaaggcaaggagggcagcgcccggggaagagacacctgcccgtgtcttcctcatgccctgaggatggctcagtggcccagatggtccaggacccctagaattgagtgatgaccccacagttctcatcaagccgcattctggatagcgctaggggcgactctcagactccccctgcctgggccccgctggtgtggggaggccacgcgtcacgtcagtccccactgcaggaggaggggccgggcttctggctcccctccctcctctcccttctcaggccttttgggatcatacacgacaaagtcacccatggtcatgttggctagtttcttttttatatcagctttatcgaaatatgatctatacaccatttaattcactcaaagtgtataattcggtgggttttggtggcttcacataattatgcggccaccaccaatttcagaacattttcttgtccccagaaagaaacccttgcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtctttctgtggctgagggaagcccaccgtgtggctgcccacacctgtctgtcgatggcactaggccacgtccaccctgtggagatgatcgtggaaaagccgccatgaacctcagtgcgtgagtcctgtgtggacgcctgcctgtctcctgagcacatgcctcggtgtgaaagggctgtgggtcacagggtggctccgtgtgaggccctgcaggcagatgtgcagcagggctgggtggctgtttcccctccagaatctcctctgggagccaggctgggacagactcctgggggagagccggggatggatgagacgccccagggacgctcgcttctgggcatgaggatgctgtggggtgcacggcacgaggacgccgcggggagcagggcacgaggatgctttggggagcagggcaggagacgccgtggggagcagggctcgagggcaccgtgggacccagggacgctgctgcttccaccagcggccctcgtggctttctttgtggaaacagtggctcagcatcagcaccggcgtgggggtggcccggctccgggcggcgggtcctggccggtctgggaggctcctgggcccgcaggcctgcctgtgtggaaacctcgcgggtgtggcagggaagcctcccgatgactcagactgcagggaattccctaatgatctggaatatttttactcctgcactcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcagcagtctcggcgctttgtcttgttctggaagcaattgctagatagacatttctggccgtgaatactattgcttttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctgcgcaggaattgcagggtgcgggtgctcccaggtgtgcggtggaggctgctccatggcagctgctgagctgggcctggctggccacgcagacgtggctccccttggggccgctccggcaaggatggttccccacaggcccacgaggcacgggtgggaaaagacgcctccatgccgtcgttccatttgcttttcatggactcaccgctgcggggcagccacctggaggaggccgcgggggagacggctggagtccctcttgcttctcgggacataaagagaggagcaggctgtgttggcctcggctgcaaaaatggcgtcccctcggggtgtcattaaacgcgacatcctggccccgtgtgcgcctcagtgtccctcctgctcagcacagtcactgaacctccctccccttgccagtgccaaaggcctccacagcgtcagggaagttcctagggaagctgaagttgtgactctgagcttcctgggctgggcgggaagcaaactatagcctgttgcgcccgggagcttcagaggaccacagccttttgtggggtgtggacggggcctcaccccaaagatggactttgtcataagaaaagttcaaaagtcattttcaaaaggtgccaaacaaccagaagacttagttacacacagagtgatttggatttttatgaagtgggggtggaggggcttctgagtggtgcatctgggctgggggcttctgggaatcctgtggcatcagcacctgtgctggagtgaaaacgcctctttcttcccagctcctgagctttccagggcctggaggacttgctgcttcatgaaactcagatggcttcaagcgcaactgagtgtactttttagtttcctgtaatttttttcctagaggagagagggatgccaggctctatcgagtgggttcatctggtgggtaatttgcgtggggacctcgggcctcccgggctggcatggccagggcttggctgggcggctctggggtcctgtgtgactcacatttcctctccaccctccacccaggcagcagcccggcactgtaacagagaaaaaggagattttgtctgatttatcagtaattgagggtttgtaacagacacacattttcttctttggagacagagcataaggataaacttaagtgtgtatacctgtaactgttcattttgggaacagactttattttggagaagataaaaggcaggaagagactctgtaggagattgacatctgttaatttgagataattgccccaaactcagcccatctgaggggccaggccgtgcacacacccaggctgtggtggggccgccttgtccgtgtgcgcctggagcccccactctgccaggcctggagcagagagcacaacgcgtcctttcactacacctctgggagcctttttattttttaaaaacatgcaaatggccactggggaaatgccaaaaatacctcgtgttttgcatttctgtctcctgatgggcaagaagttgtcagaggaaggctcttctcatttacccagtggttcctttgcacacaggcagggccagcggccaggccctcatccaccagagtagaccccagcacgagcaggcgtcgcaccctggcgtggagcccccggccccccgtcactactctcacacctcctgcatccctgggaggctgggctgggaactgcagagccgggtcccaggtccacgcacagacgccctgcacacgctctgctgatggggtacctgctccccctcacacctgctctccctggagaggacgagggcatagagaccctcccgtgacctgtcctgaggctgtgagaggccagcagatgcagggccaggacggattcctgaggatgcccctgccctgtagtccctcctacgccgggctggggtcagaacaagccctgagccgcgtgtcctcagcttctccaggctcccagggcaactttggtgtcgagctcggggccctgccagggcacgtggctcctgaggtgctgccctcgacaaagccctgggatgggcctacgtgggtctcctgggacaaggcgccctcctggctcagggccctgggtctggatcacgtgggggtgtctggggagggggctccccaccacacagagtcacagacgtttcctgctcctttcttccagatggccaccatgtctgggagatggaagcgaaaactgaccgggacctgtgcaagccggtgagtgcctttggcgcagctggagctactgtgggtccccagggcttgggaggctggggtctgctggagccactgcgggtccccaggccttgggaggctggggttcctgtttcttagaatgaaacaaataaaaatagtgcatagagtaacagaaccagtaacaaacaggatcaccaagtactcgccaaagcaccatgtgctgtcacccaacgtgtcaggtcacgtcagagccctggcggccggggacggtgctggacaggctgagggccacctcacacaccctggcgctgagacagcccagggaaggtcgtctcacacggaccctcccgccctttgctgtccccttgctgtcaccatcacctggcacagagcaggctcctgggagtcagtgctgtgctgagttcccggggggtggtcagcacctgcccagacccgctcacagcaccgagggcagggctctgcggcatccccagtggggactcctcaccccgtcctccgaggccactgattgcgccgacctcccctgtgatggtgtcccaagcacaagagcctgggcgtggctcctggactcgcgattggccacagcctgttagcgggcggtgcatgtgtgcggggtcgtggcagacgcgtggctgggtcacacttctgctgtcaccgggccgtttccaactcccccagtcacctgccacagcttccctggcaccgcgtgcatacagccggtgcctgaggataatgaccgtcctcggattggagatgaccttttgtgtggatggctgtagctgctcccacatctcctgcacggcaccggttgctgcgtgcatctctcccatccctgcgcttctgatccatgtgctcatgtttaaagtggtttcttggaggcaacgtcttcttgggtggtgtcttggatcctctctgacgctgtcttgtaattggcacatggagaccattgatgtttaggtctttagttttgtttgtttttgtttttttgaaacagagtttcgttcttgttgcccaggctggagtgcagtggcgtgatctcggctcactgcaacctccacctcccgagtagctgggattacaggcatgcaccaccacgcccggctaattttgtaattttagtagagatggggttttgccatgttggccaagcaggtctggaactcccaacctcaggtgatccgcccgcctcggcctcccaaagtgctgggattacaggcatgagccaccgtgcccggcctgatgttcacttattattgatacagttggattgatccctacgttggattttttgagtgttctgtttagtcctataaaagcagtagaaatctctaggccaacataagatgccacatggctcacaagggagttttgaagacatgaacatgcttctgagctcagcagtgtgtgtccctgcgggtcagggaagtcttgtgcacccactcagtgtgtgtccctgcgggtcggggagtcttgtgcacccactcagtgtgtgcagttggaagctggtcccttcagaaacctcagggaagagcccatctcgggcggctggaggcaggtggacaggacaccggggaggagtcttgaggtcgtctcctgttggtgggacgatcggtggcctccatggagagcggtgctggcaccttcactccctgtcccaagaggtggctctgtcagaaagcagcgtcttccaccctgcgacttcagcgcccttcccccaaggacccatccccttcccagaaccttttccaagtggttatcagatggaaaaggttcctccctggccctgggtgaagtgagctcacctgcaccttcagtggtgctcaggcctcccctgaagctcctggcactcacagggttccagttcaatgctgtcgcttttcttgccttcacctgagaagccccttgaggaaagctggaggccccagggcaggccagtgttcagaggaaggagtcccggcctacacggcccgttgtccgcagagccagtgagtcagggtgctcagaagggtcctgggaacggccagccacaggcaaaggcagctggagctgctgtaccggcctctcctccccgcagcctgttcccgtgtccataccggcctctcctccccacagcccgttcccgtgtccataccggcctctcttccccacggccatttcctgtgcccataaggtctgtggctccccgctggccgggcgtttgcaactgcccagggggctggcagccttcgtccatggggtcattgccaggcctccccacctactgggtgtctgattcgttcctccccactgggctgcccttgctctgctgtgcgtctgtgctgggtacactgacatctggctctccgtccctctgcctgcaggcagtgtaccctggtgcctggcctcgtgctgcctaccctccctagccctggctccgtcggggtctccacaggcttcgccagccccgcacatgcacgcgggttgcgggatgcaggatgccggagctgggctgcccagccgctggcctgccctgtccccctaggcagggagagcagccaggaggagccgtgagcctttctgcactgaaaacaatcccagccaagctgacatccacattctctgtgattttctgttttacttttgacactggcatatttcgagggaagcttaacagctgtatgttttaaaagaaacttaagagcacatgtgaaaaattgtgtacttcaagtttactggttgttttttgtttgttttttgtttttttgagacagtctcgctctgtcacccagattggagtgcagtggctcgatctcagctcattgcagcctccgcctcccaggttcaagcgattctcatgcctcagtctcccgagtatctaggactacaggcgccggccactatgcctggctaatgtttttgtattttttttagtagagacgggatttcaccatgttgtccaggctggtcttgaactcctgacctcaggtgatccgcccaccgtggcctcccaaagtgctgggattacaggcgtgagccaccgcgcccggcctgctgtttcatttttaatctcttaaatggagtttgctttaatatatatattttctcatcataaaggaacttcatactcatcgtggacatttggacaatataaaaaaggaaataaaacctagtgtagtctcaccaactgagacataaccactgctggcattgggcatgcgtcctgctccatttgctgctgtgtgtggatgttcacgcagacacacacacacacacagagtacattatattgtggatatatgtgtttgtgtgtgtgtgtgtgtgtgtgtatatgtatgtgtatatatatatatttatttatttatttatttttttttttttgagacagggtcttgctgtgtcatccaggctggagtccagtggcttgatcatggctcactgcagccttgacctcccaggctgaagcagttctcatgcctcagcctcgccagtagctggggacacaagtgtgccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcatattttgtgaacaaaatgggatgtgctgtgtctacggtttttgtactttctataagtaagtgtatgagcttcatctcaacagtggagtttaaagcaggttgcgtaggtgctggtgccatttggaacccgtattttttccggtacagacgagtttccctctcccttcctgttcttccgtgtttcttctttatcgcttccttctgtgtgtatttaagtggcagtgctcccacggagatagtatttttgtcatataatttgtctatttagagagttgaagtgggttggcctgtgcccacatcaacataggcccttccagtcaggtaggacttaggaaaactggcatgcaccgtccagcatgccccacagggtcccacctccacccatccagcctgcctcacggggtccccgcctccacccagtctggcccacaaggtcccgcctccgcccagccagcctggcccacggaatctccgcctctgcccagccagcctggcccatgtggtccccgcctccacccatccagcctgtcccacagggtccccgcctccaccccagcctgtcccgtggggtccccgcctccccactcctcgctgctgcctgtgagtgcctcccggcccgttactatttcagtctcggcttccatgagacgtttccttcttgtctcttccctcagctgcttctgctctaaagacccacctggtgtagctgctgactccatcgcagctgccctgagcactgctgaattcagaaaacagccttggaggaagcgtctctttatcccccgtacaaatgccgagacaggctccgggtggccagagcttcccgggtcagcccaggagatggcccagacccacagtgctctgggggcagcccaggccccgcccactgacagcactcatggcccctccggcggcagcttcagctcccctggggcagctctgatgcggggcaaaggcaggaagacgcccatgtgccatggcttctgcttcttcccaatgaactgcagttaattaaacaacacagacctgctgccaggagaaagtgtggcccctgggcacagggcccagtggggtggggagcaggggtgcggggagggcatggcccctctgcatgggtgtctgggcctcagctgtttcattatttgtaaatgaaagagcctggacctcaagttgtcttcagttttctgtctttaacactcttaagatttcattgttaatgtgattcaatcaatttggctaagttaggtgctgagctataattaattattttaacaaaagaagtaatacaatggatttttctcctgcttgttaaactaagtcatatgattataaaaatgaaactttatagatgcgactcccgccaaccctctccccagataccaagtgccgccctcggcagggatgcctgcatcaccccagtcatttagggtcatcaggggcccgagtaacgctggggcctgagcacgcggttggggtctccgtgtcccagccccccacccagccccgacctctgcgaacagcgccacacgtcccatggcttgtgtttcatgtgtatacttgaaggagcatgagtttcgtaaacatgctgctggctgttacattaaaaacatgagaaggtaacggcagcctccacacgccgccctctgctgtctgtgcctccgtgcccttggctgttcccaccccggggtctgcgggggtcagggcctgcctcctcttcctcagttggagtgaatttggggtctgactgagggcctcggccatcgtcaaatgtgacaaacacaggccctccccagagaccgcgtctccaggaagcacctgctcctctgggtttcgctgcagtcacctgagcaggtgctgggccaccgagcacttccatcacacagtggctggcggcggagccttgggtcgttttctgaaggtcaccaaccctttggcatcagagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagtcctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatacaaaaaaaaaaaaaaatcatcttacctttttaacctttagggtgttttcttaaagaaaataccatccagtttgtttcttcagtccctgaaccagtagaagagaaaggcgtcccccacgccatccccggcttcctttgtgggtacaggccactccccccagctcggagaggacagaattagcagtcatcctgaattttactgtattttgtgggtacaggccactccccacagctcggaggggacagttagcggtcatcctgaattttactgtattttgggtaagcttagctaacatcaataatctttttatattgctttttttctaaaaactgcagagattcctgtcatctgagagggaaattacacactgggcgctaattgcaaaagcagctgcgttctcttagtaaaatcagggtgttttggaaggtttccattttctctgaatgtaaacagcatttgtaatagaccagatcctaaggaagcccttgaatccccacgttcacaccaaactgttgggactccttgtttttatcaggcaagctctggaaaggcctctcaagatgtggaaaatggggttttgctgtaaagtcgctgtaccctaagagtgtctgtgagacagagctgcaggggtgatgtgcagcccccagcccagccctcgcggggaagagcctcacgctctgtgacccccaggattgtggggagggcctcatgctctgggacccccgggattgtggggaagagcctcatgctctgggacccccgggattgtggggaagggcctcacgctctgggacccccaggattgtggggaagagcctcacgctctgggacccccgggattgtggggaagagcctcacgctctgggacccccgggattgtggggaagggcctcacgctctggacccccctggggtttacgtggtctgtgccgcccacacttagtgagtccagcccattcttggaacaaagtacaatatatcttacagaagaaaatattttatctttttctgaaaatataatgattgagtcctaattaaacttcaagcatggttgaccagaaattgaatgttttaaagaaaacctaggccttatagagaaggattgctttccagagcagtgcattaatttttttcttatttgctcagcatgcggcagtccccaccgtgggtttgagcagcactgactttagcacagatcacgtatctcagaggcagaaggggcgtgcggggagcgtgcctgcccttcacaggtgggaggtggcggcccccaggaccgtggccacagcatgaagccggtggggctgagccgctcctgctacctccagtccacaccccacctggcagccggccgtcctgtcctaccagccacactcctgcctcgattggccccggctcccctctcagcattgtgcccagcgtggacatctctcctgcaccccctgcccagtgtctcggctgcaccctccaccccccatctgctccagcatggctcaacgcaggccaggttccccaggctcaccctgggcaccagccttcgcccgttctccctctctttgcctccgtcgtctcttctctcctggacgtagcaccatagtccctgggtgaccatcccaggtccccacaagcacactgaccagccccaccagcccccaggggctccccggctccctgtcaccccacctggtcctgggggctgcgaccgcaacctgcaccagactgtgagcccctcaggcagagcccccaggctgccgcagggcgagatccccagtgttgacgctgggcctacctcgaggccactgtcagtgtggttgttaaataaataatgaatagaaaccagcacccaggtatccgtgttccgtcccgcgtgcccgctgcacttcctgcctctgcaaccccggctgggtctgaggacgccgaggccgctccaggacctgcgtcctccgtgctgtgcatctgtgtcttggggtccagctcagatggcttctgccacgtggtccgagagatagttgccagctctgcttctgccgaccctggaggtggaggcaggacgggtgggtgtgggtggaagacagctgcttagcaagcaccgccctgactcaaagctgctcttggctttttcccttttctacaccgtcatcatggggtcgttagcagtctaggtttccgctgtgccgatgagcttcgggtctgcatgcccgggggtcacggcagtgaggggcggactcctagggttgtgaaatgtgccgttgaaatgcacaaggtgacaacagtgaacccacttacactccagctgtggaattcatttcacgtacatgtttgtaaagtcaagtctcattgtaggttttccttcaaaattgccatccccacaggcagcacagggaggcccctccgagagctccaagcatttggaatccaggtgcccgaggtgtccggtgcttgtggggggcgggctggggacacgccttggccaccagccgcccgcactcctcgtctcagtgccaaaggcatcctccgatgactcggccgaagatgagctcagtccgcagcccctgtcccggccccgcctcccgtcttcagggggcctcacgtctccttttgagtcagaaggtcgcagtggtcggcctccgggaatcaggcatctgagtgcagggggcccccgggctcaggtggggctgacacctctggctgatggtctgtgatggggcccagagggagagttcccttcaccctccctggggcggggggcaggcattaaatggggagaagttcccagcagaatgtatgagccccatgaacggagtgggcatagccctcggggagtcctgccggccgcccctcctgacatcccggggtgctgcccggtgaggaaagtgaaaatgttgtctgcagttagaggctggaacacacatgcccacagagaggcttcctgagcggcttgtctgtcactgtttttgtgtaactgcgcctgaatttaatctcccggaaggcgcgttaggagggctgagggatgatctggtgccaggaaggttggcagttccgagaggttattccagcacgtcagcattaaaggagagaggcgaacctggaacgtgggaaccctgcccaggtctggttagaaaggcggcgtccgcgtggcctggggcttgtgtgaggggtgcacttgtgcccccagatacaagcaggcagggccgggaatctgtctcgtggggggctgcgggcactttggagaaagaaaaccaagttacaaactcaaaattacctaccaaagtcagtatttttttaaacgagaaaataaaacatgacaaatgccaggtctttttgtctgaagtcgttttagtcggttacctggaaacgctcccagggcccctgagctggggacacggagctcttcccccatcagtgcccaggagaagctgctcccggccctaggtccctgtgggaacacacagccagccctgcctctgtgggggtccctttcgtggccagagcccccttcctcaggggacacgcggtccagctgagggtcatcccgtgacaaggagtggctgctgtgatgacccaggcacagaaacagctttgaccacagaacgtgacatccagggtgtgaaggtgtcggaacagatctgcctcgggatctgggggtccttcaccaggggtgggcgtgggccccgagcccagacaggagccagctggagactcaaacgtcacgaagaagggaagacgcgcttccctcccccggtactaaccagcccttctgctggccctgcaacgatgacctaggcttgagaatctgtttctgcctcaaggggtagaaaggggaatagattccattacttccctgtttgcaatggattattaaatccagcaataactgtggcatcggagaggtgttggtacagagggagccggggtcctgtggccttgggtccaccccagcgatcatcacgggagagagctgcttagggtgtgagccgtgggggggcggggggcggctgtgaaactgaggtccccgtgcacagatcccaccacccagggtcgacagctgggggctttctctgctggcacttcccaggcagcagaaccggcccctctaggaagccccctccaggtggcgtggcccaggccctcagtaagctcagctggggctgtgtgagctgaggggctcagagcaccccacaagggatccgcctgattgcagacaagcagttctgggccgccgcccgacctccatgcccttctgctcagcccggcagcctctccttcccaggggtttcccattctgccttttccctggactttccaactcactttgtccaagtccactgcatgtaaagcttgatcctgaaacagtgaagttcttgaggtctctgcagatgctcagcggccccaaatcaccctttcgctgccattggccaaaagcacagcctgggtgggccttgaacacctgtggcctcttcccctccccctcccctcaccccacacacttggagacaccctggggctgggcctgagctcggctctcactgcagagtaaacctgcccacctcagacacccaggcatggctcccgccttccctcatctgatcctgccaccgtggcggctgcctccaagctcctgacaacgtcaggtcagccctggcctcgcggcgctctgggtttcagccttaagagactttccatgtgtcggctgtgggcgccttgacgcaccagggcctggtcacaggttctcaaagcagagattctcctggcacccctcgtgcgccctccaagggcctaaaacgcagacgacccacactccatgccatgtcctgcacaggaaccagggtggcctcccctttctgcagcttgtgggggtcaagccgggacccctacactgatgtttcagcccagctctgccgcagcttagaagtcctacctgatttcagacagagcggatgatgctgacatttccagcccacagcgtggcctgcgccacgctccaggtcgccacaggggtgagaattctgggagcccagctgccgagtgcttctggggttggagctgggctggccccacctgtgaacagcggcctgtgggcccctcatccctgttctactgaaggccccacaaccacctgagggagacagcttttattaaatttcagtttttgtcggttgcctcgctcttcagacggcaagtgagagaagcgtgttctcacgcttactgtcaacgttgcgagggaagcgtgttctcatgctcactgtcaacattgtaaacctgagggaagcgtgttctcagctcattgtcgacgtaaaccccagggaagcgtgttctcacgctcactatcgacgtaaacctgagggaagcgtgttctcgcgctcactgtcgacgtaaacctgagggaagcgtgttctcgcgctcactgtcgacgttgtaaacctgagggaagcgtgttctcacactcactgttgacgttgcaagggaagcgtgttctcgcgctcactgtcgacgttgtaaacctgagggaagcgtgttctcacactcactgtcgacgttgcaagggaagcgtgttctcacactcactgtcgacgttgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcgcgctcactgtcgacgttgcgagggaagcgttttcacactcactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcgacgttgtaaacctgagggaagcgtgttctcacgctcgctgtcgacgtaaacctgagggaagcgtgttctcatgctcactgtcgacgttgtaaacctgagggaagcgtgttctcgcgctcactgtcgacgtaaacctgagggaagcgtgttctcacgctcactgtcgacattgtaaacctgagggaagcgtgttctcgcgctcactgtcgacgttgtaaacctgagggaagcgtgttctcacgctcaccgtcgacgtaaacctgagggaagcgtgttctctcactgtcaactttgcaagggaagcgtgttctcgcgctcactgtcgacgttgtaaacctgagggaagcgtgttctcacactcactgtcgacgttgcaagggaagcgtgttctcacactcactgtcgacattgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcacgctcactgtcgacgttgcgagggaagcgttttcacactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcaacgtaaacctgagggaagcgtgttctcacgctcactgtcgacgtaaacctgagggaagcgtgttctcacgctcgctgtcgacgtaaacctgagggaagcgtgttctcacgctcactgtcgacgttgtaaacctgagggaagtgtgttctcacactcactcgacgtgagggaagcgtgttctcacgctcactgtcgacattgtaaacctgagggaagcatgttctcacactcactgtcgacgttgtaaacctgagggaagcgtgttctcacgctcaccgtcgacgttgtaaacctgagggaagtgtgttctcacgctcaccgtcgacgttgtaaacctgagggaagcgtgttctcacgctcactgtcaacgttgtaaacctgagggaagcgtgttctcacgttcactgtcaacgttgtgagggaagggtgttttcacgctcactgtcgacgttgcgagggaagcgtgttctcacgctcaccgtcgacgttgtaaacccgagggaagcgtgttctcacgctcactgtcaacgttgtgagggaagggtgttttcacgctcactgtcgacgttgcgatggaagcgtgttctcatgctcaccgtcgacactgtaaacctgagtgaagtgtgttctcacgctcactgtcgacgttgcgagggaagcgtgttctcatgctcactgtcgacgttgtgagggaagcgtgttctcacgctcactgtcaacgttgtaaacctgagggaaaggaattctctctcacatgctgtggggtgctggccccaccaggcctcccaggagacctccccaaaagtcagaagaagggctccaattgaaagggaggtccgagatgtgctcgccaaaaccacccccagcaagacgccaggcatcctagccacccgacgctcaggccgtgcgtgtcctcagagcgtgttttaaagcaggagggatttggggtggaagattgctcctgcagaaatcagagatgaggggagtaaattagggaaccagcgtcaggatccagacttctgtgaaagagccacagggctcagcatccgacgggcgcacctggggctgggcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatcaagtacctgagctctgcgtctgttttcacgcttctgtatgtgtaggaagccccccaccgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgactccggaagatcatgccttcctggaaaccttggaacgcgcttcagcagaaactccagtgaagagtcggtgagagagcacaaattcccaaaggcggatggagttcggaaggacccttctctgtctcccacatcaggcggtgcctggttggtgcagatttaccccatggtgggccgtggatccctcacctgctctggaaactgatcttggctctgaacaaggagaaatgatgcctctcagcctcgagggatgggtgataaggcagcttcatccgctgttttctttcattgtttgagaaaagtcatgccccggaggtgtcattcctggttgtttatgttgatggcaaaacttggactttcttgtcatacagcaaacagaagacaatctgatctttgttttccaggggtttagactttgaacaaaacctcttttgtccagtactgtagtgcatccctggtagagtaattcaagctgaacacaaggttgcataaaaatgtgggcatgggggagcagggaactgtcttgggatcattctttgctgtgcacagcagctgcagcctgcaggcagctcagcgttagatctccccacccccaatgccacctggggaccagatgttactgttggcggaagaagggggtccggggcactgtctcagtctttggggcttccatggtggagcactaccggccgtactgttggtggaagaagggagtccggggcactgtctcagtcttcggggcttccatagtggagcaccaccggccgtactgttggcagaagaagggggtccggggcactgtctcagtctttggggcttccatagtggagcaccaccggctgggcaccttgtaaacaacagacattgatttctcacagctctgggggctggaagtccgaggttgggactggtacggtcgggttctggtgaggaccattccaagttgcagacagccaaaatcctgccatatcctcacatggcaggacaggcgatttgtctctccctccctgtgggacggcagtcccgttggatcagggccccaccctgatgacattgtttaacccccagttacctcctgcaaacaccactctcaagtagagtcacgcggacgggggttagggcttcaacatgaggttgaggggacacgagtccgtccatagcagtgaccccacttgtctaaagccacagggctgagcctgccccctgcccccctgcctgcccatccccaggcccccgttcttgcccccaggcccccccccgcccacccccaggtgctccctgtgctgcagacagagcccccgaggagccaggagctgccgggcaccaaccacacaggaagccaacaggtggggcaggcttgtgcctgccaccgtgttgctcatgccgatttttattctcagatcttgtcacctctgtcttgtagcagaagggggccctgatctgggagccgtgaagaccccagctgtcccccgggagccaggccacaccaaggcagccaaggggactacgttgggaggaggatgtggtccgggccattaagagctgtgatgagcccccaggtctgccctgggtgaggggctctgcctgccctggggctgcatagacccggctggggctttagaacaggaaccgttcgaggggctgcggtgggtgaagcccactcatgtcctggctcctgttaccgggtagggatggcagcccattttccaggcttgggggttctttaagaggccaggattgtgccgaatgctctttggctgacgatggccgtggcgggggctttgggaggggaggtcctggaggagaggcttgcccagctcactgcctgcgtctgtggccagaattggcacctgcatggggcctggaaacgtcgtgctcacctggggcggaagcccccctccaggactcagctcccaacgtcactgctaccgaggcagagactctgcagcggcatcagagagaagctgggccccagaacagcaccaggcatgggacgggccctccgtgccttccacggaggatgcaagcgtgaggcctgggtctgcggggacggtttacctgtcagctctgcacgccgctgaccactgcgcgccgcctccacagacagtccccatggacgctggggctgccgtggacgatggggcagccatcatggacaacgggactgccatggacaccgcagccagcctgctctgtgggaatatgctttgtaaagccagccggccctgaggccagcactcgccttccacactctgctctttgtaacgagtttcataaactcaccctcaggtgattggtgtttctgttgcaccgttgcttagcctgaaaatgagctgccctttttctgagcccatcctttcgccacctctaccccagcccctcatggctgatatcaggaggtagccagaggccgcctggtgcagggtgagcccggaacacgggcaacagcttgaactgggcctgtgcggccccctccacgggcgacagcgtgaactgggcctgtgcggcccccctccacgggtgagactcccaggcgctcttgcagacgctcactcactttctcactgataggatgcgtcttacgaggctctgatttacagagcaggcatccatcttctctgaaacccacacaaaaagcacagtttaggccaagcccaggtgcagtatgttcgtgtgtttaagcttcttagatgctggggtgtggaagcagccgtgtggctttcctttgcttgtgaaggtgagtttgcactttccagcttctctctgtattgggaaggctgcagctctccaggacatgacttagcagagaacatcccgctgcatcctcataggccagcgggtcaggcggggccattctgaaacgtcccctgtgggtgccgggtgcctcgcgcatccctgccgtccaccgccctttgtccctggctgtgcttcgcggcagtgccccttagggcaaggacagggagatggggcagtcgcctggggaaggcccggtcccagtgggaggcagcctcagagcagctgggatggcacaagacgccgctgccagggctgagaaaccatccggccaaccccagacttgagccagacttcatgggcaaggctgggagaagccgcgtggagaccccagcccagggaggggcactgtggcaggaacagggcccgcacctgcagggtcagcccaggccaccttccaagcacggtgaccacgtcgcagctcatgctgccagctccgggccaagggacctggactggctctccagactcacaagatgccgtcgtgggtggggcacgtgcggtgatcccaggtttcaagtagctgcccccagctccctgcaaatagctctgggcggaagagaagcagtgggcaggcacacgagtttattcctgagaggagcgtgttgccacagcctctgtggactggagccccaggcttcagaaagagagggagcgcctgcctgtgggtggggggacaggagctgccaacctggcggggtcccagcgaagcgtccactgggccttctgcttgcccctgggggtggtggatgcatcagtgctgggcctgctccgaacccgcagggcaagcagcccgtgcgtcccgatgccactgccggccgccagcatcctggggaggtgggtcgcgtgtcccagagccctgtgcccctcgccaccaccatcctaggtcaggacttccccaggaagaatccaagtggctggagagatgcgggggttaatgccggtaccaccgcggttttaaacggggccgtgtctgagccgtgttcttgacgttctccagccagcagcagcagacgccacccggttgccccagccccagcggctctcgggcatagccggccttggcccgtggggcggctgatttacaggacagctgtgcacggggcctctagtgtccgccagagctggtgggtgagagtttttaaagcgctcgggacacttcacagaagaggcgcactggcccccatgcctggccatgtttctgggccctggctgaaaatcccgagcagcggagagaggatcccaacagggtattaatttaaccttccagccatgtgcttttgcttaagatctaaactctgaaaattaccagcctaatttagaatggaggcttggccattcgggacaccagcatcttctgagcgggagagatgtgggtgcccaccggcgtctcactcccacatctgggcctgtttccagtgacccctgcacctctcaaaggcgcaggcctgagttcacagagagcacttggccaagccctgcctctggggctccccatcgtctggctttgtcgtggactcatcatttctggatttaccacatgcttcaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacggacaccgcctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaatgtgcgggactgagagccatagaccctcgtgagccaggcttgagcgttgtcttcagatggggcccagtgggcctcactgttgtgacgactgaatgtgacgtctggggtgtaattccagcgtgacctggtcctggggtgtcactccagcgtgacctggttcctgaggtgtaattccagcgtgacctggttcctggggtataattccagcgcgaccttgttcctggggtgtcattccagcgtgacctggtcctggggtgtcattccagtgtgacgtggtcctggggtgtcactccagcatgacctggttcctggggtgtcattccagcgtgacctggtcctggggtgtcattccagtgtgacctggttcctggggtgtcattccagcgtgagctgtttcctggggtgtcattccagcatgacctggttcctgaggtgtaattccagcgtgacctggtcctggggtgtcactccagcatgacctcgttcctggggtgtaattccagcgtgacctggtcctggggtgtaattccagcatgacctggttcctggggtgtaattccagcgtgacctgctcctgaggtgtcactccagcgtgacctcgttcctggggtgtaattccagtgtgacctggttcctggggtgtaattccagcgtgacctggttcctggggtgtcattccagcgtgacctggtcctggggtgtcattccagtgtgacgtggtcctggggtgtcactccagcatgacctggttcctggggtgtcattccagcgtgacctggtcctggggtgtcattccagcgtgacctggttcctggggtgtcattccagcatgagctgtttcctggggtgtcattccagcgtgacctggtcctggggtgtcactccagcgtgacctggttcctgaggtgtaattccagcgtgacctggtcctggggtgtcattccagcatgacctggttcctggggtgtaattccagcgtgacctcgttcctggggtgtaattccagcgtgacctggtcctggggtgtaattccagcatgacctggttcctggggtgtaattccagcgtgacctgctcctgaggtgtcactccagcgtgacctcgttcctggggtgtaattccagcgtgacctggtcctggggtgtcacttcagcgtgacctggtccgggggtgtaattccagcgtgacctggtcctggggtgtaattccagcgtgacctggttcctggggtctcattccagcgtgacctggtcctggggtgtcactccagcgtgacctcgttcctggggtgtaattccagcgtgacctggttcctggggtgtaattctagcgtgacctggtcctggggtgtcactccagtgtgacctggttcctgggtaattccagcgtgacctggtcctggggtgtcactccagcgtgacctggtactggggtgtaattccagcgtgacctggttcctggggtgtaattccagcgtgacctggttcctggggtgtaattccagcgtgacctggttcctggggtgtaattccagcgtgacctggttcctggggtgtcactccagcgtgacctggtcctggggtgtcactccagcgtgacctggtcctggggtgtcactccggcgtgacctggttcctggggtgtcactccggcgtgacctcgttcctggggcgtcactctggcgtgacctggtcctggggtgtaattccagcgtgaccttgtcctggggtgtcactccagcgtgaccttgttcctggggtgtaattccagcgtgacctggtcctggggtgtcactccagcgtgacctcgttcctgaggtgtcactccagtgtgacctcgttcctgaggtgtcactccagcgtgacctggtcctggggtgtcattccagcgtgacgtggttcctggggtgtcactccagcgtgacgtggttcctggggtgtcactccagcgtgacctggttcctggggtgtcactccagcgtgacctggttcctggggtgtcactccagggtgacctggtcctgaggtgtcactccagcgtgacctggtcctggggtgtcactccaacgtgacctggttcctggggtgtcattccagggtgacctggtcctggggtgtcattccagtgtgacctcggcggcacttgcagggtggggtggctgacgaggcggggggagcacacccgttctccctcccctgccctgggcaccactgcagaggcagcccctggcctcatcctccaagcttcacagcttgggctgcactccccgagttcactgtggctggacttgccccaggccaaaggctgggaatgcctgggctgcagagccccaggaaggcctggcacgaccctcagcagagtgtggctttatgggccctggtcagtgagctgcaggctgcgtcctgggaaggccttggaatcacaatggccccgtgattttcttcctgcctcctggacgtccccacctcctggtcacccaccccctctaaaaccttagcctccctactctgtgtagggcggacgctttaaacctcgatgtttctactcagtgtgcagggcggacgctttaaacctcgatctccccactcagtgtgcagggcggacgctttaaacctcgatctttctactcagagggtggatgatagaaagatttgaatgagtgaatgaaagtagagacttgaaaagtcagcacaaaagcaacaaaatgcagcaactccactcggaatccctgggtggaaagctctggttgacttcctgcggactcaggctggtgagatcctacagctgggaacggcccatatgggtcagtccctgtgatgcctccagtgtggcgggaaggtggcttggccaccatggatgactcgcgcctgccttcacgaccgccgggacctgtgcggggggggaagagggcggctgcaggggaggccgcacgtggcacaggtgctccggcgtctcgagctgcaggaaaacgccgtctccatcgttcgcagctgctggtggactcctcggcacccagccgtggcggggaacagctgcatggactcacgggctcaagcccggggctaaatattttctctcgaattgtggaaatgcttttgtttactgcaggaggctgccaggctctctgtggtggcgactgtttgcaccgggagcctgtgtactggctttgggggccacacataggcccccaggtggtgacaggaggggagtttccctccctgtggccgaccctgctgccaaaaacccaccagtgtgcagcccacggggaggagaaaacaggctgaggagactcactcacagcttgctgtctgcgtagcattcgctcagagtggcaccacgcgtctgttaggaatgtatgtgcgccattgtgagagctttagagccactgagccgtctgatgtctcctctaagtagcacgagaggcctgagaccaacaggaaaacagcaaccgcaggaatgccggctgggatccgcctcgccgctcctgctgactgcacaccctgcctgtttgcttcccaacacccccacagaagccggcacaaaggctggggtgggcgtgggctgggagccggtgtcggctctggcccgggcctggcggagcagccttggggacccagcacccgccctgtgggctcttccccaaagccccggacttttagggagggctgggtgggagaaagctctagaaactcgggagccccctgttccatccaaggctgcccggtcacagcctccacacagcctgtccctttagaaggggactcaggagcaccgtggaggcagtccagcctccatgacagtgtttttctttcgcagtgacggacggcttctctcctggagcagtcgttcacctttgcagttggatttttactgactcctgaaagccgtcttgttctgtgttcgagtttaccaaatgtgcagacatttatcaaaccgagtgtcgggagcagaaatgcagtcgtgcatccacgttgaaactttcgctttgattcctgcaaacccacaggcccctgggtccaggactcccactgcagtttgcaagtggacttttatagcacgttagtgctgcaggaggttccaaggaaaacagtcctcgccagtattagaaccagctgctactctctcggccgatgactcacgccttttttttttaatggggtgggagaaccaggcaggagacagagggacccagtcagggccctgttggttttgcggagggtgccccagccacaagcctgcctgatcacactcattcgcaacttgtgtttatttaattttttttttccttctcacagttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgcccggtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacggtgagtgcccgcagccatgcaggtgtgtgccccgcctggcaccatggcgtgagctcatggaggggccgtgtgcgtgctgcgtgtgtggcacgtgtggaagtgcaccgaggcaccgggcagggtgtggggtgcgtcctcctgatataaagtgcccgtgcggtgccacggcgtcagcgccacctggggcgctcgccgtgagatctgctccggtggtcgcagtgtggggcccttggcgggtcctgggctgcagatcctcctgcgagacctgtcccggggtctaaggctcacattggtgtccaggtttgcttctgcagctgaatatggagccgcacggctcaggctcaaagccctgacttggagagggaccggcctctgcagtcggggcatcgtgggtgccgcctgagtcccgtgaatggtttgtagacaacagcttagccgaggtgacgagcacgttaccccgtgcggctctgtaaacacatctaaatgcagtggcggccttgccaggagctcgcagggtggccgtgacaccgggggccctagactgtgccttcaggccccaggtgcagggtcttccccatctagcccctgggctcgcacagcgcggagatgcacccaacaccgcacacctggggttgttagggaaggaagtggcctcacgtctgtagccaggcgggtggtgtggggcgtctgagcactcaggcctttctgtgacgagtggtgaccgaaggcgccgtggcgttcttctcgactgtttacactttaaggcgcagcccgacttgcttgcagtcgcgctgtgatcggggcgtgcccgtggccctggtgaccacgcgttagagggtgattccgctcgtgttttctggccctgcggtttgtgtgcgcgttgtgatcggggcgtgcccgcggccctggtgaccacgcgttagagggcgattccgctcgtgttttctgctcgaatggtttgtgtgggaattggcttcatttcctcggaggcacagtgagtcctcccaagtgtatgacgtttcccaggcccgggttccagcagacacacctggagccactgcccactccctgctcagtggcctggggtccaggcgagcctcggccttctggggagggggcggcattagcccctcctgacccagggggggcagggactcccgggcgtcaggagctcagtttcccatctgctgggaagggagtgaggccaaacgccttcctgctgtttcctgactgaaggctacaagctttttaaggaggatgcatgcaaatattttaacccccaaaatattaagctcttgagcccacagccctggtgtgtgtgtgtttgcggtagtgtgtcccatggagcccgcagccctggttgtgtgtgtgtgtgtgtgtgtgtgaacttgaggtagtgtgtcccatgaagcccgcagccctcatcgtctgtttttgcaggagtgtgtcccgtcagcccaggaggctgctgcctccccagggctgtccctcagagccacacactggaggcccgtggctgccccctggccactctctggaggttcatgatgactgtggggcggggccaggacagtgttccgtgtcctgtgcagatgtcgtcctgaagttcttactgtctgacctgcctgctgtcctccttgtccacccgcgaggccagccggagctccgcatggggcccatgtccctgctctgcagcctcctgagcacagatggactctgccttcctccccagcccctgcgcgaggtggacgctgacatccatgcctccagtccctcacccctgctttgtctcacgcggtaccaggtggtcccaaggcggctgggagatgctgagaaattctctttccacctgccatgccttgtcccagttgtgacccaccagctctgggctcccacaattgggtagtgccctgcaggcccaggtgggaagcaggtcccggtcatgtttctgctgccctgtggcccacgtgtggctttatggcgagggtagagttcggggtgggacttggggtgggtgagcagcggcagtgctgggggctgggacgtgttctgcgtcaacacagcaggcaggggactgttgacccgcacggtgctcaggtgagatcatccctttacccagcccgttactgccaaagcctcaccaggtggcccgggcccctctggccttggtcctagaggtcaaagctaagtgagccaggccttgccttggggcctggtgggccacagagggtgggctgttgtgtcgctgagtgcacaggctggggatgttggagctgcatgggtgtgggtgtgaccccgccctggcctgcctgactgtgcgtggacatggaggggatgggtcttggggaggggagtgcacagacgactccctgacacatggaagggctgaggccagagtgcatctgccatggggctgggcctggcctgcagctcctctgaggatgcccaatgccacgttcccattggggcctctcctgacagccagtgggaccctggagcccaggattcgccagctgtaaagcagtcgctcacaccccttttaagaaagtttgtttcccggcgtgctgccgtcgggacacttgaggacaacctctccccgcagagtgagctcagttcccagcgggcctctctccccattttcctcactcagttgccgtggtgatcctccccaaactcggatcgaatgggtcacgtcctgttcaaaagacccaggggtttctgtgttgtcagagcagaccacatcccagcccaccgaccacagtcatctcgtccacgtacgcttcgtcaggcccagggccggtcctgggaccttgagcacagaccccgagcgccagccctgcacactgttctggtcacagtttatgggtcctgtgtgcttccgcctccataacctgggagcagccacacacaagctttcggggttagcgtacggcgctaggcggtgccgctttgggggtcggggttgggatggaggttgagatacctgtgcagacacctccctatgacatggcaagtgtgtgcaggtaatgtggtgatgtccgtttcatctccacctgtgaggtccctcgatgctcagccaggaccacagcagttagggcttcaggcagctggaagcagtgtcagctgtggcctgatctcccccccgcccccgccccgccgtgggcagacagcccctctcggtccttcacaggcaggcaggcggggcgcatggcagaggaagttctgctcgtggtgtgtgtgaaggggaggggagagtcctgggggctgaggtggtgcaggtggggtagtgtctggtgcaggcccggctctgggttagggtggggtggtccctggtgcaggccccgctctgggttaggacagggtggtccctggtgcaggctcaggctctcggtcatggtggggtggtctctggtgcaggcccaggctctgggtcaggatgggggtgttccctggtgcaggcccggctctgggttagggcagggtggtccctggtgcaggctcaggctctcagtcatggtggggtagtccctgatacaggcctgacattgccgccaccctgggagacaggcaccaggccatggactccaggttcctcctgagcacctgggggcaggtccacccactctagacacctgttcctccctgtgagaaaagcagattcaaatgtttattgctctgtcggagccaagtggatggagccttcactgagaatgacacgggccgagccgtttcccgcgtcctgggtggatggagccgtagatgggtcgctgcctgtccttgtgagaagatggctggagcatccaccaacatggccgggaagggtcccgggtcagggttgagtctgggtcggcccctcccctgcagatgacctctggcttgccctgggtccctggaacctggaacccacaccccaggctcacaaacgccgtgacataaacgaggtcagggcctgggttatgtcgggaaagcctcacgcaggctgaagacctgaattgtgaggtggaactctgagtccccgagactccagctccatggaaatgcgggggtgtacctggggaccgtctcgatggggacagcgggagagggagcccagaccccaacaagctccacggaaatgcgaggagccatcttgatggggacagcgggagagggaaggcaggctagggtgaatgtgggtagtccttgtttagtattaatatatattttgtctaatttcacaacccctaagagaatcgggcacctcagcagccaccctggggctcagtcgctggcttagaaagcaggcaagcgtgacctggagttggggggcggagaagaataggaagcacagggcgccccaacaagggacgatcccagcacctggagaaggagcagagacgagagacagaaacaacacgaaccccaggtcaagtcggtgccgtgcgtgccaagtgtcctcagcgggtggaaagtgtcgctgtgtctttgatagtttacacaacagggagagagcgaaaagctggggttggaggaaacaggagagaagtaaggctgtgtggcggggacaagactcagacacacccctgactatctgtaaatgggccgatcggacacaaggccagggacctgctggccagccccgagccccgtgaggtgcctgtggcaggacgtgggtatggcaggtgacagaaaccctgccgggtccactttccagcctccccggcttcccttctgcgttccgctggcctggccgccacctccagggacaacaagcctggcatggggtgcagatttagtctccagccctctgcgaaccaagcagtggtggatcgcagagctgcgtgcggggagagggggagacaggccagcgtctgggatgtcctcgtggggccggggactcagccccggcccctgggcgcccagccatgtttgagaggcttccctccgcctgaccagaatcagagctgtgggtccatgaattgagtcacttcaaggtcttgctgcttcacatgaacagctgtgcagaggcagccagagacagcccggggctcctcacgcccagtgatgctgacgacggcctgcccgtgaggacatagaactttttctgtgcgtagtggtttttcatttgttttgattttgttttccaggaatgtggagttaaaaggcaataagagtatatgtgtccagctccaccccctcggtagggggtccacagtgtccgtgtttgcatccctgaggggtctgaggagggcagttcacgctggagcctcctctgtggcagcctctgctcagccgcaggaacctaaaggtcacgcacagcccacatcctgtgcgtctcaaagaagtcaagcctcaaaatgaaaaatgaggctgggcacggtggctcactttgggaggcctaggtgggtggatcacctgaggtcaggagttcaagaccagcctggtcaacatggtagaaccccatctctactaaaaatacaaaaattagctgggcgtggggctgggtgcagtggctcaggcctgtaatccctgtactttggaaggctgaggcgggtggatcacgaggccagaagatcgaaaccatcctgactaacatggtgaaaccccatctctactaaaaatacaaaaaattagccgggagtggtggcgggcgcctgtagtcccagccactcgggaggctgagacaggagaatggcgtgaacctgggaggcggagcttgcagagagctgagatcgcgccactgcactccagcctgggtgacagagcgagactccatctcaaaaaaaaaaaaaagattagctgggcgtggtggtgcatgcctataatcccagctacttggaaggctgaggcaggagaatcactcgaacctgggagatggaggttgcagtgagctgagacctcgccactgcactccagcctgggtgacaaagcgagactccatctcaaaaaaaaaaaagaaaaatgaatccagctttttttttttttttttttttttttaggatttctttgctttccagtcctttctactcccaagttttgtttcagaagtgcttgacccataaataaattccaacaatgaggtcgtctttgtttctcctgaatattgggctttcccctcagacttctcgagcatggccgagccacagaggttcagtttttaaacagtggttttctgtatcttgcattattttaaatgtagatttgaaaaaatgccacagagctccgtgtggctccttttctaatgtgatctccacgcattccgcatcgtggagaagggccgtgaggaggctccgctgggggcggactcgcggtggattacgcgtcagcgagggccgccccgtgccacgcgctcgcgcgctgagagcgtttgtggggcctgtgtcttccgaaacggaggcgctcggggcctgctgcggtgcccgcgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccccggctgaggatgattgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggaggccgctgaagaggcagctccccaacgccaagagcccgtccagccccaggcccggagctgcttcctcagggagcccaccctgtgacgtgcccgaggtgaggcggccaccagaggccgcgtccaaacctgtgcgccaggcagcgtgtggctgaggctcagacgtcgactcacgcgtttcagttcctctcgagaaaactcgctgccacctggtctcagccagcgaccgcgagggacagtgagaaaggcgagagcgggcacacgccccccatcaacctggtgtggccgggggaaggcgagagcgggcacacgccccccatgaacctggtaccgccgggggaaggcgagagcgggcacacgccccccatgaacctggtacggccgggggaaggcgagagcgggcacacgccccccatcgacctggtaccgccgggggaaggcgagagcgggcacacgccccccatcaacctggtaccgccgggggaaggcgagagcgggcacacgccccccatcgacctggtaccgccgggggaaggcgagagcgggcacatgccccccatcgacctggtaccgccgggggaaggcgagagcgggcacacgccccccatgaacctggtgcggccgggggaaggcgagagcgggcacacgccccccatgaacctggtaccgccgggggaaagcgagagcgggcacacgccccccatcaacctggtacggccgggggaaggcgagagcgggcacacgccccccatcaacctggtgcggccgggtgagcatggagcccatggctggagaaccctggggcagctgcagtggcaagtctgccccttgaggaaatgggggcaaggatggcactgagacgggtgctgaacaaggctctctaaaaataggggctgcatgggctgtgcacatcccgtgtgggtgctgttgcaggtctcccgccgtggcgtgcaggctgtgaggccacagtgcctccgtccttccctgaggtgggcacgggagaaaggagaggtgcccgctcctgtgagctgcccacgggctgctccttggggcctgtgaggttctgggcacttttttaaattgcctgaagatattcactgtggacacagaatattttgaattctatgctgtttctagttgaaatatcagtctacagtccaattttgtgtacttggaagggaaatttgggggtatcattttcagctattcatcttctgcctttgactccttaaaagtgggtcttagcttgtttcggcgttaagtggagagctgtctaaaattagtaactggagagagagacatagggacgaggtggaaggaagcaagagggaagagctggagagatttcacagagcttgggcaatgagcactgtttagatctattttgtgccgaagaaaattcacggccagtggcagcaaagagagaccaagccctgatgttcagccgcgactgcgcgtctgggcagtgtggggcgtgtgtgcgatgcctttgtcatcttgtgtaggcaagccgtgaacagtggtaaggcgttcgcgagtcattgtaacgtaggcaggccgtgaacagtactaaggcgttcatgggtgtgtcactgtaacacaggcaagctgtgaaccgtagtaaggtgtccgcaagtgtcactgtaacacaggcaagccgtgaacagtagtaaggcgcccgcgggtgtgtcgctgtgacgcgggcaagccgtgaaccgtagtaaggcgtccgcaagtgtcactgtaacgcaggcaagccgtgaacagtagtaaggcgtccgcgggtgtgtcgctgtgacgcgggtaagccgtgaacagtagtaaggtattcgcaagtgtgtcattgtaacgctgtgtttttctggtgtagatgcactctgttttcctcctacagatgatttcaaactttacagaaacattttaagtggcattgtctccatttcaaatcaagttgcctagcttcctcctaccgccatacgttttctcttcctaatgtgtagacatttcaaagagcttccttatttgagaacgagtgttctttacagacacgcttagatctgtgagccagcatgtcgcactgatgtgctggggtaccggagcgtgaagccatgagcgaggtatttaaaaagcataacagccacattcagcgcccagaggccgatcgcccgtcagagggagagaggtggccggggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattctgccaagcccaggctagaaagaggggacagtcggaaccgtagtgttttcttcctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaaccaggagcgccccaaccccagcgccaaggcccgcatgctctcgcgggtcccagctctaccgttgagtattttcttcccactagagagatgtgatgagcaaagatttccgctcagaactcctaacatccaagtatgagttggctttgcaagccgaaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggcagtcagccaagaggacagaacaaacacagatgcattcactcaaggaagagcggccccagggggaagaacaggatggcagcgtcttcacttggggccgctccagccccgaggcgcacagccgtggaaagccagtgacagcacagaccgtggaggagctgggctctgttgaaaaccccatcccaggatgcagtccgcatttggactggtcatggagctcctggaaaaggcccgttccgaggcacaatcaccgttggctgcagtcgtgatcatgggagctgccccaaggctgcgatcgacattggagcaaacaagagcctggccagaccaggtgaccccggggactttgaaaaaccttggagattcccgggcacatacgaaaatggatgtgtgaaggcttcggtacagagagggccccagccactcttctctggctgacctcaaaaccccaccaagcagaagtgagaggtaaagctgcctgtggctgggaggcaggtcctgacacacaggttttgtgattagagggaggagactggcttcgtggctcaaggatttaaggaaacttcctgtctggtaacagcagaccattaaactctgctaaccagagggtgatccctaggcagcctggcttaaagacagaaacaagatttaaaaacagagagaacagaaaactcagtgtccacattctgcaaggaatacagcatctagataattagtccaggaaagtcatgagtcacataagcaacaaccaaggagaggggaagccgagaaacaacaagtcctatttggagggggatggggggggggaatctcatttcagagtcgctacaatgcattagttgtcatctccagttgtaaaccaaaaaattatagtacatgcaagaaaacatgaaaatatgtcccatccacaggaagaaaaatctgtagcccctgagagggctcaggtattagaccagcaaaggctttaaatcagctgcaataaatatgctcaaagaactgaaagaaattgtatttaaaaaattacaggggagtgtggcaaatatatcttaccagatagagaatatccataatgagatttttaaaaaaaaaaaaaaagaagccaaatagaaattacacagttgaaaagtaaatgaaaaatgcattagagaggctgaacaacagatttgagctggcagagaaaaagaatcaaacgtaaaaatcaacagattatttagactgaggaacagaaagaagaaagaatcaataaaaatgaacaaagcctcagagcatgtgagatgctgtaaacacatatacacatgcataatgagttatagaaagagatgattagaagaaatacgtgaagaaataatggccccaaacttcctaaatttgatggaaaacattattcagtgcatccaaatggttcacaaaattcaaatgggataaattaaaagcagctcacacacagacataaaccaaactgttgaaagtcaaagggagagacaatcccgaaagcagtgagaggaaaacagcttctcagtacgtgggatgctcagcaggattaacagccagctgcttattgtgaatcgtggatgtcggaggacagtgggacggcgcattcaaaatgctgaaagaaaaccactgtcaaccaagaattctatatctagtaaaactcatctttagagatgaagaaacaaagctgtgctcagataaacaagacacacagaatttgttgccaacagacctgacctacaggacatattaaagggagtccttcaggctgaggtaagaagcactggtgagagtaattacataggtgaattaaaaagacagcacaaacatgttttaaacttttcttctctgaactgatgtaaaaggaaactgcataagacacgattgcaaacctgtgctgataacaatgtgcttataacaatttgtgtgacagtagcacaaaggaaggggtggggaaggaagttacagcaaagcaaagtctttacatattattagaactcagtattcatctgaaatagactgttttgactaagatgcttgttgtaatctccagaggaaccactaagaaaatatatatgtgtgtgagtgtgtcacacacacacataaaatgtcaaaaaatgcacttaaatgatacactagaaaatatgtgtgtaacacaaaataagccagtaatgaaggaacatagaaacaatgacaacagcaaaagttacacaagacatgtagagaacaaatagcaaaatggaaaacataatcctaccgtatcaataatcacattaaatgtcagtggaataaacaccccaataaaaaggtagatgttgtcagactggatgttaaagacagaatgaaacagggtacaaccatatgctgtctaaaaaatacatattttagatttaaagacacaaataggttgaaagtaaaatgataaagagatactgtgcaatagtaatcaaaagagatatggagataatggaaaaaatacatacttcagatttaaagacacaaataggttgaaagtgaaaggatgaaaaagataggcagagttaatgtagaaatttggagtagctacactaatatcagacaaattaaactctaagataaaaatattactagaaacaatgaactgtcagtagtcatgttctctttgatcttaaacctgatacattgaacaggaagatataaacacatttgcacataacagagccccataatacatgaaacaagaactgacagaattaaagggagaaatacatagttgaaaaataatagctggagaccagtatatcactcttaatggatagaacaactagacagaaaatcaaaaggatataaaacacttaagactatcaaccaactttacaagacatctgtaggacactctacagagtgcacataggatagacttcctactatgccataaaacaagccttaataaatttcaaaatattctgattgcaatggatatcaattgaaaatcaacaacagatatttccacaaatatttggaaactaaacaacacatttctaaataattaatgagtgaagttagaaagtataagggaaattggaaaatattttgaactaaatgcaaatgaaaacacaacatatcaaaatttgtgggatgcaggtaaggcagtgcttagagggaaatttatagctttaaatgcctatatgaggaataagatggatttcaaatcaataatctaagctttttccttaaaaatgttgaaaaaggagagaaaaaacccaaggcaagtggaaaaaaggaaatgctgaggatgagaagaaaaagcaatgaaatagaaacatgagaaaaatcaataaaaccaaagttagttatttgaaaaaacaacaaaattgacaaaactttaatgagtttttctaacaagaaaaattaggaatgaaagaggggacattgctactgaccctgcaaaaatcaaaaggttataagggaatactataaccttatgccaacagattaaacaacctggatgaaatggaaacattcttagacacgaattacctaaactgactcaggaagaaacagaaaagtataatagacctatagcagggaaataaaagaaattaataatttaacatattctcacaaagaaaagcccagacccagagagctttactggttaattttattaaacattacaagaataataccagtgccaatactccacaaactcttcagaaaatgaagaaggaacacttctaatactgaagccagtatagccctaataccaaaatcaaaagtatcgtaagaaaaactatagaaaaatattctttatgaacacaggagcaaaaatccacaacaaaatattatcaaactgaatccaacaacataaaaaaaagattttacaccatgaccaagtgggatttatcccagtaatgcaaggttggtttagcatcagaaaatgaagtcatgtgatgtaccatattaatagaaaaaggacagaaaccacgtgatcatttcaataaatgcaagaaaaaaagcatttaacaaaatccaacaccaacttatgataaaatctcttgacaaacttagaacacaagggaacttcttaacctgatcaaagtcatacacagaaaaaaaaacagtgatcatcacactgaatcgtccaagacggaggaccttcttttcccctaggatgaggaaggatgcagaggtggccactttcactgctgctactcagccttgtactggaggttctagccagtgtagccaggtaagaaacagaaataaaaggcaaccggaatggacaggaaaaagtaaaattgtctttattggaagaaaacgtgattctatatgtagaaaatcctgagaaatctgcctacaccccaccccccctccccccgccaaaaaggtaaaggaaaacccactgttaaaactaccaaacaagtgcagcaaggtcatcagatgtgagaccagggtacaaataaattatgtctatatgcaaggaataatccaaaaatgaaatcaaggaaaaattcctatctacgatatagcattaaaaagaataaaatatgaataactttaaagaagttaaggacttatactctgaaaatgacagaacgttgctgagggaaagttaagatctaaataaatgggagaacattgcatgttaatggaacagaagaatcaatattgtgaagatggcagctttctccagattgatctggagaatcagtgcaatctccatcaaaactccagcaattttttcttctaaaattcacaaaatgatcctaaaatctacatggagtttcaaagacccagaatagccaaaacaattttgaaatcagagaacaaagttggaggagttacacttcgcaatttcagaactttctgtgaagctataataatcaagacagtgtggtattggcataggacacatagatcagtggcgcagaattaaaagccccaaaataattcttatgtctgcggtaaattgattttttgacaaaggcacaaagcccatttaattggagtaaatgacagcctttttaacaagtggtgctgggacatttgccacatgcaaaaaaacacacaccacgcaccgaaaatgaacttgatcttggactagtaggagccaaaatagtcaaacgtttttggagatagcacatgaggaactctttcaagactttggattaggcagaggtttcttagatatgacatcaaaagcacagctcataaaataaaaacttgataaatggaacctcaccaaaatttaaaatttttatgcttcaaaagtactattaagaaaatgaaaagataagcaatagactagaggaatgtgtttgcaaaacaactatctgataaagggcttatatccagaatatacaaagaacacttacagctcaataataagacagaaagcctaatcaaaaactgggcaaaggatttgaatagacatttctccagacaagacataggaatggataataaacacatgaaaaaatactccacatcactagttattagggaatgcacattgtaaatttcaataagataccattttatatccattcaagtggctttaggagataagatagacaacagccaattttagagacgaggagaaattgggcccctgaagccttgctggcaggagtgtaacatggcattacattccggccacttaggcagtttcttaaagaaatttcttagaagaaacttgccatgtgactcagcagttccactcctaggtatgtattcaaggaaacagatgcacacatccacacaaaggcttgtacatgactgtccttcacagcgttctttagccaaacatctgaaacaaccacaatgcccagcatgtggggaagagagaggaaaggtggggtttatcctcacccgagtgttatccatccccaaaaggaatgagtactgagcacgccaggactcaggtgaacctggaaaccctcatgctctgggaaaaatccacacacgagaccacagactcagtggctcccttgcatgcacacctcagagacgtcgcaggttcagcctcagaccactgggatacagccagtatggcaaaagaaagccgctggagtgtgtggcttccagggcatataaaagtgacgctcacactgtactgagtctgttaagtgtgcaccagcaatgtgtctaaaaaaacagtgtttgtacctgcgtggggtgaccaggtgcattgtccgtgagcagtaatattattaaagggctctttttatgagcagttaagtctcaatggtgggcttaaaaccttcggtaaaccatgctgtgaacagaggtgccgtcatccgggctttgtcgctccatgggtggcgcacaggcagaggagattccgcgtcattcttaggggccttgggattttcggggtggcagatggacactggattcaacttaaagtcaccagctgcattagcccctaccaagggggtcagcctgtccttggaagctttgcagccagacactgagtcctctccagctatgggagtcccagacggcatctccaatagaaggctgttttgtctgcacagaaaatctgttgtttagtgtggccaccttcaccaatggtctcagccagatctcctggagaacttgctgcagcttccccatcagcacttgctgcttcatctttgcttttatggtatggagatggcttctttccttcaacctcatgaactagcctctgctggcttcaaacttttttttctgcagcttcctcatctctcagccttcgtaggacagagagagcgagggtcttggtctggattaggctttggcttaagggagtgttgtggctggttcaatcttctgtccagatcactcggactttctctgtatcagcaataaggctgttccgccctcttatcatcggtgttgttcactagggcagcggttttcacttctgtctgtctagagttttccgctgcattcacagttggactggcgcgggaggctgagctgtcagcctgtctcggctttcgacgggtgttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggctggtcagtggagcagtcaggacgcacccagctcttatccattcacttcatcttagatgggcacagttcgtggcaccccaaaacaatgacaacagtaaccccaaagatcacagatctccgcagcagatatgatagcaatgagaaagcttggaacatcatgagcattattgaaacgtgacacagagatatgaagtgggcacctgctgttggaaacgtggtgcccacagacatgcctggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagactgctgtgtgggaggaggtggtggatgagacccttgggtgatggaagaggcaggagactgctgcgtgggaggaggtggtgctggaggcccttgggtgagggaagaggcaggagactgctgcgtgggaggaggtgatgctggaggcccttgggtgagggaagaggcaggagactgctgtgtgggaggaggtggtgctggagacccttgggtgatggaagaggcaggagactgctgcgtgggaggaggtggtgctggaggcccttgggtgagggaagaggcaggagactgctgcgtgggaggaggtgatgctggaggcccttgggtgatggaagaggcaggagactgctgcgtgggaggaggtggtgctggaggcccttgggtgagagaagaggcaggagactgctgcgtgggaggaggtgatgctggaggcccttgggtgatggaagaggcaggagactgctgtgtgggaggaggtggtgctggaggcccttgggtgagggaagaggcaggagactgctgtgtgggaggaggtggtgatgagacccttgggtgatggaagaggcaggagactgctgcgtgggaggaggtggtggatgagacccttgggtgagggaagaggcaggagactgctgtgtgggaggaggtggtgctggaggcccttgggtgagggaagaggcaggagactgctgtgtgggaggaggtggtggatgagacccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagaccgctttgtgggaagaggtggtggacgagccccttgggtgatggaagtgttctgacacctgcagtgatggtggcacaactgggcacctttaccaaaaatcactgaattttgtgcccttctcaagggtgcattacctgtgtgaaacgtgcctccgtagaatgctgtgtgtttagggaggggctgggagaccctagcaatgccacgtgctttttacttttcttcaactgagttttgagcattttgttaatgcaagaaaaaggactccttataaagagcggttcgccgtggggtctgagcctgtggcgtggtttcagttgcctcctcagccgcagtgtggagaggaacagtggtctcggccgagcagcggctgtgggcacctgcgtgtcagcccctccctccgtggacagatgctcctgagcttccccagcaaagacactgggactgtgcgccttgtccccccatcttcccacctccggtgaccaggcctctcccagggaccctctgtgctggcccggcacctgctctgatatgccctccccaggggtgtgggtccgtctgccctccacacagcccttggagcctctcttcacagggcctgagagctgagtgtggtttcataacatggttcattggcctctgaagatgctcagtgctgggggaattgggcttgaagccatcacgtccaacacacggtccctggaccatgtcctgtagggagtgttaggaggagtctagctctatttttaaatgacagtgttcatgacagaatttctcgtagggaataaaaatgtgtgtgcttcccagttacttattgtgttgcttaattaagaaatctctttagaaacacagacaggagcatgaacttctcagccacttcctgcctggcttctgggtggttctgtgttgcattactggaggtctgggtgtggaattttgagaatctcttgatccttttcagtttaattctgaaacagggttcttccttccttccagattacagtgtggacactcacacacagtaagggacaaagaaagtgtatccccttccaaagatccgcccaccaggccccggacccgtaatcaaagcctgatactgggacaatggacccagcggccgggccagccctcccctagttatcaccccagagctgtggctgggctctctttgttccgaaacggagctgatggagcaggacgctgtcgccaggcactgcggggagggggttatcagcccctggcccgcgtcccaccccagaggtgaagtcttcgccccagacaggccctatcaggccctcccagctgctgttattttagatatggcaggaagtagggcctggaaaccgcacggctcccagcccttggcagcagctcagttcccgaggctgcactcagagctggtggcagggagggagaaggcacagcagcctggactgcgggttagagggctgtgccggggccggtggagccatgcgagcggccgcgtaaatcaggcaggcgtggccggcaggctgtggctccccacagacatggggctgacggtgtgcagcgctggctggcgcagcctctgccaagggagcccctgccctccggggcagcaccatgaagacctcacccctcaagtggatgggtttgcagttcagcccagtgtctgttcagctggcaccgatgggcccagatgtcctccctggcagtgtctcagcaggcgcacagacgagccctgggccaggggacaaatgtgtgggttcctgacgcacgtcccccggagccctagaaaggacaccggggttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggccgggctccccgcagccgcagtcgccgcgtcaggcggaggatccctgttatgtactttcccttttccacagtagctgctgccagcgggctgtaaactaccgtatatcactcagatttaagaacccaaactttaaaacaaattaaactcttgttgacattgtaataaaaatcagaatggaactgaacagctcagtaaaagtgaacttcaattatttttgtggatttcagattgttttctgggattcccagactcccagtgcagctgagttatttcctcttggcagaaggctggagaaaaaaggtggagggagggagggacggacggacggagggcgcctggtgggaggaagcctggtcacctggctggagggagggatggacggacagagggtgccgggcaggaggaagcgtcgtcacctggcagttcgctcggcctgaccagcagccacagggcagcggcgtgcgtgtgagggttgggtgagggggcgcatgggcaggtgttttttatgtgttttaatttaagaaaagagctcagaaatgtttgtcagagcctatctgttaattaggtgtttatgctggattaaaagaaaaatggaaagcactagtctgactgcccctcaaaaatgtgctcgaaggctcataaacgcacggagggtctgaactccctcccctctctctcggtctttctctgtatctctatccctctctctgtctctgtctctcggtctgtctctttctcagtctgtctctctgtctcccttcctccctgtctctgcccctttgtctccctccgtctctgaatctctgtccctctctccatccatctctctccgtctccctcccttcctcgctctgtttctctgtccctctctccatctctccgtccatctctctctctctccatctccctccgtgtgtctctgtctctcttatctctctccctctgtctctgcctctctgtctctctctccgtccctccctccctccctttctctctcatggcggccttttcttttgttgctgtgttcactgtgatgtctggttcttttcagctccttttctctgctggagtggacagggttgtcggtctccactgccgtgccaggtgtctgtgcttcttgcagtgtcctgtacggagaaagcggagaactagagcattggagagacccgcatggaaggaaacgccattgctgggcagtgttgcagcctccgcagaggtgtgtgggctccggggagagggacgtgctggcccctgtgcagtggcgtggcccgtgtcctttccccgccgtccacttcctgttccccttttctgcacctgtctctagctgccttcaaggcggagctttggcacccacatatgcagatgtccaccgcgcctgccggacgccagctctccaccagccggaactcaccgccacccaccctgggctgccagctcagctggggcccagccactcccccaggtcccccttcactgtaggaggagctgggcctgggatgtggacagtgggcggcgagggggttggccatgcagagggcgtgggaggagaggagagcacgcagatgccggcccggtgatgtttcctcagacgcccgcgcagtgccatgccgtgggcctcacatgcaatgctcccctgcctagaggggcacccctgctcccaggagggtctcaaagagacctgggtttcttttaagcagttttgaccactttgattaggtcagtgatctccattagatctggacctgctaaagttacagaaggttctggaaggtgccggcacagtctgagctgaacacccatgacacctgagcaggaggctgtgacaactgtcagctcacggaccagggagggaacgcgaagctggggagctctgagctccaatcccagcttctgctcctgctcagaaagccctcccactttctctgggctgacctcacctcggtgtttggaaatggaccaagacttatcggaaagtgtcctcggcgccaggtaccacactgagctcacaggctgcttccatttaaagttaaccactcttggtgcagccataaagcctcgttgatctttggtcctttattgtgaacagacatctcgaaagagcctgtgtctccacggtcaatctttcttctgaagacatattttaaggcttcttcagaaaccaaatttaggaaaacagaagaaattagtgcttagttttccagataactcatagccccccccaaggaggaaattcagacaggacagcgagcaggttcccgggccgtcacttcagggtcacctgatgggagccgcagccgtggtgaggttcgctgggtcatgcccccgtgcggaaactcagggatgggacggattccactttcaaaagatgacatagaatgagtgagtatttaggaattactttagggctaaaaaaaaaccacatatggggatcagatccctgagccctcagaaaatcggagtagggagagggagaacagttgaagcgagaagttaaataattcacgtttaaatcacaattccaggtgagatgaatgcggccctacctgatggcacctgcgtggttgccacaggcgtggtggagggctcttgcgtttggatttgaggggcttagaggtcaaaaaacttttcggaggaacagggatgggcctgtctctcttttatttcagcggtcttttctgtttatgtgggaaacgcagtgtcatgaggtttgaaaccctgaggatgagatgcattcccagttgccaggctcggtttccaagtctgctgggtttgggagcggttggttgatagaatttcttctagaagacagggtgtgggggcacccaggtccttcctgcggaggcgtccctgccctgtgtggccctgggcacagaccccggcatcccctccacggggctcctctgccggggcatcctctgccggggcatcctctgccggggcatcctctgccggggcatcttccgccggggcatcctccgccgggacatcctccaccgggggctcctccgccggggcatcctgctccggggcatcgttcgccggtcttgtcgctgcggtggaagtgtcgtgttcccagccaggctgggagtggtcgctggcgaggcctggcgtgggcccgcggtgtctgtcagggtgccctgggccagccccgctgattcgatttagagctaacgagagtccaccaacggcaattacaggaacctaatggccttcctgccgcaccgctccgtggcacccggctcgctgtgatgaattgctcattatgtgcagtgttggaatagcctccacaagattaataattggataatcaatacagaaattcaatcttggggtgtttttttcactccggggtcaatatgtcctgaagattacaaggcccgactctgcctcccccctccccgctgcttccgcgttgggagtttggccagcacctcgccacacgatgggtcatggtgcgttgtctccgtacctccgtgacttttctattctttgcaaacagcaggttctgccgggggtcagtgctgctaacacagacagcagtgactccacggtggcttccgttaagccaggggagggcggcacaggtaatggctgtgagggcaccagggccatggcacagtggcggccgtggagggaagcctcgccgtgcccaggatgtacgtagcctgagctgtggaggggtggagggcaggttcaagaggggctgtgcctcccgccaggacacgtctgcgcccctgagctcctgaggcagtcagggcctggatttccctcccagaggtgctcccctggctgcagcatggggagctgcctgcgtggtttcgaggctctcagtggggggccagccggtgaggcactgagctggcccgaggagagctgctgaagctcaggacgtgcagtggagctgggagatgtggatggacttgctgcgggtccgggacctgcctagggagttggcaggattcggggcttctgggggaggccaggaacagagggcggcacgggcctggggagagcaggaagctgtgtgctggctctcaggagcccagtggatgggacgcagctgagacgtccgcagccatcccaggatgcgcaggtggcgggagcacgcggggcacaggagcctgtcccggcaatggctccttgtctccggcccaagcgacccctggcatggcggacagagaggcccaggaggagccggcctcagggaggatggcttgaggagacaagccccaggacgcagcctgaccccaggacacggcctcgccccaggacacggcctcaccccaggacacggcctcgccccaggacactggcgagtgtttggactttgttgaaactgcgccacaggcactgccctgggaggtaaataaacggaaaagcgtctgactgcagcaaaatcctggcaccacctggcactaggacctctcccaccacgtggagtttagactaaggcttagggattttatgagaacggcagccactccgccacacccacacaccccgaacttttgctttgccttgaatttttctagacagcctcccaaggaggagaagcaaccctggctaggaaccggagccggagcagcatctgtggctccacgaggtcagagccttggcagttgtgcggctgtggactcacacatgtggcaggaggagatgcctgcagtcggcgggccccttgtgcttcccgtttgctgagctgcggtctctccagtcggtgggccccgtgtgcctcccccgtttgctgagccgtggtctgtccacctggatgcggcacctgtgccctctgctgcgctctgggctgtggctgccgtttgaacagtggagcctgcacacgtgagccacgtctcatcccactcgagctctcagcccctgtatgtgtcagggaggtcctgagggcgccttctccacgtgctgcggggaggcgcgctgacggccaccaagtccactggaagaaatagccttcccgtgtgaatgtggggtgctgcctgcagggacgtcctgaccgtaggtccgcaccccacccacaccaaatcgccttccgtacccacctggctcatgtgcctataagatgggagagggcctggcagagaatttcgctagagacgcagggagttgtatctgccatgtttttaaagagcgctttaaaaacggtatcactttcgaacgctcggctctcaataaaaaggagcactgccagtattttaattcctctctcgatacccagaaccaccaccaggctgtgtcaactcccgtcggcgtagagcagctgatgcccgcgggtggactccgggttcagggcactgggaccgctgcagagacgccgtccccggcccccacctgtagggtctgcagggagatgacctgcttcccgtggcggagggcaccttggcctccgcggccagggtgtgaggctcccgggtcagcacacggctttctcaaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtactcttcaaggcgagtgtgcctggggcatgggggccgtttcccttgcagctagctcccggtctcctccctctgacccagggctccccagacattactggggctgcatctgccgggggtgtgtggcctgtgtgctgccgagctccaggtgacacccacggtggttcgtggacactcaccatgaggggaggtgcgtggcgtggtgaagcctgagggtacactggctgtgccatgtgcatgcccacgtccaggacgggccactgtggagcccatggatcctttgtctccctgtgtgctagcctctgtcccttctcggggacgtgtccccacctgagctggccgctcactgtgcttcaggctcctgtgaaggccgtgctgatctccacggtgagcgtggacgtgcgtggggcagagtgagcggagtggcaggttcctccaggcgctgcccaggttcagctgtgagccggtccaggtgtggccgcagggattggcgttcccatctagttgtcattgctgagatgtttaaaaatcacaccctcagccagcacagtggctcacacctgtgatccaagcactttgggaggccaaggcaggaggattggtgagccaggagttggagaccaccctggggcaacatagcaagaccccatctctacaaaaattttagaaattagccaggtgtggtggtgcacacctgtggtcccagctacttgagaggctgacgtgggaagatcacatgagcccaggagttccagaccagcttgggcaacatggtgaaatcccacctctaccaaaaatacaaaaattagccaggtgtgttggcgctcaggagctgctcaggaggcagaggagaaaggatcgcataagcctgggagatcaaggctgcagtgagctgtgatcgaaccactgcatctccagccagtgacagaatgagaccctgcctcaaaaaaaaaaaaaaaaaaaaaaaaaaaccaatctcactccccacccccaccaccctggcatgcctccgaagcaggtgtcttttttaaatggccgttttcttacatagccacagtgcaactttcacacctaacaaaatggcagattctctggtaagaggaagatttagttgaaagtcacattttagtaaggcaggtttggggctgggtacagtggctcacacctataatcctagcatgttgggaggctgaggcaagaggatcacttgagcccaggagttggagaccagcctgggcaacatagcaagaccctgtctctatacaatttaaaaattagccaggcatggtagcatgcacctgtggtcccacctacttgagagtctgaggagggagtattgcttgaacctgggaggtcgaggctgcagtgagctgagatcattccactgcacaccagcctgggcaacagacagagcaagacgctgattctaaaaataaaatgcaggccaggcacagtggctcacacctgtaatcccagcactttgggaggcaacggcgggcagatcactgtagctcgggagtttgagaccagcgtggccaacatggcgaaaccccatctctactaaaaatacaaaaattagctgggtgtggtggcaggttcctgtaatcccagctactcaggaggctgaggcaggagaatcgcttgaacctggaaggttgcagtgagcagagatcgcgccactgcactcctgcctgggtgacagagcaagactccatctcaaaaaaaaaaaaaaaaaaaagaaggaaggcaagtttcccatcccacaggagtggtggtctccagccacctcctttgggagtccctggcccacaggatacctgcagtggtggtggtgggtgggtggtggtggtggatgggggctcggagggggctcggctcacacccctgcagcctggccggggaccaggggcgtattggcttctgagttgccaatggagcttttgacctcctgctgctacacacttcacatggtgacattctatcctgaccctctctgccaccctacaaagaaggaggccgcctgatcagtgccagttcacaccaagtgcccgtctccccctggaacaggcagaggaagaatcgtgtttctgtagcagagggacaggaggaagcgggacctaccgagacccaacccggtcactctcctcggggtccattcactttatcttcattaaaaggagctttaacatttttattttttaaattctgttaattctgtttgaaatggaatttcataatttgggggcatatacttcctagtagaacaaagaaagccctggaaaactgcaagtggtggtttaatgatcccagtgagtgactggaatggcagtttggtgcagataagacggactagatccgtggaaacacgcgcccgcatgccgtctcggtggggggcggaaggacagcctgtcggaatctcccaggcacgtggtcctgtaccctgaaccctggcagtttccacacggcgtttgcattctgtgcaacattcaggctaaataaggaagcaggcagttaaggtaggaaaattattctgtcttaatggctgacgtcccgagtggcggtcccgctccccaccaccagctgcgtccagatgaggggcttgttttatgaaaactgtgacttgtcaggccgtccctccgttgtcccgtcctctccttccaaaaatagcaggccctgtggcggtggcttattgcgatgaaaaagataaaaataagtgaaggctgaaataggtcctggacttgagaacttactttttaatgaaacttgagaagctgttattttccactgctttacaaagcatctttgaaaaatgcagaatcgtaaagaagggttctagagacgctgcgaccctgcgttttcagaatgtggtggctcctcgactgtggagtggcagaaccgcccttgttcttaccccgtttctcagccgagcgccgggcgcccagcagtgtcggacagtttagggtggaccgaggaggccgtggtggaggcttcatgtaggaggttatggaaaatccagatatttgcttgtgaaggaggaaacatttatggtagactttctaagaggttgcttcttctcaaaaaattaaaaaacccacatgagaggcggcctcttcagttaccttggcgcacacaccgaagccacctctgcatcagacacgatatacgtacagtggaacaaaagcgttttcctcttcgcttcctattttctgatctctaatttgtggctttaaccatatttttatgtacttagctcatatctactgtaataccttaaatgagagccatacaagtctaaatgtgtatgtcagatggaaaaattgaaagctgtgtattcagcaattcaatgaaaccataaaacagtcagtaaacacatctatcatgcccctttgtaatgaacgccacagccatgaaaatccatatgttcattaaggttttcaaccaccatcaaatggcgttcttactccaagaattattagatattgtcaaagctgagtacagcaaatgtcattgggagacatcttagaagttagttatttaagaataggatttggcctgagatatttctggttctatctgtgtcctacccaaattattaccctcttaggttacaagactaactttagctaaaggtgtattttctgggaaggttagcaaatactttttataattatctcttagttataggaatggaggagaatgtctttcctgttttgttttgctctttttaaaaagttatttttgatgacttgtcctctgaagaatatgcacttttctgtccctcagaggatggtggagtaagctggggacaattgcgttcctgctgcaggtttaattacgctgtgtccagtgggacggtgggccttagaagggagcctgctggacggaaagtgaggcggatggggacgctgcgacaggaagaggcaataggaacatgcccccgtaggccgtgggtggcatcacgacggccttttttgtttcctgtattgctttagtgtaaaggaaaatgacaactctaaagaaggagcagtcctgcaggacgttctgatgtctgataattctgaggcctgtgtccttgccaaactgtctggtttgtttagcggtcatagataaatactcttagacttgaataatcatagcacaattggttgttgattggaactaacataaccattgaaaaagagggaagatgcttttaaatgtgttttgtgcaattaagttagtggtacctatatgaacaaatatgctttttaaaaattgacacaaaaatcgtttatgcaagttatagtcttcatctgtgctacttaaactttttaactgcaaggattaaacagtgtatttgggttagcgtggctgaaccacattgtttattctttaagcccaaatccagttcctaaaaacaattctagcgctgcctctcccggctcttcactgcacgcagcctgagggcgtcgttgtctgtgctgcaccctggtgctcagtgggtctccagctggcacagtcaccaccactcccagatgggctctgccagggacagggatggagcagactgcatgggcctggcgtgcaggtgaccaggtagaggcagctcagctgtgtctgaacagcttttcccatcgctttcccggtcgacattcatggcagccgctgcgtccaatgacaggcacagtcaattctttgagacagaaagggaaggacaacactaatgtccccatgaaccccagaaacatgaaggaggggcacacgcccacagtagaacatgtggaagctgagtgtggcagtgtaaagggcgatggagcccccgggcccagcatgtttcgcgctgcctgcttgtgttctgatgggcggtaactgaaggtccaccaggaagtgcctggcaccccccctctcgctcgtgaaagatgcagatcagagcacctgagagggtgtccttgacaagtgttttgtcacatcgttcagccatatagaaaacagacttggaaaaatctgagatcccccaaggagccaccgctcattgcccagggcgtggcccacagcaaggctgctcctgcccccgctactcaccgcagtgtgaggatgggctgacctgaccgcccagtcctgtcttcaaaacgagactaagggtagcacccagctccaaggagagctgtgccgggtgctctggaggggtgttaggacccctggcacccggtgtccctcagtggacggccgttgattctgtaacaaggcggccagtgcccacggtgcaggcaggaggcaccttatccctgacttgggctccgatccaggaggaagttgtttctccgtgtgagatgctgaagagtccgcccattcacagagcagaacggggtctcagtcaaacctcttcccacagattagcccccaggatgtgtcctgagccctgcaggactgggcagaaggtgaggatgggcccttccaggctcccttttgctaaaccttgttctaccagagcgttcaggtgcaaagacctcgcctcagaaaggcttcagagcctccggcggctggcaggctgctcacagatctccgaaccatggtttgaacaaggcagcaggaaagtgggagaattttagtctgagaagatttggaaaatccttaggaattgctgacttccaagttgtttcactaccatctgaaaaacccttacaaggctcgggctttcctggaaaacaggagatcaggctatttattttttatttttttattttttttcctgagacagggtcttgctctgtcacccaggctggaatgcagtggtacaatctcagctcactgcagcctcaacctcctgggctcaagccatcctcccacctcagcctcccaagtagctgggaccacaggtgcacaccaccatgtctggctaatttttacatttgtttgtagagatggggggtggtctcactacattgcccaggctggtcttgaacttttggcctcaagtgatcctcccgccttggcttcccaaagtgctgggattacaggtgtgagccaccatgcctggtcttaggtcagtttttaaaacaacagcaagattttttttatgttgtttctgccatgttttaggaattgcttttcctcccggggcttgcatgtttaaatttttattctcagaacgttgaagggacgcactgcatttcaggatcctgggtctccgtccgtgaaggactttccttctgtgggtctttcctcttgcagcttaaagtgggattattttcactttattcagaggccctgttagtcacagccaagcacagacgtgctcgctgtcgctcctttgctggagtcggaagtaggacagttggtgataaagtcctggacgggcgagataagtggcattggcagagctctgttgtccagacagcaagaaaccggctgcccccaggaagcggggatggagggcacacaccaggagagggggcgttttgaccgtcggcaggggtgccacttggaagtcagatttaaaatggaatcaaaactggtagaatgagggtctgcagggggaaacttgacggagcccatcaggcgacagccttctcgaagcccctccgggcccctcacgggaggggatcccccgctgcgctgccgggaggtccggacgaaatgttggagctggagagtcggcagccctcgcgtggcgttgctgcctctgcagatgcctccggagggactcggtgtgtctcggtgttgatttcagaacaggggagatgctgacgtgtcccggtggctctcacagcacagtggaaggcgagtggcagctccgacatcctgctccgctggcgcctctggccacctgcctcccccacccccacataaaaaaagtttaaggcacatttaagctagtaccggagaaatgactgaaaaataagtatagccaagcagcagaagactctgtgtgtgggggggggagggtgcatccaccactaatgtgtgtccgtgtgtgtgggggcatccgctgatgtgtgtgtctgtgtgtgtgtggggggggcatccactgatgtgtgtgtctgtgtgtcggggggggcatccactgatgtgtgtgtctgtgtgtggttggggggcatccactgatatgtgtgtgtggggggggggcatccactgatgtgtgtgtctgtgtgtgtaggaggggagcatccactgatgtgtgtgtgtgtgggggggcatccactgatgtgtgtgtctgtgtgtgggggggggcatccactgatgtgtgtgtctgtgtatgtgtggggggggcatccactggtgtgtgtgtctgtgtgtgtgtaggaggggagcatccactggtgtgtgtgtgggagggagcatccactgatgtgtgtgtctgtgtgtgggggggcatccgctgatgtgtgtgtctgtgtgtgtgggggggggcatccactgatatgtgtgtctgtgtatgggggtgggagcatccactgatgtgtgtccatgtgtgtgtgggggcatccgctgatgtgtgtgtctgtgtgtgtgtggggggcgtctgctgatgtgtgtgtctgtgtgtgtgtgtagggggggagcatccactgatgtgtgtccatgtgtgtgtgggggcatcagctgatatgtgtgtctgtgtgtggggggtggagcatccactgatgtgtgtccatgtgtgtgtgggggcatccgctgatgtgtgtgtctgtgtgtgtgggggggggcgtctcctgatgtgtgtgtctgtgtgtgtgtgtgtagggggggagcatccactgatgtgtgtgtgtgtggggagcatccactgatgtgtgtgtctgtgtgtgtgtggggggcatccactgatgtgtgtgtctgtgtgtgtgtggggagcatccactgatgtgtatgtgtgtgtgtggggggcatccactgatgtgtgtgtctgtgtgtgtgtggggagcatccactgatgtgtatgtgtgtgtgggggggcatccactgatgtgtgtgtctgtgtgtgtggggggagcatccgctgatgtgtatgtctgtgtgtgtgggggggggggcatccgctgatgtgtgtgtctgtgtgtgtgggggggggggcgtctgctgatgtgtgtgtgtgtgtgtggggagcatccactgatgtgtgtgtctgtgtgtgtgtggggtgcatccacagatgtgtgtgtctgtgtgtgtgtggggagcatccactgatgtgtatgtgtgtggggggggcatccactgatgtgtgtgtctgtgtgtgtggggggagcatccgctgatgtgtatgtctgtgtgtgggggggggggggcatccgctgatgtgtgtgtctgtgtgtgtgggggggggggcgtctgctgatgtgtgtgtctgtgtgtgtggggggggcatccactgatgtgtatgtctgtgtgtgtgggggcgtctgctgatgtgtgtgttttgtgtgtgggaggttgtctgctgtgtgtggggagggggcatctgctgatatgtgtgtctgtgcatgtgtgggggggcgtctgctgatgtgtgtgttttgtgtgtggggagggggcgtccactgatgtgtgtgtctgttggggggggccgtctgctgatgtgtgttttgttttgtgtatggggagggggtgtccactgatgtttgtgtctgtgtgtgtgtgggggggtatctgctgatgcgttttgtgtgtgtgggggggggtgtccactgatgtgtgtgtctgggtgtagggggggtggcatctgctgatgtgtgtgttttgtgtgtagaggggtgcgtctactgatgtctgggtgtaggggctggcgcctgctgatgtgtgtgttttgtgtgtggtggggggtgtccactgatgtttgtgtctctgtgtgtgtgggggggggtgcgtccacggattgtgtctgggtggggggacgtctgctggtgtgtgtgttttgtgtgtgtgttgggggggtgcgtctactgatgtctgtgtgtggagggtatctgctgatgtgttttgtgtggggggggtgcgtccactgatgtgtgtgtctgtggggggtgtctgctgatgtgtgtgttttgcttgtgttaaaaggcgcacaccgcaggaaaggaaagtggcagtaaacacccccgcccccagccttccctcacctcagatacgccaagttccgggcactgagcaccctgcaggtgaaacagggaggaccagagagggaagggacgggggccagatttggaggagagaggacggactcctggggccaggagctggctgggcagggtgggaaccctcctgtcccagggtctgagtcgtcccccaggcaccagccagtaggcccatccagctttccatgactttcctagtaagtactgaaagaaaaaacacacatctaacactgtggcttgcccagcggggccccaggccgccatctgggaggatctgggggcaggtggctgttcagggcccagcagagccggctgagctcagaccccagtaagggtcagtcctgccctgtcagctctggggtccctggcagccattcccactctccgagccctccgtggtccctgtgaacagactgggtgactacagtacctgcctttgccgctcccggggctgttgcaaggagcaagcaggtgcacaaagggccaggcagggctgcataactgctggggaaatggtagtttgttcattccttaaaatgtaagatccttaattgctttcagaaaccgggcattcagaaatgcagaaaaatgttgcttccaagccaggcagcaagggggcaaaatatatcaaacagcgttcaggccctggcagctccgttctggccctcatcattcccagcatagagaaacaaaactcctgcgtgaaacttaagaggtgaactttgggtagctcactacagggtgaagtttaaatgtcaactttctttcaaaatgatgatcaaaaagaagaaactggttatgtgaaggtacgaatacttgactgagaaaggcgtctcgcctacggcttgtttacgcacagctagtgagagcttgcgtggccccagcaagggcacagataagattcacaggtgaggcagtgaaagccatgcctgcccttgtacttggtagtttttatatttaaaaatgtactgatttcctccttcactcaattccagatgtgtatagagaggtgggtatgagtgtgggtgtgtggatgtggcctcgagggaggctctcagcctgcagccaggattcaaaacgccacagtcgagttttaggaaaaaacaatagtttccacctgaggagtattttagagaaaaatctaatataagggaaaaaaaagccctccttattaaattaaattgtggtataacagctcaccacatcctgttgcggggacatctgacgttaggcaaagtaagtttcctctttcaggtctcccacacgccgtgagggtcacatgctacctgcaattcaaaatatgctaggaagggaaaaaaccctttgtgtctgtggaaaagctgaataagaagatggaaattatcagcagagagagctggtatgggaaaccgtaggtgtcatcggcaaccataccctacccaaggaagccgcccccggaatagcaagggcagggccgggcagctgtggctgacctcatgggtcagaagtgctcgtggcgggaaggagttggggggtgggggggcggtcctgtctttcagcccagcgccagcgagccacatggcctcagaccaaccccaggatgggcccgttgtccacctgtgaaaggggaagccgtggctttcctctcagggctacggcacaggccgtgtctgcggggcgagcacggctccacgtacggctctcgtccgcggtgtggatgggtgggcggtacagcctcctctgcggttcggttgctgtgctgtcctctgctgagtggtgtcagggttgtccatcccgctctctgtcagctgctgccatggggcagcgggaaggccctggagggtgcctgggctgtgtctggtcccggccacgcgtccctgcagcgtctgagaccttgtggaacacacttgacccggcgctgggacggggtcggcccacacgcaccgccagcccgcaggagtgaggtgcaggctgccgctggctccttaggcctcgacagctctcttgaggtcggccctcctcccctcccgagagctcagcagccgcagacccaggcagagagagcaaaggaggctgtggtggcccccgacgggaacctgggtggccgggggacacaccgaggaactttccgccccccgacgggctctcccaccgaggctcaggtgctcgtgggcagcaaggggaagccccatggccatgccgcttccctttcaccctcagcgacgcgccctcctgtgcccgcggggaacaagacggctctcggcggccatgcaggcggcctgtcccacgaacacgatggagacctcagacgccgtccccaccctgtcactgtcaccatcacccatcctgtcccctcacgcctccccacatcccatcattactacccctcaggcctccccacgtcccaccgtcgttacccctcagtcctccccacgtcccaccgtcgttacccctcaggcctccccacgtcccaccgtcgttacccctcagtcctccccacgtcccaccgtcgttacccctcagtcctccccacgtcccaccgtcgttacccctcagtcctccccacgtcccaccgtcgttacccctcagtcctccccacgtcccaccgttgttacccctcaggcctccccacgtcccaccgtcgttacccctcagtcctccccacgtcccaccgtcgttacctctcaggcctccctcctgtccctgtcgctgttacccttcagggtccactcatggcttcattatttctttgtagtgtccccacctttcccctgtgttgatcatttaggcctctttcgtccccacaatcactattctgactggagtcctttcttttggagctccgctggccagggttggatgaggacctgagcccagtctcttcatgcattgggcagcctcccttcccccacaggtggggcctgttctgagctacctgaacccccaccgtgtcttcctcctgggcaggtggctcctcctgcctctttgcagacgtcttttgtagcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacagaacagagccgtctttctctctgcgttgtgccgaggccccgcagcgccgcccgagtgtcacggaaagtgcctctggtgaggagctgccgtgcgcactctgggacaagtcaggtcctgcgtgccagtccgggagcagcctgcgagcacctgggccctgtcgttatcctccttagtgtttgtgaagagtcacacggaggggcgggagcccgggctccttctggtgccttccacactgggggcggagccctctgcagagagcctggctctgcgtcctgtggctgagtgccaggtcccgtcttgggcagggcccaggatcagcgtggctctgagcagggcctgcggggagcccacgcgtgcctgtgtctttacagaggctgagctcccacacgggacagagtcgggaccttctgtgggcgccatgtcaggaggtgctgctggcggggccgggcatgtggggcacctttgcttgcctgggtctctggccccgcagagccttgggcgagccagcctcgggtgtgtgtttgcagccagggttcctcctggagctcagtgccagtgtgtcctgttatcagttcccatgacacaattcctggttctccatctgtgttttattattgttattcttaaaaatagtcgggggttgttgaaagggaatttggggaagggagtggggtgatgaaatgcacactactaattgctccaggaagccgccctgagacaggccggggcctttgcagaaacacgtggggcttatctgggctctgggcgctccagcccatggcagagggaagcccgggcagttccgtgacgtcagcgcacgccccaccagaacctgggagggagatgggacgtggcgacagtgctggtggcacatcccctatctcagcgcccatcagggcggccacagcaggaggtgggtggggcggggatgcatgcagctcacaaaggccctaacagtgccgctcgtttcctctgcgtctgccagaagtcacaggtgacggggaacgtcactggcctgtgggggactcagggactctgccatccaaagggaaataaaaatcaggaagagcctgagagggaggctcaggcgacactggtgctgacaccacagaagtgctggtgtggacctgtgggtcgcttggttcgtggagagacagccacagcatcttcccagcatcgcggccggcacctggcacctgcactttggccgtcagagacgtgctggtaccgtgctacggacgagggcggtcactctggcgaccccagctctctgccgaggcagccaggcactggctcacgacactcatggaccagggtgggaccgaggaggaaatgtgggttcctggggagatgccttgtcacaggcgtgagcgtcactgatggagaagcagggctgggggcgttgctttgatgtttatggtatttctctaatactttctcaatttttcttttcttacagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggacaggcgtagtctgcgagtggttcatgatacgcgtggaagatgccgctttgttctcagagtgtgttttcagtggcgtgtacttggatcgtctgtgaaatgaacctcgtgttgggaaggctgtgtagacgcggccattcgccgttggaagggcatcttgccagtagagctgttccctttcttctatgtttaggtaaaaacctgccgtagaaatttgcgagacgccggatagttcccaggccctgtaactgaagcagctcagaaatgttcatccgggcgaggtggagaaggaactcctgctagtgccaaatgtttttgctcagaggaatatcctgggtgaggctctggccacacacacagtcacacgccatttgacaatcatctggcgaggaaacgtgtggaaacccacaggttctcaccgtctctccccgcttcttaaagctgctcttccccttttccccaccaaagctccctacttcacgtttgggtgggaaaatattacctggccatgagttaaaatatgaaacttggaacttctacagtaattattgttctcatctttcaggaacatttttcatttaggactttataaaatgcaagaattctgatttcttttgctcagaggtgtacagattgagttaaaggactagggaagtcatcaccacctaaagcgattagtaagcatctatcccccagttttctgcgtttgacaatatctgaagtgagcctgagaacgtcgtcgaaggtcccgcgtggggtggcgtgaggagagcacagaggccggcgtttgggggagctgggaggagacctcacaggcatcaggagccctcggctctccgagtaggggaggtcccgcgtggggtggcgtgaggagagcacagaggccactgttctggggggagccctcagctctcagcaagtaggggagagctggttaagcccttgcttttctccaactggccccagtcggggcctaacagagccttggactgttcaacccggaggcggccagcacgcgcccttcgcttccctctgccgaagcgggcggagctgtccacccagaatgcactggaagctctttcttggtttcaaagtgactttgtgaaacctccttggttgtcctcaaccccagtaacagaatattccaaaattatgaatgtatacagtgatggtttctgcagaagaggttgagcttctgcgaataaccctcttagtgtttgtgccttttaggttgattttgagtaattagaaaaatgcacccacaggctgatttccagccagaggttctgcctgtcggggggaaaagctgttgggcagttacgtgtgccaccctcgtgtacaccagaaccaagactgcgttttcctggaaagctaagagagaggtcagcttcgggaggcagtggaactaccttcctggtctttgctggcctctagcacgcggtcctcggtgaccgaaatcctgggggaaccttagggatggggcgttttctgagactcagccagaggcaaagcagccgcatctgcgcgtaagatcacgtttgctttgctcctgagcagagactgggtggcacaaaagtaatatgagtatcaagtttcccctcagagccaagtggagcccaggaaagacccaagtgcttgagcttccggccctggcaagggcatctcgttatatggacagcctggggccccttgccccagcattcccctccccacccgggacgcaccctggccccgcttctagagaaggacccaaaaaatcagctgtttccgccagttccgccacgttccccacatggcgtcctgaccagtgacatcaccggaggctgtctcgtctcaacgtgaatatttttaaaaatacgtcccgtgttgaaattaacaagctacacctgagtgagtgtttggagcgcgctcagggtgcgctgacgccgagataaaataacctctttaagagaagccccggaccagctttgtgggttttttaacattgtaaattcacctaagatt

SEQ ID NO: 17065 - DNA, 20884 bp, Human
  misc_feature (1)...(20884): n = A,T,C or G
tcagatctctcactgtctcagttataattttgcaatggtggtttcactggttttaagatggagtttattttattttatttttatttttttgagacagagtttcattcttgttgcccaggctagactgccatggcgtgatctcagctcactgcaacctctgcctcctgggttcaagcaattctgcttcagcctcctgagtagctgagattacaggtgcccaccaccacacccggctaatttttttctcccaaactgctgggattacaggcttgagccaccgcgcccgccaagatgggttgttgattttaaaacgatgtcaccctggctctcctaggttcctgttcccctaacaccatgaaggctgctggcagttctctggcctccagggaggcctccacacacatttacccatgttcttagacaatcctagggactcaaggcttcaacaaacctaaatgagccagcagaaaaataaacttgaacatgaatgtcaacgttttcccacatgtactaaagggttataataattttgaaatgtttatttcaaagagcgttggtaatttaaacgtcctatttaatccccaaaacagtcctgagggggagataaggcagttatcttcatagtacaggaaaggaaaaaagcgagggtccaaggccgactataccctcagctccattagcccccgaggcctccctgccaggcggggcggacaatcccagtgcagatgctctgtatcgatcgcatgctatcggttctttcaaggaacgtgtattgatcatcaattaagtggtgagtactcctctagatgtcgattctaaagagggaacaaaacacattagagagaagaaacataagtaactcgaataacaaccttagagagaagaaacataagtaactcgaataacaaccttagcaaactgcggaaactcctacagacaaaaactcaggtgtgggcgcagaagggccggggatgcgctcggtcaagacttgaaggcccggggcttgggccctgtgtcctcaccgagccccggggaggctccggctccgtccacacccggagcgcgactcagccgcggccggggctcttctggagaacggcgcggtcaggctctgccgcaactttcaggtcccctcggccccgtccgggtgcagcgcaaccaggctgcccgcggagccccaccgcccccatgccgccgcccgccatggttcagcccggccccgcccctcccgccggccgtggttcagcgcgtccgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctctcgtacgacgcccccaggggggcagaacgcgtgcgcacgcgcgtccgaacgcgcgtgcgcgggcggtgtttgaggccggccagtcgtgactgggcggcaatgaggtcagtgactgccgggagtcctgcaggggcggggcggcgccaagcgcagggagcccggctgagtggcagcccaggtgagcgctcagggagcccgggtgagggccgggaacccaggtgaggggcagcccaggtgagcgcgcggggtgcccgggttaggggccgggaacccaggtgaggggcacccaggtgagcgcgcgtggagcccaggcgagggggctgggaagcccgggtgaggggaccggggatcccaggtgaggggccgggaactcagctgagggggaacccagatgggcgcgcgggagcccacgtgagggggagcccgggtgaggggccggggtggctcctggcgtccgcggtcccagccctgccttccggtgggcgtgcggcaccccgggccgtgcggttcccggacagcagcttgtgggggactttcgagccccgcagcccggggtcctgcctgcgcgggttgggcgtggggggctcctcaccgcgacgctgactttggagtccttgagcggcgcggatgccggacggagggaggggacaggcggaggcggaggcggaggcggcgccgtcgcccctgacctcgcttccctcagaccggctgggcaagtacggtcagctcacctgtgtgcccacgaggcggggaggcggctcctgcagagccacagaggtgccgtcggagctgctgtcaaggacagcaggtgtcacgtgggtgtggcctccactggtcaccgagttagctggggcggaaggggacaaggtgcagctcaacatggtgtgggaggcggaggacccttggtctttcaaaacctgtaggagcggggagggacgctcggtaatggtctccaaaatgtgcgggggagagagcgggcgctgggtcaggtcagcaggaggtgggacccgcctgggctctgggccctatagccacctgctctaggttggggttgggtgtggacagtagggaggggagccaggggctccccagcctgtgtagattctgctgtaagtgactcttctctgaaagactggcgcgaggcggctgcttctgactcctgtttcagtttaccctctgtgtgaaatctgtaactatccagcttctgcttacctcactcccgtattttgatttttatttacatacaacttttcaggaaggttgtgagaggaaagagcaatggtgcaggaagtgtgagtgattgagggaatatgagatggccacagctccccactgagcttgaacacttctgtgcctcactttcagattggccgtcatggaggctgtggttgttaaggaagttcttcctgagcatccagtttccatacaaagagcacaggttctctaggtggcctcagagatgttcaatacacaatgtcttctgataacgaggaactgggcaaaagcctggtaggacaccgggtaggtaaatggtggagtccctgcaaccgtgttgcagaggaggattagctgttgctgagagaagagaagcaggccggggagcagcttgtatactgttatccccttttatgtaaaaagaagagtttatatctagaaaaacaattgacccagcaggcaccaaaaaatagtgatggtgcttggagctgtgtaagaggattgtaaatttttatttttgtatttttatgcttgtttatattttctgaattttgtgtattaaacatgtatttctgttgattttggaaaacatttttacaacccatcaatgtataattttcaaaatgttagaagtataattctcatgtaaatagctcttgtcaggttatatttcagtcattaatgcagtatacagcaggataggaatgtcagttcaaaagagaatacacaaaactaggattttcttagtgagtgggtaacaggaatgctgagagaagattgccagattagataataagattggtgaatatcctgtgtgcattgaaaccacagcctttgggattgtcttttcttcttgatggaaaggagaattagctttgcagattgtaaaatgcgtgacccacaatcagtggtaaatagtttagttatttctcctagaaagtcaagtgattgttggggttgtaaaacactgaacttgcgttagcagggaaaaaagcatgcaaccttttttttcccttttgacgtcacttccaagtttggataaattatctcaatgaaaaacaaaaatgctggtatccatagcagtttagcccccataaaccggaggagcgcatagatgcatgacagagtcgaagggttccagtggccactgagcctggttcctggtcacactgcagcaacagagctaacactcttactgatgtgtttgcattcagatttttaaaaaacttcatggcccagtgcaatagaagagctgaaaccacagaatcttataagacaagctttttgtatacattttctccaaagaaaatgaagatctgcagcgtcaagagatggtggccttccaggagttgtttattctccggctccacttcctctactgcagagaggaaaggggctggtgtggaagggcttggaagccttccagaatgaaagaaccagatgagtccattaggttcggcctccagttttttgttttttttttttttttgagacggagcctcactctgtcacccaggctggagtgcagtggcgctatctcagctcactgcacgttcctccttccaggttcccgccattctcctgcctcagcctcccgagtagctgggactacaggcgctcgccatcacgcctggctattttttttttgtattttagtagagacaaggtttcaccatgttagccaggatggtctcgatctcctgacctcgtgatcctcccaccttgggctcccaaagtgctgggattacaggtgtgagccaccctgcccggccggttcggcctccagttttacccatggaaggaacagtgacttccagctgtgcattacacttaaggactccttcatgtggcctgagccttatggtgcacagcaagggaacagtgggaacccctgtgtcccattttgcgtatcaagagtgagagggtgtggttgggtcaaggagcagaaatagaagcaaaaggagaagctgagctcttcccataccccttctgtgctgcctgacagaacaaggcctagccacacttctgtgggtgcccgccttgtgacttggggtgaaccacagctgttctcagtacaacgctgatgccacgaaaggacagcagagctctgcaggactccaggaagactgggcgcttgggctggatcctgcctctgggactggccttctaccctcatggctgagagagctgaggagttcacctcctttgtgaactcctggctggaggatgctggttggcattaactaaactcagagacccacagtaacgagttagactagaacagcaccagcttacccagaaagtcaggaggtttgagcaaagaatcagaatgggggattcactacaggactggaaggggaagtaagcattctggtctttataatctgctgtttctgcatccctaattggcacctgttctctgactgccaggagggtttgcccactcagctgtggcttacctgtttctgtttccatgtctttcacctatctgccacttttctgtagatatggtaatctctccaaaaagatatctagaaagcttgaagacctggtagctatttgctcttatggtgaagatcacacaaactagttgaacatctggcttgtagtaggtgcttcatttcccgctgctctgtatgtttctttcttttttttttttttttttttttttttgagacggggtctcatcttgtcacccaggctggagtgcagtggcgcaatctcagctcactgccacctccacctcccgggttcaagcgattctcctgcctcagcctcccaagtagctgggatcacaggcatgtaccaccacgcccagctaattttttgtatctctaatagagtcgaggtttgaccatgttggccaggctggtctcgaacttctgaccttgtgatgcacctgccttggcatcccaaagtgctgggattacaggcgtgcgccactgcactcggcctgctctgtgtgtttctttttcctgtagtcagattctggggtccagggtggttaggaaagaaacttgttttctttctttctttttttttttgagatggagttttgctctgttgcccaggttgaagtgcagttgtgtgatctcggctcactgcaacctccaccctcctgggttccagaaattctcctgcctcagcctcctgagtagctcaaattacaggtgcgcaccaccacgcctggctaatttttgtatttttagtagaggcagggttttgccgtgttggccaggttggtcttgaactcctgacctcaagtgattcacccaccttggcttcccaaagtgctgggattacaggtgtgagccaccacacccagcctgaaacttggtttcttagctccgaaatagtgaaatcaagatcagagcccactaagccagccgctcttcttggtttttggttctcatgtcctggagtccctctcaccttgaccaaaccaaagacctcctgaagcatcacttgggctcaccacttccactgaggtggatttgagtcattgatctgggcagagccttctggagtcggggattctctcgtctcaaggcagaggtcctacagaagttagtggtcttggccaagcggacattgatgcaactgtggcaaaatgggacctataagtcagagctgatgacctactcgtggaaaagtacagggagaagttttacgaggggtccatattttaacctttaacagtgttgttcacgttaacccttgtaatggatgctattccttgcctgatacctgtcctttccacccagcctgcttttctttaatgctggtaagcggtctcccctccaggcattaggctgcacttgaagttgatctgctcctgtgaagtgcataggggttcaacgatgccttgctgcacactgaataccagagccgagtgctcttgccagccccttaataccatgttcaacctgatttgtcaacaggttaacagaaatatgtttggagatgtgtaagtacactggagtcttgatatatagcatgaccagaagtgtgggtcacgagggcacacatgggcatggcagcccctcagttgtcatccatagcatctatcagagagcacgcctgtgtgccctgaactcacgcaccaggggcagcatgacacgggagccgtttctctagggagaaacatgagtaccagtgctgtctttccccacatcagatttgtgttcaaacagagctagtctgtgttaaagctggagtgttaatggagaaacagacaaactcttgtactattttgcctttgattatagaccattatcaaagcaagaggttaggagtgatcagtgctcccttgtcatttgcatcaggtcccaggactcacattctttgcatgcttgtgtgagctagtgttttccatgtccttggggtgtggtcacagcgacctttttgcctgaataatgattggcaagtttttgctgaatggccacagtgaatggctcctcctatgcttctggctctagtcctgctgtctcacaattgagtcaattctggggtctcttccggagagcagagggtccagctgcgtggggagtgtggtgttcccagccctgctgtctgttcgctgggtgtgagtgacaagagtccccactccctgcagaaattccattacctggacaagtccctgcacactgggtgaggggggaccaggcggggacctgagtctttgtcggtagccgttcctatgtcatcgttgtgtgcctgggtttcctgccgtgtaaaaggaaaggctggaatcaatcacacgtcccttccagtttttcaagaacttgagactctggtgtttgtagctttgcagacaggttcaggcttaggtaaagtggaccctttcagcatgattcagcatctgttcatgtgttccataaatgtttcttgagggcccactgtggacccagtgctgcatcaggcagaggagatgctgtgatggaaggcaggtgtggtctgtgccctcacagagcttgctgtccagtggaggtgaggattcagtaagcacttgtcctatgtgcaccccaccagcaagtctcccgccttcacagcagtcccaatcagtcacacaattcaggcatcgcaggatgaaacatatttaagtcattacactgggatacactttgttacagcactgaacttctgctgtttgatcctagttaacaccccaaacaccaccaatgagtgtttggggtatgcatcaggagcttgtagcaaaggtacttaacccagtccatgggtctcccctactctgggagggcatctggagcaaatggcctttaagtgaggacctgacaggtaagatggtgccaacttggggaaggtaaagacttttccaggagagggcccagcagctgcagagacccagaggtgcaggagagtgtgatgttttcaaaggactggaaggttatagcatggagtgagatgcaggggatggtgagagtggaaccagagaaggtataattgataatcacattctgcagagtgccgtaggtcacagtgaggagttcaggccttccctgctgctgttgagaaggcattccatggccttaaccaaggaataacatgaagaacaggagcacaggttttcgtgacatccttggggtgttaactaggatcaaacagcagaagttcagtgctgtaacaaagtgtatcccagtgtaatgacttaaatatgtttcatcctgcgatgcctgaattgtgtgactgattgggactgctgtgaaggcgggagacttgctggtggggtgcacataggacgagcataggaccgtgtgttcctgccagcaccgctccggcctcctgttcgtggctggaccgctctagctttagtttcattttctttcctcctatactgtcagtggatgttaccttggtatgtttatgcatccttgtaagttcattaagaataaggtacagaattaaatattttgtagtttaatgtttgcgttactggggtagtgatgtgtccttgtttctatcgagtcaacacaaaatgaatgatctttcttttagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggtaagtgcatgcatcagcagaagatgacatgtgcctcacgcatttaatcactggctacaatgtcctggacgctgccataaactcaacagcaggctggattgcagcacacacattcagttacaaactcattttagttgaatgcaatattctggttttgtttatttatttatttattttgagacggattctggctctcgtccaggctggaggcaattttcttaattttaagtcttttaggctttctcttccttaaggaaagaaagctcagtagattttatggctcagtagatagcgtctggaagcacttaattttttcctttcttttaatactatatttatttatttatttatttatttattttttgagacggagcctcactctgtcgcccaggctggagtacaatggcatggtttcggctcactgcaacctccgcctcctgggttcaagcgattctcctgcgtcagcctccctagtagctaggactacaggtgcgcaccaccacacctggctaccttttttgtctttttagtagagatggggtttcactatgttggtcaggctggtcttgaactcctgaccttgtggtccgcctgcctgggcctcccaaagtgctggaattacaaatgtgagccaccgtgcctggcctcttttaatactttagaaaaactgaagtaatatctgtgcgtacacacataccttgcttgctttttatttttgaataaggttgttgtactagtgctcagaagtgttgggacctagcatagttatttgcctagcactttctttctgtttttgaagaacatgttttaaaaatatttgtcacttgattgtcatattgatgtcaaaatgttcttcatgttaaactctttaaactttttttccttttgagacggaatcttgctctgttgcccaggctggagtgcagtggcatgatcttggctcactgcaacctccgccacccggattcaagcaattctcttgcctcagcctcccaagtagctgggattacagcgcccaccaccacgcctagctaatttgtgtgtgtgtgtgtgtgtgtgtgtgtatttttagtagagacggagtttcactgtgttggccaggctggtcttgaactcctgacctcaggtgatctccccgccttggcctcccaaaatgctgggattacaggcatgagccaccgtgcacagccttaaaattgtttttacatagattcttgctatcttttatgacccatcacattgtttatgggatatttgatatgaaatttgagatcctgcaaatgttcagccattcacacaaatgggtcatgttactgcacatttcttgtctacagaagactggtagcctcgagaggaaaaataagcataacaaatcactcctgccttcggggtcgaggtgggtagatgatatcagtccatcaaaagtgcactgcagtgtaaacagtacagactgttcatgcataaccaccatggacaccagccgggtgtcagatactgtgctggcacctgggaactcaaggaggaacttgtgttcctggtgtcccctgaggttggccccatctggcaccagatggggtgtgtgagcacagtgacaggaaagtgcagagaaaccatggccccagatgcggaccctctgcaggaggagcaggtgagcacctcggagttaaggcaagtgaatgagggtgagtgaggcacagtcgtcgccagtacagagcctcacagggtggccatggaagtagatggagcctatggcaggcgatactggagacatcctggtgagtgcgtggtttgggcggtggcaggaggaggttgggggccggtgtgatttgggtagaacttacccaggaagaagggttggaaccatgaatagtttgaaagagcccctccagtgacctggctactgagttcccttggcgagcaaatgactgaatatgaagctgctggtctaagtgtgggtcattttgggaacgatgctgtgacctgggaccccatcagcatcctgtacgcagcttgcagttttccagttttctctttgtgggcgttatttccataagagtgcagacttctgggatgcaggtcagggctgtgacttccctgggtttctctggagtgagatcagtgtggagtggagaggtgtgtgctggaggaagaggccttggcctgtgctccgcattgcctactcctctcacctggaaacaccggacttcaggagtcactcggctgtggcagaaaataaagttcttgaaaggaaagcagaggcgctcactcacatcgatgccctaaacatcaataccacatcaatgtcccaagtggtaaatagtgactaaattattaatacatcccacaagatggtgtgcttgaggtcattagtgtattttgagaaatagattaatagttatcttgtattttatttttattacaagttctttaaaaacaacaagaaagacgtgagtctttctgtctctccagtcctcaggggaaagcagtgttggatttctccagggttttatctgtgcttctcctggagccaggtgtggggacagcgtctccagcagttctccctcccctggtgtggtggtggagcccagcctccaggaggacagactcagcgagattttattttgaagtttgcacattctctaaagcttttagggtgctgtttgtgtagaatggagaaagggttatttaagtatttacttctaaccctgctcatgttaactgtataaagccaacagaccctaataagagaaaattataacctaaattaatatagctcagggccagtatgtctacatagttctattttgctctagttgaaatactaataaatgcagtaagaaaacactatgtctaaaatgttgaaattctttgaaattcttttaaagctgatagattcttgcatagtagtagggcatgaggattcaacatttctcccccatcaaggtctgatttgatcagaactaaaggatgtaaagacaaaatattaccatcaatttaggatgggtgtctaagtcaagcacagtggcttattcttcgtatttctgtcttagatttggttctactatttatccacagactcactagttcataatacaaatgaggtgatataaaagcactgtcaggccaagtgcggtggctcacacctgtaatcccagcactttgggaggccaaggcaggcagatcacttgagcccgggagctcaagaccagcaacatggcaaaacctcgtctccacaaaaaatacaaacattaactggtcatagtggcacacgtctgtagtaccagccaattgggaggctaaggtgggaggatcgcctgggagttcaaggttacagtgagctgtgattacgccactgcactccagcctgggcaagagtgagaccctatctcaaacaaaaacacaacccgctgtcagtttttatgtattttgtatatatacgtgtgtgtgtatatatatgtatgtatacagtcgaccttctgtatccatgggttctgtgtctggattcaaccaactgtggatcaaaaatatttgggaaaaatttaaaataatataacaataaaaaatataacaaataaataccaataaaatgtaacaattttatatagcatttacattgtattaggtattataagtaatctacagatgatttaaggagtaagggacagtgtgcttaggttatatgcacatacaaagccattttatataagggacttgagcatccgtggctttgggtatctgcagggagcccaggaaccagtcccccaaggatactgagggtgactgtatatttaagtatagatgtaactgccgggctccagagctttgcatgtgttatgtcacagattttgttcctgtagattttgctactcttctcaaagcctttggtgactttgactacaaaaattttagtgccttagtaaaaccaaagaactcttcggttctcaagctttgagttttctaaacttaaggtagtgattgcattctgatattactgttggtaatttaagatgactactttcagtaagtgaggaaaatggtggaggagaactttttgtgaattgtgagggaatggtgagtgaataaagactgagctcgcgagagtctggggctgagtgcacagtgtactgtacagttcatcactgtgtggggccttccagctactgtagaggattctgatgttcagaacatcgactcttcagtgttttgtcttcagacacacactcttttcactcctgttgatactgtacgctctcttgaggagcaatgagcactcttgcaggccctgtgccaggtgccaggtcataacaaagacgattctcagtcttccgtaagtgggaatctgtgggaggcacatatgcatgtggtgcggcacacacgacagaagattctggaagctgaatctgtgaggggcacacgtgtgtggtggtgctccagcacacacgatagaagattctgcaagctgagtctgtgaggggcacacgtgggtggtggtgctccacacacatgatgacagaagattctggaagctggaatctgtgaggggcacacatgtgtggcagtgccccggcacacaaatgatgacaaaagattttggaagctggaatctgtcagggggatacttgcatgtgactgtgcttctgttcacacagaaggttctggaagctggaatctgtgaggggcagctgtatgtgtggtaatgctccagtacacatgtgatgacagaaggttctggaaggtgaactctgtgagggttgggtatgcatgtggccccgctcctgtacacacacatgtgataacagaaggttctggaaggtgaaatctgtgagggttggatatgcatgtggccctgctccaatatacacacatgatgatagaaggttctggaaggtgaaatctgtgaggggcagatgtgtgtgtggccttgctccagtacacacacacacgtgatgacagaaggttctggaatctggactctgtgaggggcgcacgtttgtgtagcgatgctgcagtccattgcgtggcagaaggagcattgtctttcctttggtttttgtcagctctttgtttacttgataaatgcttgagtgtcttcagtttgataactagcaaaggaaaacagcgtgtgagacttctggtgtccttgcggctccatgcataggtctgtgcctgactgcagtgcacccacatgttcactcgaacaggggtacttggattgtcttagccacgctgttcatttggcctcagactgaatcctactgaagtcccatcatcagtggaaagggcttgtgagctgagtttgtccacgcagcagaagggtgggcagcagtctggatggtttacacagacacggtgagagacgttacccggacgcaaaagagtacacagcgtgtgataccgttccatgtacagtcatacgttgcttaacgacgggctgtgttctgagaaatgtgtccttaggctatttcgtcatcgagtggccgtcatagagtacctttctacatgtctaagccaactccacactcggctctatgcgacaaagcccattgttcccaggctgcatacctgtacagcatatggctgtactgaatactgtaggcaagtgtaacacaactgtaaatatttgtgtatctaaacatacctaaacatagaaaggtatagtaaaaataccatgttaaagatgaaaaatggcacacctgtgcagggcgttcactgggaatggagcttgcaggactggaagctgctctgcgagagtcacaatgagtggtgagtgtgagggcctagaacgtcactgtactctcctatagactttatgaactctgtgtacttaagcaatgctaaatttatataaaaaaatttctttaatcataaagtaaccttaacttactgtaacatttttactttataaatttttaattttttaaacttttccactcttttgtaataacacttagcttaaaacacaaatacattgtgtgtatatatatatattctttatacccttattctgtaagcttttcttaattttcgaaacttttttttaaattgttgaaatctaagatgcaaatacacattcatccagccctgcacagggtcaggatcatccatatcactgtcttccacctccacaccttgtcccactggagagacttcaggggcagtaacagacatggggctgctacctcctatggtgacagtgccttcttctggaccctcctgaaagacctgcctggggctgtttatagttaactttattttcatcagagaaggagtacactccaagataatgataaaaagtatagtatagtaaaatagtaaatgataggaattgttcagctccattataatcttgtgtggaaccactgtctatacactgtgcgttgttgactgaaataaaggcgctgagccctgggcactgctgtaggtgcagttgtccagcctcacctgggtgtgggcccacctggtactgccgctatgggtctgagggaggtgtgagatcgaaaacttgcctgtgccaaagtccagcattgtccttcaccacttatggacctggtggttgtggccagttgtcagagtgactatactgtttaccacccagacaaggatgtcagggactgccccaggcaaaccaggatctgcagtcaccccagggtctgagaaccagctatatttgtgacttttgctttggacatatcaaaaacctccaagaacttgtagcctaactctataatttcacaagtaagaaataagttatagtattaactcttcacatttcatttcaatcccatgtcacttaaccatccggaactgacagccataggttcttctggtctgtgggtttctcccctgtcccattcagtttggaggctccaggcttgttttggatcctgcttcctctgctcttcttcctgagtgttcactgtgcctcagcaatgctgagtgcggtgaagcatgtggtcctggcccaccttgaggtggccccaaccacaggtgggagtgtttcatttgcacctggggttggggtgaactaagtgcttggtatgtttgtggaaagccgaactggcggtctctgaaggcgtgtgtgtgcatgagggtgccgtgatgcacatgcgagagccctgaggtcccctctgagacctgggaaggactcccgtgacagttgtatgaggcaggctgggttactccattccgctggcctttctcttctaattgtcctcacattaattttttcagtccagacttagaatagatgctctttgactcaggatggggttacatcccaataagcccaccataagttaaaaatattgtgtcagaaatgtgcagcctcccgaacatcatggtatatagcctggcctgcctttaacatgcccagaagacttggatcagcctacgtttgagcaaaatcatatagcacaaagcctgttttacaacagaatgctgaacagctcatgtaattcagtgaatgctctactgaaagttgaaacaatggttgtgtgggtacttgaagtacagtttctactgagtgtgtatcatctttgcaccataaaatcaaacaattgtaagtcaaaccattgtgagtaggggactgtctataacagctaatatacctggggctttaaatattcaaaaacaccagaagaacgtgttagaattttttattttattttatttttttgagacagtcttgctctttctccagactagattgcagtggcacgatctcagctcagtgcagtctctgcctcccaggttcaaatgattctcatgactcagcttcccaaattagctgggattacatggtgcgccaccatgcctggctaatttttttgtatttttattagaaatggggcttcgccatgttggccaggctggtctcaaacttctgacttcaagtgatctacccacttcggcctcccaaagtgctgggattataggcgtgagccaccgtgcctggcccaagttagaatattttgccggggaggtatactgtattagtcagctcaggctgccacagcagactgccatagactaggcagctggaatagcagaaattcctttctcacagttttggaggctgcaagtctgagatcaaggcaccagcagattcatgtctggtgaagacccacttcctggtttacatggccaccttctggctgtgtcctagcatggaggaggggaaggctctggtctctttctcttcttatgacactaatctcatcatggggccttacccccatgacctcatcacttcccagggtctaggtatgggagcttgatatacctgtgtctggttttgccaaataagtattgtttatttacttaatatgagaaaattcaagataaaacaaagattgaagggatactgaaagaaaggttgaatttatcatagctttagggagcagaagccaaagagcaagaggagcaggaaaacagcatgagcgggcaagggtcagccctgctggcccaggtgcgcccacagagctggtggcctcctttcagaatgaagtcccaatgagagcagagccctggggaggaaattcttttgctttgaaatgaatttgttttgtttggtaagtaaggtagcaaatacctttttgtgatgtgaagaatgaattttggcagtttcgcattgacttgtgcatttgtcttctctccatgcaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacggagcaagactctctctcaaaaaaaaaaaaaaaaaaaaattctagaccgaagtgtacggcagtgccatctggtggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgttt

SEQ ID NO: 17066 - DNA, 20168 bp, Human; identical to SEQ ID NO: 12833

SEQ ID NO: 17067 - DNA, 95255 bp, Human
  misc_feature (1)...(95255): n = A,T,C or G
attattagatttttgtaatacttattaatacatttttctcttatcttttggaatagcatttcctggttttaaaaaaaaaaacttaaaagggggcaaatcggcaggagactgaggaaaagcctaaatgtattccccagaaagtatgttttaaattttaacatttacttactgagaggtgaggccagctgaacttcctgggtccagtggggacttgaggaactttcctgtcttacaagaggattgtaaaatgcaccaatcagcgctctgtaaaatgcaccaatcagcactctgtaaaacgcaccaatcagcaggattccaaaagtagccaatcgcagggaggattgaaagaggggcactccgataggacagaaatggaacatgggaggggaccacaagggaataaaagctggccaccaccagccagcacctggggttctcttccatgctgtggaagctgtccttttgctcttcgcaataaaccttgctaccgctcactctttgagtccgtgccatctttaagagctgttaacagtcaccgggaaggtctgcagcttcattcttgaagtcagggagaccacgaaccccctggcaggcaccaactccgacacattactaggcgctaagcattgtgctagagagtttgctgtggtataggggcaacaatctttactttggaatgagaaaaactgtttcaaacaacttacttgccatgagtaatttaatttctctcttttctataaaacatgggtaatatttatctcacaaggatgtttgggattaaaaagtgacaacctatgtcaataggacagcatgatgcagtgtaggtcttcaatgaatagcatggagagtgcttgcaaagggcaacgataaaatctaatataaataagacgttgtagacaaacgctttaaaaacacagggggtaaggtctgatgtgccagcgtcactacagacgtacttagaaaagtgttctggggatctaagtaaaggaggactcccatttgctgggagtgagaaaagagctttagggaaactgcagcgtgatgggcgaatcctcctttcaatatatctaccctgaaagtcggctccagccctgccgaacatcctggcccagctgcacccgacccagcgtgagatgtcaaatgacctcttggcgcttccacgccagactggaggggctctgcacaagccttgcccgactcattccgggcaccttgagcgtgggagtccacactgccccttgaccgaccagctgccaggttggccgcactaacttgagcccacccccactcgaagctccgcgccgacagcaagtggagacttgggggtaccggatagaggaaggaactcccaagttgtcagcttcagaaccatccacgcctcccccaacacggaaccaccttcagcctcccagctggtatcccaccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgcgttgctcttgcttttcctcgctggggtgtacggtaagtgtccgcgtccccgcgccccgctgaccgaacaaagctgaggcgacccgggccccgaggcctccaggacgggggttcccctggagactcccgcggagaccctggctaccggcgggacaaagaccggtgagggggtggatgtggcggaacgggtgtccccacacggagatgcttttctccactcgtccacctccagaccctcgggtggtggagaggggctggggggcccggccgggagggccccggcggagcgagggggtggcgggcggacttcccgacctgggttcgagggcccccgcggccagttgctcgaggacccgtagcctggcacaatccacacacaaagatgcttgactgtgagaaagcagaggagctcgcccccgccgctgccgggacggtccttccccccgccccctcaacccggggttaggaagttctctcaccggcgagattcccaccgcgccagcccttgtcctactcgattccctgaaaaggcttcccgctgacttctccccactccacctcgggggcaagggctctgccgaatccgggcgtgcagggtcctgttggttccccgggagcagcacgcgggagaaggccagaaaatagtttccagccccacctcagtctctcctgttagggtgtacacatctgtcctgactcctagttcaattgtaatttcatccatcctcgtccgccgctgtggtcactgttactttattccagtcgatggatcgggttagagataactcctttcgggttaagagaaggctgaagactgtgcggacagctttatattgcgttggggtctgagcaagagctgaatggaattaattgcaaagaacatctatctcttaagataattaagttacacttctgacttcaccgttcttagttcatcagttaaacacactgaataggtatttcagagagctcagttttaacctttcctttttggagtgttgctctgatttctccagaaaaagaattagaagatatcattactttggtaaattttacttataaaaagtctaattcatttgccacaaacattgatttgactagtataatggtggtggtggtgaggtttagtcaacagccaatttgtcagcaagtgttatctcttttgaaggcatttatctacggaattgaatgtgatggtggcttttgaaacctggcaagtgacgctaaatgaagaattaatgaacgtaattgggcatttactgacagccaagaaattctttttggtacaattaaggatgtgttgctcccgtacctgattagtagtatttttgtttgttttggtgaggagagtagtttggtccattttttatgtaggggtaattgccagaggtgtgcttgtgtgggaccaaaaacccagtacacgacttttgattgttagctgcatcaagtggctgtaatccctgcttgcctgatgacttgtgggtttgggtctacaccagagatcaataagctattacgttgtttcttctgccctgaaggtgggtatagttctgctctaggtttggtgtaatggcccaggagagagaagaaattgagaggtatctttaatttagggtgattaggattgtccagctttgtcctctactataataagcattgaatttctgtgatgtccgatcagaatagataaataaatgggctcttctttcattaaaacctgtgtcatcagtgtttgaactagaagtcttttgcctcgagggataagaggctgtgaacccctcaatttgttttggtgcattctttagtacttgtacacaaagtgactttctggtaggtgcctatcaaagcttttatctttttggaatttgtgttcagtgaggaacacaaattgttagtaagcaaagactgaaactcctttttccaacagtgtgggccgcagattataaaaccagcaggtgattatgccaaaggttgatgtctcaagccacagcaggtttcaaagtgtaaaaaaaaaaaggaggtagtgaaccaggcagaacattaaactatatcagcagagattaaagggaacccttcaccctggaactgagaaatcctctttatggctgcatgttttttgtcctcttctgtctctaaccatatgtgggtttataatagtgaaaaagggctgtaacaatagtatggggtggatgtggttctataacaatagtgggaattgagtaacttagaatatatagtagttgtaatgggtggtggatgcatcctgagaaatagctgtcgccttgagcctgttagaacagatactagctgtaatttatgaaactgtcctctatacagtaaaaagtgtgtgtgtgttttaaaaggcttcaaaaataattagctctgttaatgaaactgaatattcacaatcactgttaacaaagaaaagcaggttgattggccaatatttagggaactccaatattaattcttcacagagtgactcttaaatgaaatgactctaaggtgtgcttcagatttttgaaacatttcacatacataaaaaaattttttgttgtttattttggtgctactttccagatgacgattttatgggctctgatatgtgactgttgtacttccaaattaacttttctgaatgccagagtcttacctgaaactctaaattgtaatctagaatataatgttttctagaagtagttgttcaaggacctgtaattatctttcaggggctactgtatcttaaccgcattcaatgtgcctaagagttaggagagagtaaaggttgacctctgccacctttgaaagtttgaagggataaaaatatcagtggtgacaaccacaagctttgctacgcattgtcctaggcttactgtaagaggaaaaagtgctttgtcatttttcacatagggatgtctcgcttttacaaatctatgggagtttccaaaacctctgtctcctagtcaatagaagctgttagtcttgctcacctcctaaaccacaatttggtaattctgacagttcccgttgactttatcctttccacttactgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaggctgaggcgggtgagtctcctgagtcaggagtttgagaccagcctggccaacatggcgaaaccccgtctctattaaaaatacaaaaattagccaggtgtgctggtacatgcctgtaatcccagctactcaggaggctgaggcaggagaatcacttgaaccaggaaggtggaggttacagtgagccaagattgcacgattgtattctagcctgggtgacgagtgaaactctgtctcaaaaaataaataaataaataaatgtaatttagaatgtttcttgtttgtatatcattttacaataaacttcaagagttgcagatggttaatttttggttacttgctgccagagcatttgatagtcgtagaactgttcacagcatatactgattgacttgtgataaaattcatttttaaactggttttcagcttattacagtcaagagtctttactgttcacagtagtattctagatgttgtggtagcctaaaataatctttttactttgcatatatgtaatggatgaatcttttcccatgaattttatggaatgttcagtagcacttaataactggtttaagggtagacaagaaattccaattttagaaaggttgtagaagtaactggaacatgagggaaaaatctaaaccagataccaattacttcttacaaagtcaagtttgattacataaaatgtgttgaataaaattgaattaattgcttaacataaacccttccttgagttcagaatctaaattatatccatatccttgggagaatatgaaggtgggcagcacattccacaaaattctaggtggttatcaggcagaaagtattaaacaagcactgttaactgtattctagatagagtatggaggagatttgaatgatgtatggtaaatgatttataaggttcctagaaagtaaaatttcttttgaagaacataaaagggattttagcctgaaaagtgagcagcagttaaagaaaatgttgagatttacttttgtaattagaaaatttaaagcttattaaaatattaagggaacaagagggcctttttgtgtttctgatatgagatgttgttccttttttttttccccactttaccagtgataccacaatttaaggggtgaaagttcagtaaaaatatatatgaaatataagtgagaattatatagatttaagtaaacatagaatatttttattttagatattaatcctgttcttactgcaagtctttataagaagaggaaggttgttctaaatttaggaattggaagttgatgatctctaatttctaaggttacctttcttttctgtttttcttcttttctccttatcactccctgctttttgagagagttaagtaatagatgtacattatttattcccattttctaaaatttaggattagatcctgcaaatacaaattaccaatgtatctattcaaatacatgttatcagagtctcttctttttaagtatatataaatatattatttcaatactgtattagcttagggaattcttactgtctaagttatagaagggaaggaaggaaactaacattaaattaagtttaatagcacttatttacttacaagtacttaatacttacattgaaagatgcgtgattagtctttatttattgccaattaatctttagtaggtcttatttggcaatcctgtcagatatgtactctttcttttgttttatggaagagaacattgaaacacagaaatattgtgacttaactgaagtcaaaccagtatgaagtagtagagtcaggattgtagcctaaccctggctgtctcttcacttagttcatttagcaaatatttattgagcccttgcttatgtctagcactgtgttagataaaacctgatgcacatagtttctgccctcatggagcttatagtctaatgaataagttgtaataagtgctctcaaagaaacagacacggggcagagatagtgagtaacaggcacagagtaattaggggaagactttttcatgaagggacgtttatgagacctaaagcatagctaactgtgttatggttgggtaagaaagctttacatatgagaacaatgcatgaaaggcccaggatcaggaaagagctggtatgttgcagataaattactaaaaacactgtaactggaacataatggttgtaagggagagtgacaggatgagattagagcaatacttagaaactctaggatttagaatccatggtaaagagtttgggttttattttaactatttaagtgacataatgtgatttatgttttgaaacagtcacatttgctactatgtggagtattgttgtgaagtgggaaacagtagagatgggatgatcagttaggagattttggctgtaatccaggtgagagataacaggagcttggaccaaggtagtagtagtggagataaaggagtgtaggttgccctgttgatagagataaggggatttttcctcttgccgtaagaggtaaagaagaaaatattggtgcaagtgtacttaggtctgtaggttttggggtgggaaggtggacattacatctgatcgttcttattttctcaaagtaatatgacataagatcatcagtgaagaggaggaatgagaagttgagggtgatttttgttccctcaattcagtagaatggtttggacgcttagcaagttagatttctgttatttaatctagaatagagaaggctatgaacactatacaagcacatatattatgaatagttgtacagcagatgacaggaagagatggacttaaattacaaggggaggaaccttaagaagggttctgtggagaactcagttctgagggcagtcattttgtcaatgaaataagtatagaacataactttttacaatgttttaagtgtatttcaggcaagaagcaaagggtggagcaaaagctggatttccaatacctttttgccaaagttaaatgctttctgctaagctatcaataaagattgctttagaaatcagattgtctttggtagaggcaagaatgtattaaaagattggtgaatttcagagcagatttggaaaaattgagcttttatcttttttttttattgtgtagctttacagaagatataactttagtaggtcccaaaacttcaaagtaaataaaactgacaaaagagttttctagttttcctcttaaatagttaataactcatttacttgctggtatcagtttggtgaagatgtgaaattgttttatgctcatgttttgtcattgagtgagactaacttgatacctacctttaattcacttacatttcagtttttagagaaattaaaaatgatgccaatcttttaatattaggattaaatggagcacaataggatgtttagtagttggaatttactttttcaaatataagtgagtaaacctttcataatctgacttaatttcattaatagttaaggcatctttttacatatattggagaaaacataagaataatctttgtatctgatatattttgaagtagaattgtttcgtgaaattattattgcttgtgaaagttttgctaagagaatacagaacacctatacaaaaaatgccatgattaattctcaaaatcattgtgtgaggtaggtattattagaagaaactgaagctttgagaatagtagttttgcctaaggttcatgtctgtctactgctgtgctcttcgtgtagaggcccattattttttttttgtctacattattgtaacagccaccaactagtcttagctctagtcttgtcctgattgaatcatatcacacttagcagtagccagagtgacttatctaaagtacagatctgataatgtaactttcttgcttaaaacccaacagcagttccctgttcttaaaatataaattaaactcagcagagctttcatgatctggctagttttttttttttcacttttaagttcaggagtacatgtgcaggtttgttatataagtaaacttgtgtcatgggggtttgttgtacacaattattacatgggggtttgttgtacataattattaatctgtttgttgtacagattatttcatcacctagtgatatgttacatcatatctagtgatatctgtacatcatatcgtatatagtacccagtagttattttttctgatcctctcctttgtcccacccgccaccttctgacaggccccagtatgtgttgttccccttcctctatgtgtccatgtgttctcatcatttagctcccacttataagtgagaacatgcagcatttggttttctgttcctgcatttgtttgctaaggataatggcccccacctccatccaagttcctgtaaaggacatgttcttgttcttttttatgactacatagtattctatggtatatgtgtaccacgttttctttatccagtctgtcattgatgggcatttaggttaattccatgtctttgttattgtgaatcagtgctacaaggaacataacacatgcatgtgtctttataatagaacaatttatattcctttgggtgtattcccagtaatgggattgctgggtcaatgatatttctgtttttaggtctttgaggagtcgccacgttgtcttccacaatgattgaactaattacacttctcccaacagtgtacaagcattcctttttcaccataacctcgcaagcatttgttatttttttgaccttttaataattagccattctgactggtgtgagatggtatctcattgtggttttgatttgcatttctctgattggtgatgttgagctatatttcatatgattgttggctgtatgtatgtctttttttgaaaagtgttcatgtcctttacccagttttcaatgggtttttttcttgtaaatgtgttttaagttctttatagatttagattaattttttgtttgtttgttttgttttttttttgaaacggagtcttgctctgtcgcccaggctggagtgcagtggcacaatcttggctctctgcaagccccgcctcgcgggttcatgccattctcctgcctcagcctcccgagtagctgggactacaagcacccaccaccatgcccggctaatttttttttttttttttttttttttttagtagagacagggtttcactgtgttagtcctgatggtctcaatctcctgacctcgtgatccacctgcctgggcctcccaaagtgctgggattacaggcgtgagccaccgcacccagcctagattagttcttaatagatgctggatattttgcaaattatgaatctttgtcagatgcgtagtttgcaaaaattttctcccattctgtaggtagcctattcactctgttgaccgtttcctttgctggacagaagctcgtcagtttaattagattccatttgtcaatttttgcatttgttgcaattgcttttggcatctttatcctgagatctttgcctatttttgtgtctagaatggtattgcctagcttgtcttccagggtttttatagttttgggttttatatttaagtcttcaatccgtcttgagttaatttttgtatatggtgtaaggaaggggtccagtttcagtcctctgcatatgactagccggttaccccagcaccatttattgaataaggaatccttttcctatggctcatttttgtcaagtttgttgaagatcagttagttgtagatgtgctgccttatttctgggttctctattgtgttccattggtctatgtgtctgtttttgtacgagtaccatgcagttttggttactgtagacctgtagtgtagtttgaagttgggtagcatgatttcttcagctttcttctgtttgcttaggattacctctgctatttgggctcttttttggttctatatgaattttaaaatagtttcttctagttctgtgaagaatgtcaatggtcatttaataggaatagcattgaatctgtaaattggtttgggcagtatggccattttaacagtattgattcttcttacccataaacatagaatgttttttcatttgtttgtgtcatttctgatttctgtaagcgtagttttatagttctccttctagagatctttcacctccctggttagctgtgttcctgggtattttattctttttatggcagttgtgaatggaattacattcctgatttggcttcagcttgactgttgttggtgtataggaatgttagtgatatttgcacattgattttatatcctgtgaatttgctgaagtagttaccagcttaagaagctttgggcccgagactatggggttttctacatataggatcatgtcatttgcaaacagggataatttgacatcctcccttcctatttagatgcgctttatttatttcttttgcttgattaccctaaccgagacttccagtactatgttgaatagcagtggtgagagagggcatccttgtcttgtgtcggttttcaggggtcatgcttccagcttttgcccattcattatgatgttggttgtgggtttgtttgtcatagacggctcttattattttgaggtatatttcttaataccttgtttactgagagtttttaatatgaaggggtgtggagtttcatcaaaagccctttctgcatctgtcaagataatcatgtggtttttgtctttagctctctttatgcgatgaatcacatttattgatttgcatatgttgaatcaaccttgcatcccagggataaagcctacttgatcacggtggataagctttttgatgtgctactggatttggtttgcaagtattttttgaggatttttgcatcagtgttcatgaagaatattggcctgatgttttcttttgttgccagtaagttttttgtttttgcttgtttgtttttttaataccaaaaccgccatcaggttttggtatcaggatgatgctgacctcatagaatgagttaggagggagcccttcctcttcaatttttttgaatagttacagcaggaacagtaccagctcttctttgtacatctggtagaattcagctgtgaatccatctgggcattttttggttggtaggctgtttattactgacttaatttcagagtttgttattagcttgttcagggattcagtttttttcctggtttagtcttaggaaggtgtatgtgtccagtaatttatccatttcttctagatttttctagtttatgtgcatacaggtgtttgcaacattctctgatgattgtatttctgtggggtctgtggtagtatcccctttgttgtttctgattgtgctcatttgaattttctctcttctttattagcctagctagtggtctgttttattaattttttcaaaaaaaaaaccagctcctggatttgttgatgttttgaatggttttttgcatctcagtctccttcagttcatctctgattttggttatttcttgtctttactagctttgggatttgtttgctccttggttctctagttcttttagttgtgatgttaagttgttaatttgcaatctttctaactttttgatgtgggcatttagtgctataaatttcccttttaatactgccttagctgtgtcccagagattctgggatgttgtatctttgttccattggtttccaagaactttctttttctttttttttttttttttttgagatggagtctcgttctgttacccaggctggagcacagtggcgcagtcttggctcactgcaagctccgcctccctggttcatgccattcccctgcctccccctcccgagtagctgagactacaggtgcccaccaccacgcccagctaatttttttgcattttcagtagagacagggtttcaccttgttagctaggatggtctcaatctcctgacctcgtgatctgcctgccttggcctcccaaagtggtgggattacaggcgtgagccactgctcccggcctgtttccaagaacttcttgatttctgcctgaattttattatttacccaaaagtcattcaggagcagattatttaattttcatgtaattgtatggtttttagtgagtctcttagtcttgattcctaatttgattgcactatggttcaagagattgttttttactatttcatttcttttgtatttgctgaggagtgttttgcttctgattatgtaatcaattttagagtacgtgccatctggcaatgagaaacatgtatattctgttttagggcggaataattctgtagatatctgtcaggtctgtttgatctagtgctgaattcagggtcctgaatatctttgttaattttcctgttttgatgatctaaatactgtccagtgaggtgttaaagtctcccactattattatgtgggagtctaagtctctttgaaggtctctaagaacttgccttatgaatctgggtgctcctgtgttgagtgcatatatatttaaaatcttcctgttgaattgaacccattaccattatgtaatgttcttctttgtctttttcgatctgtgttttaaagtccattttatctgaaactaggattgcttttttcttttttccatttgcttggtagatttttctctctttattttaaacctatgtgtgtcattggatgtgagatgagtctcttgaagataccatacctatgcatcttggttctttatccagcttgccattctgtgtcttttacttggggcatttattccatttacattcaagcttagtattgatatgtgtggatttgatcctgtcatcatgatgtttcctggttattttgcagacttgtttatgcagttgctttatagtgtcattggtctgtatacttcagtgtgcttttgtagtggctggtaatggtccttccttcccatgtttagtgcttcattcaggagcccttgcacagcacgtctggtggtaacgaattccttcagcattcgcatgtctgaaaaggatcttatttctcctttgcttatgacgctttggcaagatatgaaattctgggctggaatttctttaagaattttgaatattggcccccagtctcttctggcttgtagagttgctgctgagaggtgtgctgttagtctgatggacttccctttgtaggtgacctgctttttctctctagctacctttaatattttttctttcattttgaccttggagaatctgatgattacacaccttggggatgatcttttgaaatgtcttacttgagttctctgcattttctcaatttgaacgttggcttctctagctaggttggggaagttctcatggatgatatcctgaaatatgtttaccaagttggttccattttccccatctctttcagagacaccaatgagttgtggatttgatctctttacataatcccttatttctcagaggttttgtttgttcctattcattcttttttctgttcttgtctgactatcttgtttcagaacgccagtcttcaagctctgagattctttcctctgcttggtctgttctgctattaatacttatgattgcattatgaaattcttaaagtgtgtttttcagctctatcaggtctgttacattcttttctgtagtggctgttgtctgtcagttccagcgttgttttatcatgatttttagcttctttggattgggtttcaacgtactcctgtagcccagtgatctttgttactattcatattcaaatttctatttctgtcattcagtcatcttagcccagttcagaacccttgctggagaggtgatgtggtcatttggagggaaaaaggcactctggctttttgagttttcagagttcttgctctggttcttactcatcttgtgggcctgctaccctcaatctttgaggtttctgatctttggatttttttttcccttttatcctatttgataacttcgagtgtttgtggtataaggtggatccagctgactgacttcatttctggaagattttagggggccagtgctcagctcccgactcctggacggcttgctcttaactctgggggacttgtattgggccccgactttgttctctggttcttcaaggcttcgaaatccactgcgctggattgggggaccaacttgcagcacctgtggcagagcactagcagtgccagggtgcctgccttcctgtgggtgttcaccacagtggtggaggcaatgcagctggtcagggtgtcagggacctgctgctggtaactggaggtgatgttggcttggggctctagtcacactgaagctgatgttggcttgggggcagggcactggtggatctggattccttctctgtgccctgcaagcaggaatgatcactcaggggcaggggatctggctagtttttatctttctgcctcatcttggtcattccccttcacccctgcccttccccctctcccacaccatgttcctgccatacttgtgacttccagtctttatacacgctgttccctctgcctgccttatttctttctccaccactttcttctctaggttaactcctgctgtccttcagctttcttcccattgctgcctcctttggggagtcttcctggttcctcaaaactaagtgcccttcttagaagcatctcagatataatgtgagcctcaagtgtaaatcacatatgtagttttgaattttctattaaccacatttaaaaaaaagaaacaggtgaaattaatgttaatattttaaaactaatatatctaaaatactatcatttcaacacgtgatcagtagaaagtaattattaatgagaagctctacattatgtttttcatgctcagtcttcaaaatccgttgtaaattttatacttacagcccatctcaattcaactaaccacattttaaatgctgaaagccacttggaaaacagtgtctattaaagctgtatgtaaacatgtcctgtggcccaggaattctgcctctagatatgaactcaacaggtatataatgtgtgacaaaagacatgtacaagaatattcatagcatccttattggttataatcccagactagaaacaaccctatggccatcagcaatagaatagatgaataaattatggtatattagcataagataattctgtttagcagcagtttccaaactttcgggtcgcaggactccacagttattgaggaatccaaagaatggtttttgtataggagctatatatgtttttaagaatattaggaattaaaattgagtaattattaaaacattaattcatttaaaatgacaataagaaacctattacatattaccgtaaataacatgttaaataaaaatatgtaagatgacaactatattttccaacagaaacaaaaattttttgagaatagtggcattgtcttagtttttgcaattaccatagggtcagatttatatgtaaaacatatttagtataatgccagacaatacttgttgaataaatgaattcatctatctataaatggagtaaattacatttatgtgattcctaatgttgaatcatttttgcattcattcatagggcataccaccttgctaatgatatattttaatctgctagaatacatttactgataatttttatactttgcatttatatttatgacatcagtccatagtcagtcttagctttcttctgccctctacctctttttttccttcctgtaacctaacctccctcttcttctgcttgattttcatatctgttaatccattcttttagatgcacttacgatcttttttttgttgagttcagtgtttagaagtagtataaaagattctagtgttccagttattattattttgccttttaagattagaaaaagagaagtaagtgattgtttatgaactatataggtactgtaacaggaaagcaaaaattaaaaattttgtactaataaatgccgaggggagaaatgttttcattcctagtatgtttagactttatttcactaaccaagataatacagatgagcctgtaagaagtagatcccttcttacgcatcagctataggattaagtaagccagtaagagacctcagtggagatagatcagttccattagaagtggaactcacatctgaaggcaggagctgtgtgggaggtaaaatggagatgctaaatgaggactgagctcaagtcagggggtaggactcctgtattctgtcagtagggtacatccggtttgtgtggatgacactttaagaccaaactaatttgctcaaaaagtagcagacataaagttaaccaaaatatggctccagtgctatctaaactatgacctagtagtgtactaacatgattacttgtatgtaaaagtatttgcccaggtacaaaggatgggagattaaggagaacctactactatcggtgctgctggagtggatcactgcacaggggctaggagccatatgaaaaatacaatcgagtattaagaaattgcataaattacatttgtatacgattcaacttaacattattttttctactacgtaagaataagaatctgagtgtttgatttgattgctttgtgtgggtgggttagagagaattagaatacatgatttatctctggtctttattttattaattcttttattccctgatctaagtagggggctagctacgataaatagaaattatgttttttaaaggtttatttgaactctactctaaaagcatatgtccatgatgcctttggggaaataactctaattttcaattccttcatccttgagtcagttttgctaatttatattaagttatatgttctagaacattattttacctgtatttccatatttgctttaaatttataaataatattatttttaaaatattttctacatccgtgattatatcaccatagtcattcctaatacccatctgtctcttgtctgtcattcttttcttgaacagacttatcaaaggtttctttattttagacgttcttctcaaagaaccagctcttggtttcatgctgtactgctttccttgttttctgttttattaattttctttcactatttctttattttgttgattttttagctggttgtttatttttaaattttgttttatacattatacagtaaaactgactctctttttttctggtgcagttatgtgactgttaacacatgtacacattcatgtagctgccactaaaatcaggatgtagaacagttcatcacccccagaaaactcttgcctgctcttcctttatagtcacaaccatgtcctcacccataatctgtgatagccactgagatgttcctaaccatagttttgtctttttaagaatgtcatataaatggaattgtccaacacataaccatttgagactgactgcttttactcagcataatatcttggagattcatgcacattgttgcatcaatcactagttttattccttgccattttatggatataccacagtttatcagttcacctattgaaggacatttccattgttttcagtttttagctattataaataaaacttctacaaatatccagtacaagtttctgtgtggacataagtttttatttctctaggtcagtggtccccagcctttctgacaccagggaccagttttgtggaagacaatttttctgcagacctggtgggaagggaggatggtgttggaatgaaactgttccacctcagatcatcaggcattagattctcataaggagctcccaacctagatcccttgcatgtgcagttcacaatagggtttgcagtctgccaccaggannnnnnnnnnnnnnnnnnnnagatttggttgactcatagttcagcatggctggggaggcctcaggtaaacttatggtggaaggtgaaagggaagtaaggcaccttcttcacaaggtgacaggtaaggagaatgaacacaggaggaactaccaaacaattataaatcatcagatctcatgagaactcactcacaattacgagaacatcatggaggaaaccacccccatgattcagttacctccacctgatctctcccttaacacatggggattataaagattatggggattataattcaagatgagattttgggtggggacataggcagaccttatcaggtggtagtgcttgctcacccaccactcacttgctgctgtgctgcccacttcctaataggccacggcccattactggtctgcagcctgggggttagggactcctgctttaggataaatacttaggagaagaattgctgggtcctaagttacacatacatgcttaactttttcagaaactaccaaaccgttttccagagtgactatatcagtttgcattctgactagcagtgtgggagtgtttcaattgctctgcatctttgtcagtacttggtattgttaatatttttatttttgtcattctagaagggatatggtggtagctcgtctggtttgcatttgtattttttaatggctaatgatattgaacatcttctcatatacttctttgccatcttgtgtgaaatgcttgagttcattactcatttttaattgggttggtggttttttgctgttgagttttgggagttcttatatatttttcccccctctgaatctgtagcttgtcttttttttctctagacagtgccattggcaaaggaaaagttttaaaatttgatgaagttcaacttgtcagttttttaatgagttgttttttgtgtcatttctaaaagctctttacctaatcccagattagaaaggtttccttctgctttttttctgaaagttttagagttttatgttacacatttaggtctaaaattcattataatttatctttttaaaaggtatgaggtttaaaaaagaggttcagtttttgcatatggataaccaccaattgttccaacactacttgttgaaaagattattctttcccattgagctgcctttgcacgtttatcaaagatcaagtggctatatttgcatgagtctatttctggattatattctgttccattgttctgtgtctatcattttgtcattaacacactttcttaattactgtagctttatcctaagtcttaaaattgggtagcgtatgcaatcctttcagttttattctttgtaaaaattaactattctaattccttttctcttccatatacattttagaatcagcttgcttttatctacaaaatgtcctgcagggattttgattgatactatgttaaatttatagattactttaggaagaattgatacctttactatgttgagttttctaatccatgaatgcagagttgctctgttaatttaggtctttgatttctttcattagtgtttcatagttctcaacacacagatcctttgtatgttttgttagattatacatatttcatttggggggagttataggaaataatattgcttttaaatgttgatttttaattgttttttgcatgtatatgaaatgtgattgatttttgtgttgaccctgtgtctaaactcacttattagttctaggagtatttgtgtagatttctctcaaattttctgcataattatgtcttctgtgaatatggacagtattatttttgtgtttcccaactatacacctttttttaatttatttattttcttgccttattgcattggctaagacttttagtacactgagtaggagtggtgagagtgcttgcctgttttccatcatgggcggaaagtatttcagattccaccattaagtatgttagctgtaaggtttttgtagatgccttttaccaagttgaggatgttcttttgtattcctagtttgctaagagttttattatgaatctttattatgaacattattatgttgtatttagaaaaatcccttttctgtatctactcatgtcattatgtgatttttcttttttgactgttagtataatggattacattgattgacttttttcaaatatataactagcctttcattctgaggataaaccacttggttgtagtgtattatgctttttaaaaaataacaattttaaatgatgaacttcagcttttaaaagtgtacaattcagtgtttagcatattcacaaagttacacaactgtcaccactatctaattccaaaatatttgcattggcccaaaaggaaactctgtacctattaacaatcactacccattcttcctactctctagcccctggaaactacaaatcaactttctgtcactatggatttgcctattctgggcattcatataaatgaaatcatacaatatttggtcttttgtgtctggcttctttcatctagcataatgttttcatggcttattcatgtcatagcatgactgtaacatggctcagtactttattcccaaaaattccattgtatggatattctactttgtgtatctgttcattagttgacagacatttgagtaatttgcactttgggactattatgaataatgctatgaatatttgtgtgaaagtttttgtgtggacacatagtttcagttctcttgggtatatacagaggagtggaattactgactcatatagtaattctgtgtttacctttttgaggaactccaaactcttttccaaagggcagcactattttacattcccactagcagtatgtgagggttccagtctctccacatccttgccaacactttattgtctgtctttttcattacagctgttttaattggtgtgaagttgtatgtcatggtggttttgattttcatctccctaatgggtactgatgttgaggttcttctcatatgtttattggccttttgtgtttatactctgaagaaatgtctattcaaatcttttgcccatttcttaattggttagagtatctgtctttgttgttgagttgtaagagttctttaaaaattgtggttattaaccccgttatctgatatatgattttcaaatattgtatcctgttttgtagtttgttcttttactttcttaatggtgttctttgaggcacaagtgttttcaattttgagacagtccagtttacctagtttttgttacttgtgtctttgatattatatctaagaatccatttgctaacccaaggtcataggggtttactctggtgtggttttttaattcccctaagagttttataattttgctgttatatataggtttctgatccattttgacctgttttttgcatatgatgtgaggtaggggtcaaattcattcttttgcacatggtttcctttgttccagcattatttgttgaaaaaaccagtctttctcccatttaatcctcctggcacccttgttgaaaatcaactggctgaaattaatgagagtttacctctcagatctgtattttatgacctatattgtctatccctatgctagtaccacactgtcttcattagtgtcgctttgtagtaagttttgaaatcagaaagtgtgagtattccaatttgttttcatttttcaagattgtttttgctattctggatttcttgaattttcatatgaattttaggattagtttatcaatttctaggcacaggggaaggtagctaggattttgatagggattgcatggaatctgtagagcatatttgtcaagaattgtcttaccaatcttaatccttctgactgataaacatgggatatgtcttttcattcatgtagattttaatctctttcaataatgttttgttgttaaactattttattccttttcatgctattgtaagtggaattgttttcttagttttcagattatcattgttggtgcatatgaatatactttttcttgtatcctatgacttgttgaacttactagctctaataagtttttgtttctgtgaataccttatgatttttcatatacaaaattttatcatatgcaaatagggatggttttacttcttcctttctgatttggtttggctgcatccccaccaaatctccacttgaattgtatctcccagaattccctcgtgttatgggaggtacccgggggaggtcattaaatcatggggggccagtctttcccgtgctattctcgtgatagtgagtaagtctcctgagatctgatgtgtttatgaggggtttccacttttggttcgtcctcattttttcttgctgctgccatgtaagaagtgccttttgcctcccgccatgattctgaggtctccacagccatgtggaactaaatccaattaaacctctttttcttcccagtctcaggtgtgtctttatcagcagcatgaaaacagactaatacaccttccaatctaaatggctttttttccttacctaattctcctggccaaaacctctggtatggtgttgaatggaagtggcaagagtggatatccttgtttttatttgtaaacacctttaattttcctgctctcttaccactttttttgtcctgtcatttttgttttttttttaaataaaatgacatttattacggattttgtaatcagtatataattatatatttacattttgctttacatacataagatcacagccaaggaggttacccataatttcacattttatcaccagccgcttgtgctattttatatttgaaaatattcactcttattatttacatcaaacagtgatctataactttgtttaaacaataataattaagggccttttcttctttgggacaataaaaaattaaataacgtattgaagatactactaaggaaactctactttttgattatggcctctgcattaaagagctgtaggaatttttctaattgtcagatcttcccacaacctctctgttcaaagaaataacatctttgaaataatttgtgtgagtactttacaaatcacaagttgattcacaagaccatattaccataatcactaatttttaaaagtctcctaaatattttgtatatcacttctcttgattataaaatgtcaatagtatggacacactcttaatataacagaatattaaatcaatttcctatcaacccaccaaaggcatttagtaattgtattggccatttccactgattgggcaggaggctcttcccctaaggctcccatggttttcactggcgtcattttcctcaccagacttagttaatcttcaacctgaggaatcacctcttctannnnnnnnnnnnnnnnnnnncatctggttctactttaactatagccagcttctcatttgtaatctgttctgtatactttctatgtgctgcattttcagggatttgctcaagaacatcaagaatctttgtgtacaatattctcagcctctcttatggactcttgcatatagccaatcccacaaggccagtggtcttcagcacacccactatgacagtgccaacaagccaatgacctgccattttttttgaagtctttaatcaggctgaattttattttgctgcgtcctctccctctccccgcatctccccctctccccgtcgccccctctccctctctctccctgccccagcctttctccccctccgtctttccattcttcccccacaaccaagtaacatgtatggggtgtgtgtgtgtgtatttttttttttttttgagatggagtcttgctctgtcgccgaggctggagtgcagtggtgcgatctcggttcactgcaagctctgcctcccgagttcacgccactctcctgcctcagcctcccgagtagctgggactacaggcgcccaccaccacacctggctaatttttttgtatttttagtaaagacggagtttcactgtgttagccagggtggtcttgatctcctgacctcgttgatccacccgccttggcctcccaaagtgctgggattacaggcgtgagccaccgcgcccggcctgggttgtatatatttttatgggtacacagctaaaactgttttttttattttgccctcacgtttgagtaatggtttggctggatatggaattccaggcttcaatattttctttcagaattctgtgtatgttattttatccttttgtaacttttacgttaaacattttggttctcataccaaagagttgtcctcttagaagcttgtaatttcctatttctatttggagtttacagttttcacaagtatgtgtctgtgagtttacagttttcacagtcattattaccgtttgctatttggcggaccattttatctgagcatatcgatattattctaaaatacttattgtgtgtatatgtctagttgtgtggatatatgcacacatatgtatttattatggatatgtgtgcacatatatatgtctacacttgtatatgtgttttaaatccattttatcctgaaggtttcatccatttagaactattaagtgaatattatattacacttaatagaagtacctagcttttttttgtctcttaggttttaatatccttatctttttattctataatttaaagattcttcagtttagtcttctaaattataatttgtctgtaatacgtctatttatgattttttttttttctttgacagagtctcactctgttacccaggctggagtgcagtggtgcgatctaggctcactgcaacctcgacttcccaggttcaagtgattcttctgcctcagcctccctagtagctgggactacaggcgtgtgccaccatgcccagctaatttttggatttttttggtagagatagggtttcaccgtgttggcaaggctggcctcaaactcctgacctcaagtgatctgcccgcctcggcctcccaaagtgctggaattacaggtgtgagccactgcacccagcctaattttcttttttttttcataatgatagttttgtttttttagttagctatgcggtgctgatttgtgtctttcttatctcccctgattactccctccctgccctgtcccctactctcatccctacacctgagaatataagaattgtaggtcctttcctcagaaagtaatgcccctgcgcacattcacagaaaattttgtacataatgcgcgattctagaatgtctaaaagctcatttatgacctctagatccttgcttttcaaagtgctcttatagaaacagctacattggtcctgtctggtagctggttagaaatgctgaatctcagggcctgtgccagataccaaattggaatcttcattttaacagatcccttgtgatttatttgatattcaggtttgagaagcattgctgtaggaggttagaaacttctgtgatgtatgtgatatatattcttttcctgttgtgttaccttttacatatctggagtatcatctacagcacttttaaaaaaaaatcatgacttgatcaccaaaattgtaaagtagaaatattttgaagtagttacaatatagtatagtatctgaatagcaagctatgctatatgaagtagcaggaggcaagcagggactgatgtatacactcattcttgtaacaatagcaaacagttacatagtagttactatgagccaggcagcattctaatcattgtgtttttgtttatgtatatgtgtttgtatatatgtgtcttagtccatttggagcactgtaacaaaataccatagactgagtggcttataaagaatagaaatttctcacagttctggcggctgggaagtccagcatcgaggcactggcagtatttgatgtctggtaagggctcactttctgattcatagacaatgtctttttgctgtgtcctcacatggcaaaagaggctagctagttctctggggtcccttttataaggacactaatcccattcttgaggacagagccctcatgacgtaatcacctcatgaggtacaaagactccacctcctaatactataaccttaggagttaggatttcaaccatatgaatttggggaaggatacaaatattcagactctgcgaatgtatgtatgtatatgtatttatttacacagattcatttgcttatcatttgttaataatgatatataatgacatatcattattaacaaatatataatatagtaagacagacctaagtttggatattagttgtatgtcttagttgtgtccttgagcaacttatttaccatatctgaagtttagtttcttcatttgtaaactggagacaatatgtacctcaaatatttgttctaataactaagtaaattaaaatttgggaaagtacattaatttggttatcatttgttaagcaaatgaatctgtgtaaataaatacatatacatacatcagcttcgatactatttccattttacaaataaggaagctgaggaacaaaaaggttaagtatcttagccaaggtcacgtaattagtaaatggaagatctaggatttgaaccaagatagcataacctaaaatctgtgctcttaaccattacactatattgttcttttatagttgtacttggagatctccgtaaacaaaatgcagctcaaaagcaagctgattaattccttatacatttaccttttaaaatttattactagaactcatctgcttgtggtgctgatagatgagccagacatgccagatcattaattctttctgaattacttttggtttgctattaattgagatttctaaatggcaagaagctagattattggattttacactacctaccctcaaggtttgaaataaggttattaaataacttatgcaaatactttctacattaaatgttaattttctcccatctccagtagatggacaaaagacaatttatagaaacagtaattggatggctaataaaattagaacaaagattaacttcaaaagcagtcagagaaatacaaataccacgtgttaatttagtaaatatataaaaatgaaactgttttatcaaatattcaataaagacataaaaataaaatgtgattagtgtttaatgaaatgagcattcatacttgataagtagaaatgttgatctttgctgatgggtttgttggtattatttgacatatcatggccttcttttccttatcactttttttcataaactatttcctaattttgaacattaaattgtttgcagttttggtcacataatgctgtaattaacatgcttttatctttgtttgaatgtttattatggtttataaaagtagaattactaggtcaaaggttggagtgttttccaggctctcattaaaaataatacctaatttgtattgaatgcttaccatgtgtagtcattgctctaaatgctttacatatgtatgaactcatttaatctttacatcaaaaatataagatgggccctattttaactctgttttacaggaaactgagccacagtggaattaaaataattttcttaaagtcacacagttagagccaggatttgttttccagaaagattatactactttacgcttctgctcgtagaatttgagattatataccctcttaagacctctgcagtaaaatgttgtgataattgcacaatagcagtgagcacaactagaacctctaaattatggtctctaaataccattcctcactgaaaggatccaagggtcattggatgaatgactgatttccattctannnnnnnnnnnnnnnnnnnncgaaaccagggatgttctcttgtatcagaaagcaaggaagctaccaaagactagtagttccagccaaaaggacacaatggccaataaaaaggggactcccagtgaccaaaagatgagagaacttgaacatgatgaaagaatataacgaaggcagttggttgaaatgtactgaatttataaaaactccttggtttataacaatagatgtgtaataaggaacacaaatacacaccaccactacaacaacagtgaattactggatacagtaaaaacaaataggcactaactccatactctgataacaagcaattatgaagaaagagggaaacttctttgcagaatttttgttaatgaatgtggaagtaatgacaggattagaatatcattttgccaaccctaatgaaatgatttattcaggctgtgatcatcagtggatgaaagcattagacatatggtcatgtgagaacttctcaatggaggaatcagtctgccctacctggacctattgcttaatctgagtcttatgaaaagtagggtaaggagacagtgtatgtcttcttctgtcatacgtatgaaacatacagcataagctctgaagttttccagccaaaaatgttgagcctgtgtcaaattaagatcaagcttctgtagcagggtttggcaaaacacggcctttcagtcaaattctacctaatgactgttttcaaataacgttgttttgttttgttttttaaacacagccactctgaataatttacatattgtctgtagctgcttttgtgctgcagtgacagagttgagtagttgcaacagaaaccgtatggcccacagagcctaaaatatactagcttgtcctttcacagaaaaggcttcctgatccttgagctagatgaaccaaagttaagtgacatcagaaagaagcaacaccacaaaatatgggccttctacgggacagctgatgtggcttctttaactagtcagtggtatggaaaatgagggagtatcactctaggctaagagagacttaagcgcaacaaccaaatgaaatctcgagactgttttgatcctgcttcaaataagcaaactgaaaaaacaggagacaaccaggaaaatctgattattgcctggctatattaaatgtcatcaagatttattatgaattttaagtagtagcattatagatagctggataacatattttgagagatatgtatgttgaagtatatggaggtaaaatgatatgtggcatttgcttcaacatacttcacaaaaagaaaaatacagcaaagacaaattgatctcaagattctttgatgtcaaggctcatatactttatactgtatcatcatgccatcattactatctatggtaggttttagtgttgcctcctaggttgctgtgcacaacagctaccaacctctcttttaaatgccctaattccttggtttctttgtcaatgtaagcacaccgttgtgtgcttactcctgtttccactatatctaagcacgattgacagagggacatccatcaagactggatctgtatcttctggtcttggtggtagaagagcctcatatttgatacttgattctgttcttcagtaactgtgagatttagtcctgacaggttaattttttagtctcaacatcctgggcctttaaagggggaatatcagttactcctggaattgtttcaaaattaaaggatacgtttgttctgtaaataatgaaattattaacccaaatgagacccataaatattttggaaggtatagtgagggaattgatgcatgatctttataataagacagacctaagtttctatattagttgtatgtcttagtcgtgtccttgagcaagttatttacttatctgaagtttagtttcttcattggtaaactggagacaatatctacctcaaatatttgttctaataactaagtaaattaaaatttgggaaagtacatagtatagcaacagatacatgctaattaaatattttttcttttttttcatttggggaaatatacctgtatagtgtagctagacatatttacaatggataacttaaaaaactttttttgaatatcaaatggtatgattaacaagaattatgcagaacttatgtgaagaaaattcctgtaacataaagaggatactaaatagagagatatccttttttttggataggcatgtacaatattgttaagaggtcctttctctctaaactatttttttttaattaaaaaagtttttatttcaataggcttttggggaacagatggtgtttggttacatgaataagttgtttagtggtgatttctgggattttggtgcacccgtcccaagcagtgtatgctatgccaaattacccagtgtgtagtcttttatcgctcacccctcctcactcttttcccccgagtccccaaagtccattgtatcattcttatgcctttgagccctcatagcttagctcccatttatgaatgagaacataaaatgtttgatttctccattcctgagttacttcacatagaataatggtctctaattccatccaggttgctgcaaatgccattattttgttcttttttatggctgagtagtattccatggtatatgtataccacattttctttatccacttgttgattgatgggactttgcactggttcctcatttttgcaattgtgaattgtactgctataaatatgcatgtgcaagtatctttttcatatgacttcttttcctctgggtagatacctagtagtgggattgctgtatcaaatggtagatctacttgtagttctttaagtaatctccacacagttttccatagtgcttgtactagtttacattcccactggcaatgtaaaagtgttccctgttcaccacattccatgccaatatctgttattttatgatttcttgattatggccactcttgcaggagtaaggtggtactgcattgtggttttgatttgcatttccctgatcattagtgatgttgagcatttttttcatgtttattggccatttgtatatcttctttaaagaactgtttattcatgtccttagcagacttttcaataggattatttgtttttttttttcttactgctctgagttccttgtagattctagatattagtcctttgttggatgcatagttagggaagattttgtcccactctgtgggttgtctgtttactctgctgattatttcttttgctttgcagaagctttttagtttaattaagtcccatctatttgtctttgtttttgtggcatttgcttttgggttctttgccatgaagtctttgcctaagccagtgtctggaagggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcccatgggttgctcccttgtgtggtgttctctcccttcccgtagtattcctgagaggtgaactgcagtgattcttgtttcatttgtgggtctagccacccagcagagctaccaggctctggcctggtactggggagtgtctgcaataagtcctgagatgtgatccatcttcaggtctctcagctatggataccagcatctttccagtgaacataacatgggagtgaagtggactctgtgagggtccttgattgtatttttgtttagtgcactggttttttgtttgttggcctccagccaggaggtggcactttcaagagagcatcagctgtggtagtgtaaggaggatacaagcttgccctaaggtcacctggataaggtttctcaggcagtgggtgggaccacagagctcccaagagattatgtcctttgttttttggctaccaggcaggtagaaaaagatcatcaggtgggggcagggttaggtgtggccgagctcaaactctccttgggcaaggcttgctgcagctgctgtggggaatgaaggtgtagttctcaagccaatggagttacgtacccaggaggattatggctgcctctgctgtatcatacaggtcgccagggaagtgggggaaagccagcaatgacaggccttacccagctcccatgcagcctgaaaggccggtttcactcccaccgtgcttctccaacagcaccaagtttatttccaggcagccggtgagcaaggctgagaacttggcccagtctacaaacttccctgctgagaaagcaagcagggctttcaggtttcatgcctctgcccctgccaagacttctgtgcatgtatctgcactccccattttccccctcccccggattctgtccagtaaacttcacattcagttgaaattgttacaaagttcaactggaagtttccttctccctgtggttttttgccagtttcactggcagccctccccaaggacccctggaagacaaagtcagaaatggcttccctgtggacctagagtgcccacagggctcttcccactgcttcctgtacccctatatttcactcagctttctaaattaatctcagctccaggtaaggtcaagttcttttcccatgatctggaccagtgaggatgtgcatttaggggcaaacgttcccccctcacactttgggcactcacagtttttggctatctcacagagcctgcagcagcaagcagcttcattcaaaggatctgtggattctctaggctttcttggtatgtttctgtggtagttcttggagcaaaagttcatgacatgggtctccacacactgctctgtctgtctgagtgggagctgcaagttagtcctgcctcctgtgcaccattttttttcttacattggataacttttatcaattatgtgaaaaaggataattctctgcttcacatgtgatatttctgtagaaaaatgccaagctgacaggttaactggaagatagtactttaaggttccatgaaagagtaggtaagctatgagatgacttaagtagaagtaagtgaaaagttagctatttgctgagagaaaaaaaaaattgtatttttagtagagaaggggtttccccatgttggtcaggctggtctcgaactcccaacctcagatgatctgcccgcctcggcctcccaaagtgctgggattacaggcatgaaccaccacgcccggcaaaaaaaaaaaaacaacaaaaaaaacgacgtatttatacatttattagattgatgggctataagctgttaagaacccaggagtcactgaagatcaaaaatggtaaatttaaaaaatgccattttcttggtatccccatccccaacaagttctaaagctaatgcagagcaaagtcccttacaatctaaagactgaagctgctcaaaatgtaaaatatttgatagtcatttaccaaacattttgaaagacagtgataataaatttctctctaattcaagggaatagttgggtttgaaatcttccacttgtggctttctgacttcgttcactcgtggaagaatgcctagctttctctttatacattctttatccttttccttctctcctcttacttacagtatcatatgaaaccaaattgttaattatgcagaggatgtttcatgcctaattccaaaatctgataatttttattcattaaaacaacaaacatttactgagatctcactgtgtcataaattgggagatggttgctggggaatagcaaggcagggagaaagagagtaagaaagaaaaggaaggagagaagaaagaaggggagaaggactttctttgccctgaggtagtcaacatttagtgtggaagactagcagttaaaatgtggtacatatgtatatggaatactacacagccataaagaacaaaatcatgacttttgcagcaacatgaatgcagctggaggccataatcgtaagaggattagcacaggaacagaaaaccaaatatcgcatattctcacgtttaagtgggagctaaacattcacagacgtaaagatgggaacagtagacactggggactactagaggtaggagggagagggatgtgggttaaaaaactacctgttgggtactatgctcactatctgggtgataggatctatactccaaacctcagcatcacacaatctacccatgtaacaaacctgcacatatacccccagtatctaaaagttgaaattatttttaaatattgataaccccaaaatatgatgaggattgtggtagtaatatgcttataactcaatacgtactaatacaatgtactatgtgagcatcaaggaggacccctaactcatcctaaggtagacagaattgtatttcctgaactgggttgaaggagttagagagtaaccagtggcaatgcactcaacttttccatgcaaagggtacatcatattcaacaatggcaaaatttcagaaactgtatgtattttagtagtgctgaatccaaaatatataagtacaaggtaaaggcagaaaaggagtagcaaaatttaagggatggagagatagaagagccagattatggtgagccttagagactcttaacacatggaaggaattgaactagttacagttttataagctgaaggttaatgtcagatgtacctttaaaaaagatctctggtagcattgcaaagaatgatagaggattcatgagagaatagtgcaaaaaggatcaaagagttgtgagaccaaaagtaggaaaaccagtttgcaagctaattcatttatttatacattcagcaaatattcattgactgtctaatatgaaccaggcactattctgtgttctgcccctttgaagcttatatttaatgcagtaagaaggaaagaaatatcaaagacatggaataaagaaatagcaggagggttggaaagaactgagaacttaatatatagtgcatgaagggaaggaaggaaggaacgataaggaagaaactgaaatgacttccaggttcctacttgaacaactgggagatgctggtgtcattcaccaaggtaaggaatataagaggaagagcagactgagggtagataagagtttagtctcacacctacctagtttgagatacctaggacattaaggcaaaactgtacagtagaaagttaaaagacagtatttattgtaaaaattggactaacacctccttcataaggtgattgtgaaattaaatgtactgaaacgtggaaattccttagaccatcatttggtacatagtacatacgttagctgctattattatttcaagattatgggctttgagctagacaaatttgcttaaatactggtagcaccacttgccacttttgttaccttgaacaagtctcttctttgagtctttttttctgcatgtaaaactggaatagtatctattttagaggggtgctgtaagaattagtaatgatgtatgaaaagtaccgactacagtgactggcacagtataagtgctcagtgactactgggagtcaaataaaaaaattgcagtttaggagaaagttcagattaggggttgaaatttgggatctatcaatatggagtacttgaacctttgaacatgtatgctgagaacagactttctagaaagggaaaggataatatgccaaaagatccctgaatagttggaaagagaggcgatttactaagaatagtggttgaggaagtttgttggaaacttgacgcaaataatggagggctgatagagttttcaagggcattggagatagagctgagtcaattatttaaaggttattcaatagcattgagtatccagatgaattgaaaccatgaatttacagtgatactgttctttgtagttatatggttttctccaactttaagaaaagtggaggccgggctcgggggctcacgcctgtaatcccaacactttgggaggccgaggcgggcggatcatgaggtcaggagatcgagaccatcctggctaacacggtgaaaccccatctctactaaaaatacaaaaaattagccaggtgtggtggcaggcgcctgtagtcccagctactcgggaggctgaggcaggagaatggcatgaacccgggaggcagagcttgcggtgagccgagatcgtaccactacactccagcctgggcgacagagcaagactctgtctcaaaaaaaaaaaaaaaaaaaaagtggattcagagttgatgttttttaggataaagtgttttctaagtaggtcattggtatccgtttccacatgagcttcagatgtgctaggggtaaaagctagattgaggagggttcaggagtaaatgataggtaaggaagctctattaatcagtatagattcttctttcaaaaactttggctgagaaagaccaaaataggaaaatgtaaggaaggaggtgcactggcaagaaagtagtggttttgcttttgttttttaatggacaggaattacttgaatgtatatttaagaggaaacaagggaaccaaaagagaggaaagaaaggtctgaagttgaagcaaagagatgggctaatgaatgactccaggatccagagtgaccttagacctagtatgtccttgacactcattgtaaagcctctgataaacttgagattcatatttatttatttatttatttatttttgacggagttttgctcttgttgtccaggctggagtgcaatggcgcagtctcagctctctacagcctcctgaattcaagcgattctcttgcctcagcctcctgagtagctgggattacaggcatgcaccaccacacccagccagttttgcatttttagtagagacggggtttctccatgttggtcaggctggtctcgaactcccaacctcaagtgatccgcctgcctcccaaagtactgggattacaggcgtgagccactgcacccatattaattatataataattatataattaatttaattatataattctatattatatacaaaatataatatagaattataattctatatcatatacaaaatataacatagaattataattctatatcatatacaaaatataacatagaattatatattagatacaaaatataatatagaattatatattagatacaaaatataatatagaattatatattagatacaaaatataatataatatagaattatatattttaattattaatatataatatatttatataatatatattatatatttatataatatatttatataatatatattatattttatataatatatattatataaatatatgatatattaatataatatatatcatatattaatataatatatatcgtatattaatataaatatatcatatattaatataaatatatcatatatttatatatattatatattatatattatatattatatattatataataattattaatatataatataattataattatatattatatacaaaatataatataacagaattatatacaaaatataatataacagaattatatattatatacaaaatataatataacaggaattatatattatatacaaaatataatataacagaattatatattatatacaaaatataacaattatatattatatacaaaatataacaatggtatatacaaaatataacattgaattgtatattatatacaaaatataacagaattgtatattatatacaaaatgtaatataacagaattgtatattatatacaaaatataacagaattatatattatatacaaagtatatagaattatatataatatataattatatattatatacaaaatataatatagaattatatattatatatgattatatattatatacaaaatataacataatatagaattatatataatatatgattttatattatatacaaaatataatatagaattatattatattttaattattaatatatatttattatatattaatatattatatattaataattattatatattatatattaatatataataattattaatatataatatgtaattatatattatatacaaaatataacaattatatattatatacaaaatataatataacagaattatatattgtatacaaaatataacagaattatatattatatacaaaatataacagaattgtatattatatacaaaatataacagaattgtatattatatacaaaatatataacagaattgtatattatatacaaaatataacaggaattgtatattatatacaaaatatgatataacagaattgtatattatgtacaaaatatgatataacagagaattgtatattatatacaaaatataacagaattgtatattatatacaaaatatgatataacagaattgtatattatatacaaagtatgatataacatagaattgtatattatatacaaagtatgatataacagaattatatattatatacaaactatgatatagaattgtatattgtatacaaagtatgatataatatagaattgtatattatttataattatatattatatacagaatatataattatatattatatacaaaatgtatagaattatatatgatatataattatatattatatacaaaatataatatataattatatataattatataatatatataataataattataagaagaataattataagaatgaagagggcctgggatcagtctccgaatgacaggggaaggtagtgggcactgggcacctaaaaatggcatgcctcttctaaaagaggtcagccacagatccagctcagtaagtatgtatgcagaaatagatgtacacagatactaattttttttcaaaagaagccccgaaattcagtatttttaggtgaaaactcaatttttaatgttggagttgggtaaatctggatttgagtctgtctctgccacttactagctatagaattgtctaagttaattgtatgagaaaacctgagtgagttttcgcatccataatgtggggacgatggaatctattcttacaactttagaaggtagatttaataatacatcatgaattcgtacaatgtgtaatgtttattaaatgttgactgtgattagtggttgtccagctttaaaggtgtgggagcgggattgattacaagggaacatcagagagcttttttgggttatggaaatgttttgtgtcttgattgtagtgttggttgcttgactggacatatttgttcgcacttatcaaacccttgaagttgatggattttttgcatataagttatacctcaacaaagctgattttataaagataactgcctttcccttttctgtgtactccagttacatcaactgttaataaaatagagttgataccaaaggtttctaacatttttatcgctagtctcttactgtcccctctgagccccagttacaagccccacagtgtgaaagatcttgcccactgggaaacaagaaagaaaaaactacctttattagtccaatatactcttctcctatactgtgcaaaccatgtactggatttatcaatttgggtactgtgcttgatacataatatgagtaaagcaggtcacttagttactttgcagaagtgttataatataatctacaagctaattacccactgtttagtaataagctataaaacttaataaaccaagaagaaaaattagaagcataagtaatatacaggcatacatcagagatatggtttggttccagacctccacaataaagtgaatgtcacaataaagtgagtcacgtgtattttttggttttccagtgcatataaaagttatgtttatactatactgtagtctgttaagtatgcaatgacatatctaaaaaatatatataccttaatttaaaaatattttattgcttcgaaattctaatgatcatctgagcctttaacaagttacaattcttctcttggttaaaggtcttgcctcagtgttgatggctgctgactgtcagggtagtggttgttgaagattgcagtagctgtagcaatttcttaaaataagacagcaatgaagtttgtcacatcagaaaccttcataaaagctttctctgtagcatgtgatgctgtttgatagccttttgcccacagtagaatgtctttcaaaataggggtcagtcttttcaaaccctgctgctgctttatcaactaagtttatgtaatattctaaatcttttgttgtcattccaacaatgttgacagcatcttccctaggaatagattgcatctgaagaaaccactttctttgctgatccctaaaaaacaactcctcatccattaaagttttctctggagattgtagcaattcagtcacatattcaggctctacttctaattctagttctgttgcgatttccaccacgtctgcagtttcttcctccactgaagccttgaaacacctcagaggtcatacatgagggttggaatcaacttcatccaagctcctgttaggttacagttcattgacctccaatggaatcatgaatgttcttaatgacatctagaatggtgaatccttttgagaggtttcaatttactttgcctggatcccatcagaggactcgctgtggcagccatagccttacaaaatgtgtttcctaaataataggcttgaaagttgaaattactcctgattcatgggcagcagagtggatgttgtgttagcaggcatggaaatatgtggatttccttatatatctccatcagcgctattgggtgaccaggtgaattgccagcaagcaggaatattttgaaaggaatctttttttctgagcggatggtctcaagagtgggcttaaaatattcagtaaacaatgctgtaaacagatgtttacaatgtgctgtcacccaggctttgttcaagcagagcagatttagcttaattcctaagggccctaggatttttggaatggtaaataatcattagcttcaacttaaagtcacgagctgcattagcctgcaacaggagagtcagcttgtcctttgaagctttgaagccaggcattgatatcttctctctcgctaggaaaagtcctagatgacatcttcttccaatagaaggctgtttcatctacattgagaatctgttgcctcgtgtagccaccttcattagtgatcttagctagatcttctagataacttgcagcagtgtctccatcagtacttacagcctcaccttgcacttttatgttatgtagagtgcttctgtccttaaacatcatgaaccaacctctgctagattccaacttttcttttgaagccgcctcacctctctcagccttcgtagaattgaagtgttctgtgtgccttgctctgtgttaggctttggcttaaggcgatgttgtggctggtttgatcttctttccagaccatcaaaactttctctctatcaacagtaaggttgttttgctttcttatcatttgtgttttcactggagttgcacttttaatttcttttagaaactttttcttttgcatacacaacttgactaactctttagctttcagctagaccttccttaattaataaaggccttccttactaatcttcatttttgttgttgttgttttgttttgttttgagatggagtgtcactttgtcgcccaggcttgtgtgcagtggcgagatctcggctcactgcaacctccgcctcgcaggttcaggtgattctactgcctctccctcccaagtagctgagattacaggcatgcgccaccacgcctagctcatttttgtgttttcagtagaaacagggtttcaccatgttgtcaaggctggtcttgaactcctgacctcaggtgatccacccaccttggcctcccaaagtgctggaattacaggtgtgagccactgtgcccagcccatttatagcttttgatttaaagtgagaaatgtgtgagtgttccttttacctgaacacttagagatcattataaggttattaattggcctaatttcaatattgttgtgtctcagggaagagggaggcccgaggagagggagagacagcttgttgatggaacaatcagaacacacacagtattcgtcagttaagtttaccctcttttataggcacagttcatgttatggcacctcaaagcaattacagtcgtaacatcaaagatctcagatcacagatcaccatgacaaatacaatagtaatgaaaaagttttaaatattacaagaattgccaaaatgtgacaacagagacctaaagtgacctcattctcttggaaaaatggtactgatagacttgctctatgtaggatgcacaacctcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgaaaattaaaaacacttgtgcttcaaagggcactatcaagtacactgaaaagtcagcttatagaatgggagaaaatatttgcaaattatgtatctaaccaagggatcaatatctacaatgtctaaagaactcttaaacaactcagcaataacagaaagacaatccagccaattaagaaatgggcaaaggatttgaaaggacgtttctccaaagaatagcataagtggctgttaagcacatgaaaagagccacattattactcattagggaagtgcagatcaaaaccataatgatatatcacttcacacccataggatggctaaaatgaaaaaggtggacaataacaaatgttgtcaaggatgtggagaaatggacccttatgtgttgctgatcagaatgtaaaatggtattgccatttggaatacagcttggcagttcctcagaaaggaaaacatagggataccatatgacccaccagttccactctctctacatactaaagataattgaaaacatatgtctatataaaaacttgtataccaatattcatagcaatgctattcacaaaaagtagaaactacctaaatgtctgtcacctagtgaatatgtaaacaaaatgtgatatatccagataatggaatattattcagccataaaaacaaatgaagtactgagtcatggtacaaggatgaatcatgaaaacataaggctaggtgaaagaagtcagacacaaaagaccacatattgtatgattccatttatttgaaatgaccagaataggcaaatccatacagacagaaaaactagattacctgttgctaggggatgtggggaagagaaaaaggggaataactgctgataggtacaaagttttttgaggcggtgatgaaaatgttcaggcattagatggtggtggtgatggttgtacaacttcctgaatatactaaaaaccacccattgtgcacttgaaaaaagatgaagttcgtgatataaaatatctttcaataaagctgttactgtaagaaatataggtgtgtaattttttttcctggcgttctgaattctttcaaactcatatttattcttgtgaaccacagtcataggtaggaacctttgaacttagtagtcctaaaattccttttccagtttatgttgtgagctcttttatcagtagctcaagctaattttagaatagagaaggtgattttcacctgtgtgaacactcactgagatgctcagcagtagggtgcataaagatctctgcatgttctttaagggatctgattcattctctgaatactaggagcatgtgcttgtttagtatttgtactttaaacaatatagtagttcgttgtcattatatccttatttccaagacatttcaaacataaaatcttactaacataatactacaggaagtctaaacatataaaaacactgaactcccaaaggtccattaagaatatggtttggccgggcgcggtggctcacgcctgtaatcccaggactttgggaggctgaggcgggtggatcatgaggtcaggagatcgagaccatcctggccaacatggtgaaaccccgtctctactaaaaatacaaaaattagctgggcgtgatggcacgtgcctgtaatcccagctattcgggaggctgaggcaggagaattgctttaaccagggagtcggagtttgcagtgagctgagatcgtgccacagcactctagcctagcgacagagcgagactctgtctcaacaacaacaacaaaagaatggggtttaaaaattataatgtatcttttcattaaaagtaatgttataaataattattactattattttaagtgggaaataggttcaaggctagttcatataaatacataatggatggccacaattaaaaagttacagaaataatacttttaggataccagtaattaaatcaatcaggaaaatatcttatttctcagggatttcataaccttttttacaaaagtaaacatctcattataggtatttgttagacattatggagcctttccttagaagaatgtactgaatttgtcatacacttgaaagggattcccaaaaatcttcatctagacctacatggggaaagtaggtatatgagtctatttggactaccataacaataccacagactgggtggtttaaacaacagaaatttgttttctctcagttctggaggctagaagtccaagatttaggtgttgtcagggttggtttctggtatggcctcttttcctagcatgcagtgtcctccttactgtgtcctcacatggcctcttctcttactgtgtcctcatatagtatgtgtggacagagatctctggtatctcctcttcttataagaggacaccagccttcttggatagagcccccacccttaccttatttagcagaggaccaaaattcactgaaaatgttctcactcagtgagaaagtgaccactctgcacactttgattctagatgttaggcctgccgacatgtaacacaagcaaaatgaggcctccgctatcaagcctgcctttttggcaaactatattagggtttggccttacaggtagtaaaaaaatatgtatttgcatggctttgttttctgcatatatatcttcacaaaaagtgatgatcaggctacagcatatcagatttgaggattctaggacctgggttttgagccctcctccctcatttttttttatcttctcacataatttgacatgaattatctataagattctttacagtgctgtcttaccataaaactaagaaagaaatttaaaactataattattggaaatattattttgcataatttgtatatgtgatactagattaagatactgagaggaataaaacaatgcttatgatattaaccctgatcttaattcacctacatgttttaagattcataagtcatttgtacaaatctcaaatccagaatattttgtgtgttgtataatatgctatcagaggggtttttttttgtttaaaaaatttcctatggataatttcaaatatttgtgaaaatagataggacaggataatgaccccctatgtacccaaaacctaggccctaacagcagttattaacccagagccaatctgcctccttgctagcctgttaaattcttctgcatattttgaagaaataccagacatcatttcatccactaatattttagagtgcatctctaaaagaacaaatatgctttctttttaaatcaatataagtgccatgccattatcttaggaatgattgttaatttttcctcagttttataaaaccaaaactggtttgtgtttacagtcgtctcattaatgtcctaagtgtttgtttatgaatcagaatctaaatgaggtccacagtttgttattattcagtacttcctttaagcctttttcaatctgtggactttcttcacaactttaaaaatatatatatttgttgaaacaatttagagtttttcattctggagtttgttgagtattcttctgtaatatgatttaaaatggtcctctgtcgtttgctttttcagtaaactggtaaatggatttagagctataaagcctaatacagtagccgtcagccacatgagctattttaaatttaaggttaaattaattaaaattaaataaaataaaaaacgtagttgctgaagtacactaggctcattttaaatgattaatagctacatgtggctaatggctaccacattgggcagtgccttgatagaacagttccatcgtgtgggaagttctgttagtcagtgctgctttagatagagtcttgatcaaattcaggtttctctttctttgtgttcttccattaggaggcccatgatgtgtgatgtctcattgtcctttttttctgatgttagcagttactgatagtcaatggctgaatccattcattcattcaagaatgcaaaatgttgaccataggagtttaaaagaattacttctgcttgaggtgatctccagaagctttatggctgaggtaacatttaattgagccttgaaatttctctaaaaatttgataagtgaagatacagggagaagaggatttttgtggttttgggttgtggtggttgtgtttgtttttgttttttaaacagggcagaagactaatgtgtttgatgcacaaggagtatgggaaattaaaattgaaaagtatatttggagcctatactatgtagatcctgaatgcaaggacaaggcattggattttatttgaaagggaaaatgcgatagtagctatttgttgattgcctaccgtccagttatcctttttctctttttaacaatgcccttaaatgcttcagaaaatgtaattcaacacctcactcctaggcttacgcctatcatcgtattccattttgttttccttgacaaggttgggcatgtgacctaagctgttctaaacagaatgaatatcaaggcttttggttgcaagtgatgagatacaaatactgtctcttcccctggatgtggtacttggaagtgctgtagttattttgtcaggatgatgaggaagccagcacacagcctgacaaaataacacacagagagatcaggcaaccactgatctctctgtcactatagattattgtttcctgttctagaactttatagaacagaatagaatcgtacagaatgaatacttttgtgttacttcttttactctatgtttttggaattcttttttgtcttttttatatgatttcatttcccttacctagttgtggaattgttaggtcatatatctatatgttcatcttgaaagaactgttttccaaagtggttgtactattttatattcccactggcaatttttgagagttctagttgaagcttgttttaaagctttgctaggataattacagagtagcttttacttggcagttagctctactcctaaggtgtgggtggacttcctggtctggtaatacccatgtgtttatcaaggtctctccactttggagctctctcttgctggtcagaactttagcgtcttccagatttgtgagatggaagtgtttatttaagctttcagtggtagttctttgcctattcttatatggtgtcaccttacacatgtgcagcttgacattcagcctaagactaggaccgtgatgcaaattttggaggtttttgttttttgtgttgttgtcttaaaaaactgatactgatactctcaatgtttctgttgcctgagcccctctaaactctcatctctgtctcctcagcttagcaagatctccctgctttgcttgggttctccctcaatatgccagagtccgggaagtctccaggcagaaagggcagtaataggactcaccttaatttgtttcccttttctcagggatcacagtcttacattgcctgttgcccagtgtctgatttttttttttttacatatttttctgttttcttaattgttcacagcagaattgctgatctgttgctaattcctcttttataaccagcagcagttccatgagctttttcttttaatcttttttcattgcaactgaaaatggggtcttctgccatgtcttccaactggctattgtttatatttacaaatgctttggatttctgtatgcttattttatatcctactaccttactaaattttcctgttctttatagttatttttctattgactgtcttgggttttccaagtagatataatctgcacatggacacagttttactttttttttaaaacaattcttgtctaatcgcactgtctaatattagtaactatagtggccactcctgtcctcatccctatttttagtagaaaagcctctaggctttccccttgaataagaagcttgctaattatattttgtttgcttctgttttatatattttcaattattttgtcaacagactaccaactcttcaggagcagggattctgcatgcctcttacttacatggactaagtattccctgctatgtgttatgttttgtactagtcgctggggttgcaaaacaaaaccctgctgtgtcccatcagaatactccccccaccccaaaattaagatctagtaaggaatataggcattacacagataaaacaaatgtgataaattttcaaaaagtgacagtgtcagatactaaaggagtctataacagaatgacctaacctagtatgggagaatcaagagatacctccctaaagaaataatgtttaatgaaaatccaaaggcaagagagacagttgatacttttctaaaggagatccattattactggaaagaagagatagaatgggaaagtgggtcacaagaggtaaagatttagaagtagttaggaagaatcggactgtggagagcttggcaagccctattaggattatgaacttttcccttaagtacaataaaataggaaccatctttgcttttttggtttatatgtttatatatgtgtttatatttgataactattctcactgagcagtagaaaagaaattgtaggaagctgagcattttcatttcttgtagctgacagtcatttaacttttaaaccaatgtttttctttcaaattggaatgctgtggcaggtagattttaattctgagagctaagcactatttcttttacaagcaagaaatatattcatgtctgaatccttttttaaaaaaagtaaggaacacaaactttttaatgtgggaattagtattgaacctgaaatctttttaagaggtgaggaatacagactttttaatgactgtgtatttgaatgttcaatccacgcagttactagctctttggaaaaaaaaattaccaaactactagaagctttggttttctcatttgtaaaatgaactgttgttttaaggattagctgagtgaacgcttgtaaggcacttaggatttggctggtacatacctatcaaatcttaggtgtatttattagctattcttaagaactttagttcttaaataaaaaggacagaaatatataaaagaagacaaagttaataaagcaacagggatgcacagactataaatttagacattctcttatgataacatccccattatataagtgagcaaactgaatcttaggagtcatttgaagttcatgactatataaatagtagagctgggattttattacaggagtctgactctagaacttaaacttcatatcactgttgtatagtttctttcctaaagcagcatctattttagttgattctctctcatattgtagtcaaaactacagaaagcaataaatggggttggttgattacttcttggtgtttagtgagaccaaaaaattgttataacaaactattttctgatttaggtgataatcaaactttttcgtacgtgaaaaatcttttttagggtttatctacttaactggttcattacataattagctgctaatgtgtagttaaagaagtaatgttttatcagactttttttttttttagtatttgctacctctaaagggtgacgtctgaaaaaatatctgacatggctgcatttgaacactagtcatagtaagattggtggtgggtgttcatattcatatatatgaaattttcttggggtttgggagggggcattaaggagaatgtaatttgctttgtgttaacaaagcgattttctttgggctatctactggtaacctagaaataattgaaagtgacatcttcataaacatattttttagaatggtagtacacataaattaagtagcccacttcttcaagtgatgttcagaagcagaaacatcactttgatgttaacagaaattatcattgatttcttttaacttctaaatagtattgtttttaagctagagtaaatgtgtgggaaattaattagcagtatcatgttttctgttttaaagtgttaaccagtttttaaaatcattaatactttaatgaaattttaatatgttataattagcatgatatttaccagatttctgtttatccagaatgatgggaatgaactatatattctgttcacctgtttctccttttttgtaatataaataaaatttttaaagaaatctgtgcctgtttgtaacaaatttggccaatgctaaagtatacaattcaaatcttcctctctaattccagttccagaggttttcctccacatcagtgttatacccttaggctcatcagtgtttatataaatgcatagacatacatatgacatgtttaacatctgcatattataaactatacatacataattttaaagttaaaattaaatcatactttactgctcatctgaaacatttttaatttaatatgtgtatctatccaagttagtacatatataattatttgtttattgaatattttattataaggctgtatcagtttattcctgtgcatgttgataatagttttagatttttttttttttttttgctattataaagaatttcactaagccctataaggtaggtattatctccattttaaaacatgaaattgaggcacagagagattgggtaacttgccctaaattgcacagcaagaagtaatggagctggttttagaatcctggcaatatagctcagaatccacaatcttcaatattacattatgctggttttttgccttctgtttttgctctgtttaccaaactggaaaaaagatttcatgtttaaaatatatctaaactgggtgtgatagtacactcctgtagtcccagctgctcaggaagctaaggtaggaggattgcttgagcccaagagttctagtccagcctgggcaacatagtcagaccctgtctcttttttaaaaaagtaaaatctgatattaaaactctcctgggcataatatgctatcttacagatactggaaacattagtatcacaaattatgtaactgtgatttgtagcaatgtataatatagaagtagaagatttaagcccaaaccttgccagtgcttcttaaactttaatgtgcatatagatcactaagtgtgcatataaattcagattccataatctggaatgagcctgagtctctgcatttctagcacactcccaaggtggccagtactgctagtctactcgtgagtagcaaggatttaggcagtttatactgacctttggcaaaccttcttaggtgttttattgaatcagtttcatgttttgtttctgctgcctgtttttataatttttgtgtggtaaagaaatgggtacagtctttctggtcatttcaattctgtatgtgtgacatttaacaataaatgagaaaaagaaattgtgccttttttggcatcagtgcagagtacttaaaatgaatataatcatttatttgtatacttaatatggccttcccacctatctcatcatttccactgtttcattcttaattgagggaaatataatgtatgttttcattttgaagggtataactgtagttgaaccaaaaatattgttttatcactgttattttttctttagtaacaataatatactttacacagttacaaaaatcaacacctgttcaatgctatgtgccaggcactatatcaagtgcttaatgggcatgatttcattttaatcatcaggacatccctcattcatctttcagctatttgtgcgcctcctctgtatcaggaactgtgcctacagtggggagccaaataaacacaaattctgttctcctacagcttagtgcattggggtggggggtgcaatacaatattcaagcaattatagaagtgtgatacttgtaaacaaaaagttgttaattacaatatttgctattttctccactctcaaccatgaaagaaaattctgcttttgccttctaagctttttctgactagcttccttccccacctgactccgaggagaattctttgtctgttcggtttctgagctgttgtgatgccagatccaactaatgggtaaagagagaaacctttagaactaatgatgtataaaatacaaaattttaagacaaatatctgaagagacattgcttacattaatttgagggagtaaatattcgcaatacttaagattgttagaattgttggtgagaaaaatttgaaagatttttttgaagatttagaagacaatgcaagactttttttttttttttttaagtaccaacatatgtggccctgacagatattacaccgacttgtggctgatttggacacgcttttaggggaatgctatttttaacaagctgtgttctcttttttcttgtagcagtactgacttcccttttgattattaattgatagaaaattctttctggtgttgatcagatctatctatttgacctttatatataacactaccttgttgagatttccaaaatgtttgttttccccattactattatgattttgagcttcctagtattgtcttgaagattattataagaaactttagcttctctgtattaaaaggaactctatgtagttgtttctcttttaaagggaggatctgaaaaaattttgtaattttatcttggatattagtttattcattatgtttaattttaggaaatggtgctcttgcagaacattctgaaaatgtgcatatttcaggagtgtcaactggtaagtcattttttgtaatgtttaaatttcatgcatgacttatatggtaaatattgaaagccacctggtatcttacgaagtgatatttggctataaaaattattactgctttttgcagcatgtaataaggaatgaagtaactggaacatggagaaattctcataagataaaactgatacttgcatgcccatggattgattatacttttccaaacggactgcataattattttttcatacaaacattgaacctagagaaaagttagctcaagttgaattagtattttctttccatacaaagttatgtgacatgaaatttactgaaatgtgattttgaatgctatccctaggattagagccttagaaattaagctttttgcttgatttttatagtactactctacatataactattgtatttgagcgcacagtttatttgctgttaaaagcaacacagtatacttgtgtccatgaaattcagaaattcatcattgtggttaatgtattttttatactcatctaggcttttataacttgtaattactttataactttataattacttaaagacttataactactaaaatttttattcttaggccacttccacagctccgttaccatttttgctgtcaaccacagttactaggagaactaaaatatttatttttgcatatattgaaataggttttcttactgttcatttattatttccctatattgataagttttgtgtggttaaaactgtacttagtgtatttatcaatccattgattaacttctttgtgtcatcttgtaatttgtttggttcttttttcctcacatgaagcaaatcctgttcttttgttttatgtctgactttgtattcagaaagttaatagacttaacaaatactctaagggttagtgtgccctagtcaaacacatcaagcccaacaagcctagtttcctgaaaacgcaaagcaagtgcttcagtgcctgcatcaattttttttcatagtttgtttcacttttttaaaaatacattctcaaatgatatataattgtatttatcaaataacagtaaggttattttaaagatggccttctccctttttctttgcattttgaatagttaatgagaattataattacttttccaagttgtaactataaagtatgtttgtttacaaacattttaatttatacaaccaaatggttactgtttaatttagtagttttcaaaagttttggtctcaggacccattataaacttttaaaaactactgaggcctgttttagtctacgtgtgctgctgcaacaaaatactactgtggatggcttaaataacagacatcagtttttctcacagttctgaaagtccaacatcaaagtgctggcagggttggtccctggtgagacctcttttcctggcctgtagatggccaccttctcattgtgtcctcacatggccttttttctatgaatgttcagagaaagcaagaggtctcttgtgcctcttcttctaataagaacatgagtcctatggtattagggtcccatccttatgacctcatttaacctcagttacctccttaaaggctgtgtctccaaatacagtcacattgggagttagggcttccacatatgggcttgaggggggacacaattcagtctgtaacaaggacttaaaagagtttttgtttatatgggctacagctaccaatatttactatgttagaaattaaaactgagaatttgttttaaaactcattagttcaattaaaaataacagtaacctattgcatgtttacatcaatatgtagtatggttttatgaaaaatatatatttcaaaacaaaaaacaataagaacagcattgttttataattttataaagtaatgattgacttaaaagaaaatagctagattctcatatctgtttccgcattcagtcttttgcaacatcatgttttgtttgacatactaggagacaggccagcctcacagtgacgtataattggaaaagaaaggaatattttaatagcctttttcagataatggtgaatattctatgatactacaccaaaactcaacacgaggtagtttctttaaggttagttgcaatgtggaatctgaagccatatcattgagcgttttgtgctctgttacattaaaatctaattgggtctttcttaccctttgaatcaattttcttaccatgtatgtttttataatgtgcattgatcacttgcaaatgcagatttgctgagttatgcagattattacagagtatgagaacttatgaaaatttggaaatttagatagatatagtactacattctgaattttagattatacttatttttagctgtttacttgtgattagaccactaggctcttcttgagcattgataatacccttaaataaatttctgtttgaagaaagaaatcagcagtaaagatattttacattttttaatcttttttttcttctgaatttcagatacacatttagaaatatgtattagttttctagggctaccataacaagacgtcccgttctaggtaacttaaacaacataaatttattttctcactgttttgcaggctagaattctgagatccaggtgtcagcagggttggtttcttctgagttctttttctttggcttataaatgggtgtcttcttactgtcttcacatagtctcccctctgtgtgtgctgtcctgatctcctcttcttataaggacaccagtcattggattagggccacacatatgacctcattttaactttaactctttaactctgtaaagactctctctccaaatccagttacgttctgatgtactagggttagactctaaaatatgagttttggaggcaacacatttcaggccataacaaaatgtgtgttttaattaaatatatttatacgttaataaaatactccatttcagaagtgagtaaaaccttattcatggcttattttttctaaagtctcatcttacaaaatctttctaacagaatgagaagaataatacatgaaatctattccaattatattattaaaaataaatggatgctgtttccagaggtatgtctgggtacacagagtcattgctgttttttgttgttgttttttttttgagatggagtctcactctctctgttggccaggctggagtacagtgttgtgatctcagttcactacgaccgctgcctcccgggttcaagcgattctcctgccccagtctcccaagtagctgggactacaggtgtgcgccaccacgcccagctaatttttgtatttttaatagagacgtggtttcactatgttggccaggctggtctcaaactcctgacttcaagtgatccgcccaccttggtctccctaagtgctggcattacaggcatgagccaccgtgcccggcctcattgcattttttctgtggccagtacggagctatagatgtaatgtttaatagagtataagctttctgaaatccttgcatccccagtagaaagtagggccccttcagtgctggtctaaatagagagctagcctttggaagaatctcaaaatgcaggacttgctttctgttgagatcagcaagccacagaaatggtgagatgcttcagtattctgtgctgccatctatttctgctcttcccctgctcttttcacctctgctactccatttgccggtgctcagtgccctgctggattgtcgtttgcactttggaaagtatattgatgattttagaaagaattttaattgtctgcacctagtgttatcaggtaatttattttccaaatcaggacactttgaaagcgaaataatatattatttttaattatgctgcaccagtgacaaaaccaggactgttctggacaaatcaggctgtatagtcaccctgttggcaatgaattcaattcatttaacatgtatcaagcacctgataggaccttgtgccaaggagggtggaagtaagtggtgagtaaaatattatctgaaggaacttatcacttaatagcagaagtaaatgtgcaaactgtacctataatatggtctttttttttctttgtttttattattatactttgttttagggtacatgtgcacaatgtgcaggttagttacatatgtatacaagtgccatgctggtgtgctgcacccattaactcgtcatttagcattagatatatctcctaatgctatccctcctcgctccccttaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtagcttgaggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaagtattttattctctttgaagcaattgtgaatgggagttcgctcatgatttggctctctgtttgtctgttattggtgtataagaatgcttgtgatttttgtacaattgattttgtatcgtgagactgctgaagttgcttatcagcttaaggagattttgggctgagacagtggggttttctagatatacaatcatgtcgtctgcaaacagggacaatttgacttcctcttttcctaattgaataccctttttttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagctcttatataatatggtcttaatgtactaaggcacattatggcaaataatgaacattaagttagaatatgaatttgtaaaaagcctagttaaaatatctggtgagtagtaaatgaattaatattaacttttcttattaggcatagtattaagggcttcattttgtttactcatgaatttttgggggaattactaatttctaattaataatatatttttggttcttgtacttggaataatttgttctgtttttaatattctgtttatttccatcttcttcctcctcaaatccttgccaggaaagataaatctttgcctttttgctcgttctgatgctacagggttggcataagaaattgtagttaaattatcaaaaagtatgtatctagttgttatataatgggaaataatattggataaaatcttaatttttgtacttattttaatttagaacttttcttggttcagaattttaaatctctcttcatatataagctagagaaaggagaaaagacaaatggtatttttataaatttaataatatatgaaaatcattatgaattataccacagaaactgccaagtaatttaattgcatacatgagagagtaggaaggctcttttaatcgctttttaaaaaagtgtctaaattatatgtttctttttgaaatgtttaaaattaccaaattactgctcatctgctacatagaatgaaatatatcttacgtctagttgatttaccacaaggcccttgtacacattaaacaaatatatttgattttttaaaatatatctactttaaactgaattactctgtaatctgtgatattgactttaatcaggatattctagaaataatttatgctgtctttattcttgattacttctaaatcaagttttttgttttcacaaattctattacacaagtttcattaaacatttagaaaaaagcaaaaagattaagaaaatcacccattaaccctaccttcctacaataattaatagtagtatattaaattttttatttgtccttttgtgtacataccttaaaaataattgtatatgcatttgaattatccctaattttatctcctgctctttctgtttaacactatgtacatttttcccttagccttcatattcattattttaatgcctgcataaaatttccatcatgtgacttcattacaatgggttgtttccaatggattttgcctaatttggatcatgctcaagagacatattcatatacagttgacccttgaacaacatggtggttaggggcaccaattccctgcatagtggaagaaaagccatatataattgttgattctccaaaagtttaagtactcaatagcatgctgttgactggaaatcttaacaacaacataaacattcaattaaatatatgtacgttatatgtattaaatactgtattcttttttttttttttttttttgagacagggtctgactttgtcacccaggctggagtgcagcggcatgatctcagcccactgcaacctccacctcctgggctcaagccatgctcccacctcagcctcccgagtagctgggactacaggtgcgcaccacatgcccagccaatttttgtttttgtagagacggggttttgccatgttgcccaggctggtcttgaacttgtgagtgcaagtgatctgcccaccttggcctcccaaagtgctggtattacaggtgtgagccaccgtgcccaggcttaaatgctgtattcttaaagttagctagagaaaagaaaatgttattaagaaaatcataagagaaaattcatttacagtatgctactgtatttattgatactgtaagtttacattatctatttacagatgagtcatctgtttgataagatgggcagctgcagttgcagacctcagtctacagtacatatcaagcaattcggctttttcttgtaatgtcatgactttcctttgcttcttgggagcacttgcaacatcactagtggcactttgtatggatccagtggtgttatttggggtttatggtattgcactaaacacaatgaaaaatacacgagaaccaccagagatcacattgtactgtgacacacaatttactggagataacaactgctcacatggagatgattagcatcacacagcgatttaagcagatacttgcaaattgagctcaccaaaatagcaatgggaggtggctacagaattattagttgtatagtatgtcatataattaattttattcagttatgatttagtattcatctttatacttctcttgaatgtaaatggtactgtgtgtggtctgcaagtgtttgtgtaggttttgataaattctaactctttataataggttagtgtattttttatggtagtaaatgatagactagtattttacatatatatgcattcatgatatacctaattttttttcaaaatttccagtctgtgtaatttgtctgcaaggtttttcaaattgtcacaaatctccaaaaaattttccaatgtatttgttggaaaaaatccatgtataagtggacttacacaattcaaacccatgttgttcaaaggtcaactgtatatctagccttttttatttctaagaatatttccttagcatacatttctgaaagtgaaattactgtatcacaggtcataaataatttaatgactctagaaactttttgacagattgccttccaaaaaggatgtactaatttacacagttgtctgcatttactttcagtacaatcatgtttttcttgcttaactttttttcttattatgtttccattaaagtctcaaccttttatttgctgtcaaactgtttttttttaagtaacattttcttttcttcttgattcatggcctggagttgtaacatcgcaaagaataagagaatgagatttgctttcctttatagttaggcaaaaactagcctgaagtttataaaatattttctggttgctaataggaacagatgttaaggcttgctgctttctcaggcagaagctttttttacataggaagattaacatggtatttccaattaccaatgatacaacttccaaatattcctaccttttaatgacagctgaagtctctgtctgaggttagcttgattttgagtctactctgcatttgacttagaatcttctgtcaggcaaatctgacatttctgtgagctgagagagaatatttacttaggaagtttctttcttaatccgtattcatattaactgaattagcagagtatataaaatagacttcagatagttttgaagtattgtttatgctgtcagaattttattctatcaaaatcatcaccctttcttgcttttatgtatttgcattttatagtttctattctaatattcgaaggcctagcacattgctaatcctgtatgccttttacaactaataatttagttgtggcctttaaaatagggacatattttctaaattgcaataaatttgctttcagattagttaacattttgtaataatggagagtactaaattaaaatggcttttgtttttaaccacagctttgggcttaaatattataacatggtattttgaaattttcctggaagaacatctagtctgataaagcttttattatcctagaatgtttaagatcttccaaataaagaatctgaaaggaaataaagcttaaattgtaattatctctgatagaagtttacaattattttttaaatatagaaaagttacatgaaaaagtagcaggtcaaatggtcctttgcacctttcctatgtaattttaatattattttacaattattcaattaggtacctggacctcttgttaaagttactgagaagaatttcactagttcttttgaccagtgttataaaaatgtctttcatccatgtttcagatgaagaaaagaaagaagccttattacattttagttgattattaatacattagggtttttaggatttcagaatataaaaacagaacatagtttgaacccaagaagctatcctttatataaagaaaatgagtagggaatatgagacagagtaaattcttgatatatatatatataaaaacattactataggatgctaataatttttaaagtcattgtctaccttcagagtttacttcctgagacacttaaagttttaaagtagcgaactccctttaagttttggaaatgaaactaatggtggtattattatttctatattatatactctataattgaatcatggccaatgtcttatatgaaacatctttatattatataattgtaacctattttatattatatatcacatatttattgaacaattatgtatttataacaaaataattatgttatatttttatgttacattacaggttgactatcccaaatctgaaaatccaaaaatcaaaatgctccaaaatccaaaacattttgagcaacgacataacactcaaaggaaatgctcattggagcatttcacacttcagatttttggttttgggatgctcaactagtaagtatatatctgtacatattccagaatttgaagaaaaaaaaatcaaaatacttctggtcccaaggattttgaataaggaatactcattgtatgttataataaacaataactccagcattagaacagcacgtgtgagtaccagaactatagacagaacaggttgtattgtgacagggtatgcagtgcttagatggtagaagtgaagttcatctgatggatatatccatttcattgagtgagccaaacctagtgaacgtaaaaaggcaagctctgttcaagcatttgacattttcttttccagtctgtaactttgggaataactcttcaaagttgataacatgttggttatctgtaatttttgccaaggcatgaattttaattggatgtactgtgaaactgttgtgcaaaagccagtcacttggtggataagcaaactgtacttgggtatcagttgactaacagcctgatgtaagtaagggggtgatttgatattaaactgcagtaatagaaatacagtatccagaaccaagcaaatgatagttcttctttactcttcatgcaaacgtactctggtattgtttatttctgggtaccacccttgacaaaagacacagtaactggaacactcatagaagatgtgagtatactaaaaactatgtcaaagctgatagagatgacctacaaaatcgtgagctccaaggccagtttgttagcttaagtgaggatttctgccttacctttttatgcttccagccagagtcacagtaaccttcaaaaattagtaatttttcccatttgggaaatagtagtagcttgctttagcattttagtcttctgtagtgcttaaaataggaaaatgtaggtaccatgttagtaatttttatacccttgcaggaaaaaaaaattgccctcataagccctttaaaaaaggcataaaaggatgaatcttctctattcatcttacgttatgcattgttagcaaaatcctaaattattcttactaagaaatttcagggtgaagctggctagttagttccattttaggtgggtatattcagtttctttgctctcctcatcttcattcatactgtgctatgacccgttttttttttatttctccttctctctttatatttttgcctcttctgactttgtattttattttactgccatataacccttgattatagtttgattgttctgaacattagtgaccttcaagataccaagaaattacctgccttgattacagctgatagccaagtaaaatattttggtccttaaagaatgtcacttagaataatatgaataaatatattgctgtattcagtcttaaatatcggtactaatgcagaagaatatttaaattataaacagctggatataagatttcctacttgccatggcacttgcggtttctaataataagtctcagagtaatgagagtcctaagtgggagtgatggattaatatcattttttctgcttgcctgattcttgtctttcaagtcatagttaaaacctttcccatcttagactagtaaatattgctacaagttgagcatccctaatctaaaaatctgaaatttgaaatgctccagaatcttttagagcactgacatgatgctcacaggaaatactcattgaagcatttcagattttggattagggatgttcaaccagtatgtatgcgcaaatattccaaattttgaaatccaaaacacttttggtcccaagcattttggattagggatactcaacctatgttcaagtgctagtaattattcccatacagggagaagttcagttttctaacttcttttttaaaaagaatgaaatttggagtaattctaaggaaatcttactcatgttcaatctctgtccccttccaactctgtccatcctcaaaatgttgacttctgacattcacattataacgcagcttggctcaggtgccaaggagtcagaaaaccccatttaaagagtctggagggtcagagaaatcaggacactatttaggcaacaaacacagtcaagatacaggaagaggacttttgaatcaaagtaatttctgcctagctgtgggcgtgtgtttcctgttcaggttacagggcttagttatgttatacatggcagtccaacaaagggcaactatagtactctaacttatttttcttgcagattccaacagttggtcacttgccttgtattctcagtggcccatagactctatgctgaacatgcatgctttccagactgtccattattaagtgtctttaagtatctgtccattgctctttcctttgaaatgtctccctcagcctccacttcatccccttattgctactattctactccttgccctaagcatcttacccataattaactatatgtatatatgttctcttatcattaaaagtaggttctagaatgctgtttataaaatttttaataccaaagatactaagaagctggtcagttctgcctgtagttcttagataatgtgtagcaaataaggaatcaatctttagaagctttaaaactactaactatacttattttctctgtgttattatagattatctaccctttctatccatgttaatgtaggaccaatagttcatttttctagaatagaccacttttgtcatttaaatgctattgaaacggctcccttccacctccctggtaatttttccagatgttatagggagttcgttagtgggcagcagtttgccttagtggttaagaatacagcttttatgaagcctcttgtctgggttccatcccagctctgagacttacagcttttttgtgaccttagaaaaattaccaaatttctctgtgcctccatttttttcttatctgttaaatagggataataataataagtattaaggtacctgccaggtaataagagttcaataagtgttaggtaattttataacattatcatcagctgtggatccaaggcctgcatacatgcttcactttaatgatacttacagttcttggacttggaaaccatatatttctgacttgaagcagaaatctcatcctcagcactatgtgtcatacttagccttttaagttttcaaactgctattattttcctaaattaacagtaggccaggaggtacctgatttttatgctaatcatctaactacatactctgctttttccatgtttgggtgcctttagttgtttgcataagcataatattttccatgtattgaatgattcacttgttaactttcagaataatttttactgtcatcccatatggccattcaatccagacaccatttgcttaccaaatttttattttggagatggtgggtttctttaagtacatttatttccattggaatcaaatccttcttactagttttcaacacttggaattgcttttgtactcatcagccataatggaattaatattctttataatacactctatacagtactctgaaaaatgagatggccaaatgacactaaccaccgttacctatatatgctattatcctttgcttatgaacagagtgagcatgattttgctgtcgtgaaactttcataaagtaaaattgtacaaaaagatgagtttttataattgctttttaggtgatctctttgcctcactggtttctcttccctcaataacctttacaaaatacttggatcacatcacttccttttgtagtaggtctgtcttggcttgactgctgtctatagaatttgggtcattaaattcttttaactagtttagagtatgcttttctgtggctctaccaacttctcttctatgaaagaaatcttttgttcatagtcaagcataaccttctctgttctatacttgtataatataggtttttggtcggcctttgtttctgtttaattacaccatgtctataactgaacatgtgatactttgcctaaagttacttgttatgcattaaatcatgtactgtattatctggtatgctgtcatattaactgttatatgcttcttggattcagttaaaaagtatatgtcattgttataaaactataatttccatgagaacatgagttctctatttcttttgtgcccttcatatgtgtcttataaagttaggtggtcagtaaacataaacagacatttacttgcatttcagttttgtgatttattaaaatcaaagtcaaagatttcacataacttttagtctcaactactttttgtcatgaagtatcaactcttgtcagttttaaaaaacccagttcttcatctgtggagcaggaaattatactttttctttgacagtagttcagctctaattgtaaatatgtactttttctgtaattttttaggtgttttgaaactatgaaatctcaaattgtaagacagcttgactttattttgaagtgatcctccctctttcatgtgtcttcttaatagaggctgagcactgccaattttttaaataattgatttaaatataataagtatgatgcattaatctagttttaaaaccatagtcctttgcttttctgtaggattattaaaatagtataagtaaaaacaagaagtcttcagtgtttcatcagttaactttgccctgttttctaaactatacagtgagatctttatattttaaatgagaaaactaataccaaaatcttaagaactccatcagaggatctctacctgttcattcttcagttaattctccctttcttaattgacaacatacatgataaattttaaaaatatgtattcagttaatcttttcatatagtttaaccattagcattataataatgtcattgccttttttttttcatttcagatgtcctatacactacttcaactgtaaattaaataggcttttgtgggggctagtcagatagcctgtaggttcctactaagaagatgctatctacgtttgaaagttgctatcttttgaataaacattttgaacctctttaatttggggatttctatttctgggttatagaaaatttataaaaagtagagaatgtagatcatcattatccaaagtacttgaatatttgtttatatctaaagataactcaccaacgtaaattagatgatgtttgtaaaacaaaaagttgatactggctgggcttggtggcacacacctgtaatcccagtactctgggaggccaaggagagtggattatttgagctcaagagttcaagaccagcctgggcaacatagggagaccccatctttataaaaaaataaaaatagtaaatttaaaacattgatgcaagtaattaagagatgtattaaggaagcaaaatgaacaaagactaacaaggcttctgagagaagtgttggcatagatcacttacaactacataccttttaagtataaccctagcaaataaaatatcaatccaaatactaccacagtcaaatacctgtggacatttacaattacaatcagtctatattctgcagccatatatgcataggttcatgctcccccacttaaaggtatttgcttttaatggagaccaatttaatcaaaactaaaaatacacttcagggatatccctcatcaattaaattgttttgttttcatagtggtgtgatgtcttcatatttccatctgcattttgcaccttcccaagatagcttaatagagacaaaaaccaagcagtaattttagccaaaaaaagtaaccacattttgcaataaagaaaggcagcttctatagggttttcatattttttcttaaactctgaaaacttctacctctggttatttcaaatcattagcatgctgggaataagatcttacataattttgcattgtactgacaagatttatttatttgccaattacatataaactaattcttaaggaagaattagccagaccatagctgaaataactatgtttaagcaatagaaaaggtatgaatagaatgaatgtaagcaaaagaaggtcaagtttgatgtattttaaactgggaggatagtcaaaatatagaaagatgaagttcaaaccatgtaaagattttgatttcaaacaaatatttatttcctaaagtgaagttttgtgagtatgtgtcccaaccctatccttcccatggcttttatctgtgtcaggtaaccagttaatcatgacataatttctcattctttcgagtgcataatagtgcccagcacttacaaagtaaacaatcacacatcctctttcagtcactgtcctctttctcacttagcctgaacacagccttagtagccatctcaatacagcattccaggcattactaccaaccagtctgatttggcatatcatgtaatattgtttactgacagtttactgtaatacaagcagtgtgctatgtcttttaccaaaataattgcatgtaatccttggaacatcctgtgtactagtattttaatccccatttacaagtgaggaaattgagacttggtttttttgtttttcttttgttgttgttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattgcatgttttcttcagggagtaggttattctatagaaataaggattgactttaagtaatatagcttgttttattttgatcattatggataaaattctttaaattacataatatacttcctagcattcttaacctaaattgaaaagtgtataacccctgttacggaaaacaaaaacaaaaacaaaaaaaagttgccatgcatggtggcatgctctttgtagtcccagctactcaggaagctgaggcaagaggatcacctgcgcccaagaattcaaggctgtagtgtcctatgctagtgcctgtgaatagccactgcactccagcctgggcaacatagtgagatctcatctcttaaaaaaaaaaaaatgctgggcgcggtggctcacgcctgtaatcccagcacttcgggaggctgaggtggtaacatcacaaggtcaagagatcgagaccatcctggccaacctggtgaaaccccttctctactaaaaatacaaaaattagctgggtgtggtagcgtgcacctgtagtcctacttactcgggaggctgaggcaggagaattgcttgaacctgggaggcagaggttgtagtgagccgagattgtaccactgtactccatccaccctggagacagagtgagactctatctcaaaaaaaaaaaaaaaaaaaaaaaaaaagtcatttttccaaattacaattgtaatagtggtatttggccatctcttgggttacctgatttttaaactacagcagaacttaaaaagcatgggagtgcaggccgtgttttataccagtcattttgcctatactgattcattattcactcaacaactcttagatcagtatgaatattaatttattatgatgatataatacaacagtcttaccttttgagagacaggcaatatataaattatgagctcatggtttttgagtttagtatgtagtgtttgtttttctgaaaatttactcgtcacttctgataactgtttatgtacccctggcagctactctccccacttctaattttctgcttctaatctgctgttactttaaaatcaagtaatctaatttgttgaaattgtattaaataagacgttctagaattttaaattctactaaaggcttaaacatcacgtatttgattgagagagaataaattgtcacattatcaactgaattctggataatgttaactatattgcaacgagagttccagatagtgcaagaataatccaggaaagtgttggtattagttttaatttattctatatgcatgaagattttcctctgtgatatgcagatgtctaatcacatggtgatattttaagcactatttcaaaattttacttttaaataatgtaggaatcattcataaccctgtaataaatagcttggaagtattaatggaataaattgaagaactgctttgcagtgattttgagtgttttactatctttattcaatcatccactaacttcttaacaaaaattacaatccagcatcttactgttaggcttatttagagtaccctaaaagcagcattatgctcctaaggatctaaacaaagtaggtaagcaaatattggaaaggtagtttatgataaagaaaataaacttgaaagatgagttttgaaaaaagatgggtggatggatagatcagtctccatggccaaagccagtaatcttgaactcttattcagtgatccagtttgaaatttccttgcctgcccaaaacatgtacagtagtccctccttatctatgagggataccttcaagaccctcagtgaatgcctgaaactgcagagtaccaaacctgattgctgtccagtttaatgccttttccatcttaactaagcacttaggtactgcggccattaacttttgcagtttgaggtatcacagcaaaactagcatgaatttctttttccttcttcataatttcatggatataagattcattcttaccttagagctcagacacctcagcatacgattttttttctattgttgagaactttcaccttttcacttaatggaagcactttacagcttctctttgacatatccgaattaccagcatcactacttttgtgcttcaaggccattcataatggcaaaataagggtgacttgaacacaagcacttcaatactgtgacagttgatctgataagtgagatggctactaagtaactaatgggtgggtagcatacacagcgtggatacactggacaaagggaagattcatgtcccgggagggacagagcagcacagcaagagatgtcatcactactcagaacagcacacaatttaaaacttaagaattatttatttccagaattttccatttactattttcagaccactgttggctccaagtaactgaacaatgaaaagcaaaatgtccgataagtggggctactgtattttattggaataagggactttatctaaaagggagaaaattgaaatatctcattagaataatagctttttaaagttgatactaccatatcttattggttattatttgatgtgtaaagttttttggtttttaaaaaataaacactgatttacctaataccatttaaatgtgtaataataaggaaagattgctttggctatcttccagcttgtggagagactccagagcaaatacgagcaccaagtggcataatcacaagcccaggctggccttctgaatatcctgcaaaaatcaactgtagctggttcataagggcaaacccaggcgaaatcattactataaggtaattctacctttctgtattactatataatttattacaaaacataaattccattttcatttattattacttaacatgcagtaatataaaaagaaggcttttcaggagatgtaataaagaacagctattagctattggtgtcatcttaagagtaagagtaacagcccatctggtatgtgttttgagtattttctaagggtggtaatgtatttgcattgaatcatctatattcttctaagctactttttaacaaaatatagacatttgcaaaatagcctattagggtcaagactaacctttggcagtggaacaaacaaataaacaaaactcattaattcacttggatatctagctcttaacctttgtctcattagtagagccttctacctaaatgagttaaaacacaatttgtcatgcctgtctgtatatgtgtatgtatgtataaaacttgaaacaaactgataatggagaaatactatatctagaaaaatctttgtttataacttcgaaacaaaagaacatttgttaagaatacaaatgaaaggcattcctaggggaaatagctgtaagtttaagattctaagaatgaatgtgacatataaataaggaaaggttagattaaattttaaaacatttagcaaaatacttgcagagaaaaacagtacgggaattaagatgtaaagaatatattagtagaactagatactgcttgcttaggaaaattctttaaagccattaggaaaaaaatatttacctacaggggaaaaaaaaatagcccgaatgaagaactgcagttggaacaaaacacaaataagaatgtcatttccatcacagagacagtgtagcacaaaggcaccttcaacatgttttcatgtgtaacattgtatgggtaggaggcatagaattttagatttagaagagactttggagatcataaactcaaattccttcattttatgtttttaaaataagacttatacatttagcctactttctcatcttttttcatcttccttttttgtatttattaactgatgaggaaaccaatctctcttgagaagcataactgtcatctatctcctttttttggtggaaaccacaaacaagggccatagtttgttttccttttattttcctctaccctacattacctcttctggaaccccagagcttggcacatacaaaagctgttgttctcctcctccatgcagtgtttttctcttgcctgattgagtggtagaatgcaccattaaggttatctttctgtaacagggtcagtgtttaaatgtaaataatatacctattttctgttacttgtagtgtgactaagtatgtttacaaaataacatttttaccacatattgggagttttttagcataaaactagaatttatagagaccttcaccttttaacctaaaaatttaacttacaacttatagctcagttttgtaaaacttgaaaatcttaccagcacagaggagattacatgaaatactgccatctggttttgataatgtattgcatccttgagatttcatgaggttaagatacactaaaaaccaagcacaatactgaaatgcagaataaaattgaagtgagccctacagctaaaggaaaatttcctgaattttagaagggagcaatgaatttcgatgtatacagatcagaaggtgattttagtaattgttcagattctttactgaagtcattatcatggtaataccataactttaaaaagatgacacacctgcatatacacaaagacaagttttacatatgattatcattgcataatcttaaatgattcaaaagaatcatatgcataattaaatgtagctcttttagacatacaaatgagtcagtattaggaaatattaaattaacttaccatgtaaacaagtcaaaagaaaaagtatatgattatctagtgtacacagatgctttgaagcatcttggtaaaaaagaaaatcagcattcattcctgaatttaaaataaaaattttaaattcttagtaaaatggaattagaaacatgattttttaaaatctggatagaagagggaaactaaagttacggagtaaaaacaatactgagaactgtctgtataaaacttgcttaagatggtgaaataaaggcatttttacttcattcctctcccttggaacccactataatcaacaaaggccaccttatccatggggaagagaggattgaataccagcaccctgcttgaagccaaggactagggacgggcaattttgctccagacaggaggctgaaaaatcttccaccaaccacagcctgaatttatatggggctgagagcttagagagctgagagggcataacctaacaaacatgaataactatgtcacctgctgactccatgaaaggatctgtaatactctgaaccatcatttaagacttgttctggaatgtagacccaagtaggggaacatagaagaagagaggattaaaaaaaagagagaaaaccaaaaaacttccataaaataaacctgtaaaccaaaattccagaatgtgtgaaaaaattgaatgctgagaaaaacagccaaacaaaattaagttggaactcaaatttactccaggcattttaagatgtattctgtcagggattatttcttaactttctttatgccacggccacctagtattctggtaaaacctatgtattctttcccagaataatgtgtttaaattcattaaaaaaaatacatagcattacaaagggaaccaattatgttaaagtacagctatcagatattttttaatatttgtaatgtaatatatgcttatttatgaacacattagcaaaatcaagtggttaatttcaaagaaaaaattttacgtgtaaatagtatttttagatatctgtaaaaactgaaatgtaacataaaaatatctctaattttgaatagtggtggagtggccagtgctataaatactgtcatggtttgttgtttataagtgtaggaaatgctaaattttagtaaaaggttagtgaaaataaagctttaaattgtttctaccctatttgtgatttttgaggggacaggagaaacaccgaatattcttacttggactttgttagaaaaaaagtgtgtttcagcatttcagttaaaatatcaaaaggtagccactgattaaaaataggagtaatattgagcagttaacagaggaaaaggaactttaaaaatatattcaaaaaagacaggaagctagatgtggtggctcacgcctgtaatcccagcactttgggaggctgaggcaggcagatcacttgaggtcaggagtttgagaccagcctggccaacatagcgaaacctcatctctactaaaaatacaaaaattagctgggcatggtggcacgcgcctataatcctagctactcaggaggctgaggcatgataactgcttgaacccaggaggtggaggttacagagccaagatcatgccactgtgctccagcctaggcaacagagtgaaaccctgtctcaaaaaaaaaaaaaaaaaaaaaaaggaaagaaggaaaatgagaactctctcccaagtagaaaggttgtaacacatctaaaacaaaactaatacagaatgtctaaaaacaaggagatgggccagatgctgtggctcgtgcctgtaatcctagcattttggaaggccaaggtaggctcaggaattcgacaccagcctgggcaaggtggtgaaaccctgtctttacaaaaaatacaaaaaactagctgggcatgatggcacgttgcctgtggtcccagctactcaggaggctgaggtgggaggattaccggagcccaggaggttgaggctgcagtgagccatgaatgcaccactgcactccagcttgggtggaagaatgagacttagtcttaaaaataaacaaaaacaaaacgagatagaaaaggttagttttggagctactcatcaagagaaagctagtgtaggaagattaacatccattgtaattgagcttaaggcacaaaatactagtaacaattggggtattctaccaggaaaataaaccagcagtaaatttcatttacttaattacatagcctaaaatacatgcaaagcaaaatgtggagaattgcccggcaaatttgaccaatccacagttgcagtgggagatttttaacacacctttaatacttatttcaacaaagaatacacattcttttcaaagacatgtggaacatttataaaaattgattatgtttcacatcacaaaggaactcttaatacatttcaaagactgtacatcattcagattgtgttttcttaccacaatgcaattaaaataaaagaaaaaaataaacctgtatgtttagaaatatattcctaaataactcctgaattaaagaggaaatcacaatgggaccaaatattttttaaataaccatagtgaaagtaatacatattaaaactgttagaatacattgaaagaatacttagaaaagtttacaactttaatgcattgatttaaaaattagaaaataaataagctcagcatttaactcaagagttaaggaaaagaattagagggtaaattttaaagtagcagtaaagaccaggaaaatacgcaataaaattcaataaaacaaaaagctgactttctgaaaaactcaggaaaatagataaaactcaaagcaaaactgaagaaaaagagaagataaaaagagcaaaagtgtctgtagttataaacaaaatttttaatgtcataagagaatattataagcagttttatgttaatacttttatacaagtagatgaattggattattttttagaaaatttatattactaaaattgattcaagaagaattagaaaacggatgaaatcagtagccattgaagaaattgaatcagcattcaaattaagactctagaactagttttataggcaagttttactaaatgaatagaaaaggaatttccttaacctggtaaagggtgtctgtttaaaaattttcaaaagcaaatttaatgtcaaagttaattatagcaccaaggaccaagacaaaaatgtgtgcttttactggttatagtagaattcttagtgaatgcaacagtgcaacagatagaaatcagtgatataaagaaaataggaaggaagagaaaacctttatttgctaattatatgtttgttttaagcagtctaaagcaaacttaaagatcacagataggaaaaaatgtctttaaattgtatgaaagtactgtgtacagagctttgtagtaataaattttactatcaacataagatcaatttctaagaaaatttaaatggtcaaaagtttaagaaacactgattaaaccaaaaaacatcaagaaattgaaactctctccctgactcaatatattctaaataggcacagagcacaaatatgtcaacagtgcttttattacacaaagtactatgaagcatttaaaaaaccaaaaagtaattttacttatttaaaaatcctaaatgaattagcaaactaaaatagggtatacatgaacagatatttattgtttcttattctaaacaaggtttctgccttcatgaatcttttttttttttttttttttttttttttttgagagacacagtctcgctttgtcacccaggctggagtgcagtggcgccatcttggctcactgcaacctttgcctcccgggttcaagcagttctcccgcctcagcctcccgagtagctgggattacaggtgtgtaaaaactaaaactctgaaatgcttaaaaaatagttgaacatctttgggatctttggaaacaccaagatagcttagagaggacactaaatgcactaaacataaagcaaaaataaaaaattagacttcatcaagactaaaattaaaaaccacgcccaactaatttttgtatttttagtagagatagggtttcaccttgttggccaggttggtctcgaacttctgacctcaggtgatccacccacctcagcctcccaaagttctgggattacggcgtgagccacctctcccagcctttgccttcatgaatcttaaatgtttagtggactaaaagtttattaagggattccctagtttgaatgggactagacctcccataaacaagagctattaagtttggataagatattttaaaaccaaactagggattccctagtttgaatgggactagacctcccataaacaagagctattaagtttggaaaagatatttgaaggctctggagagtaataaaaaactggcaaaaactggagagtattccacccctgaaagaaggaaccacacttcgtgagataggcttgtttcctaccagttctctgaagattcttgccagtctgtgcaacgtggagtgactggaactcaagcagatcaccgtggtcttgtcagcttgaggtgtcaggatgcagttgaggatgggacagtaactggaaattaataaggtaactcctggaaaggagagaaccacaagctggaaagtaactgcatttaaattattctcgaatccttagctgacccatgaattgtgtgtgcttaaagaagactccaaggaacctgctggaaagtaacagcaggaaggctgaagatttcagctgctgcaccccacagcagaggcagcatgtggagtttgaatcctgtccatcacaggggagaccgagtatagggcttcataaataaatgccttgagatttttaatgaaactctgtgtgtcatactttacaagtaaagacagtgtccttaaactaagaattccccctaagactaagggcaaagcagaaacaaactcactttaaacaagtgtaaaaccaaacctcctcaagttcatagtcatcagactaatttaactgtgtgatagaacaaaaattagtatcttctatgttctagataaatgtaagaaagaagaatctcattttctacttgaaaacacgaaaatttatataaatctcagctataaatgtaaaaactaaaactctgaaatacttaaaaagtagttgaacatcgttgagatctttggaaacaccaagatatcttaggacaacaaatgcactaaacacaaagcaaaaataacaaattagacttaatgaagactaaaatttaaaacttctgcttattaaaaggttccattaagaaaatgaaaagacaaaccacaggctggaagaaaatattagcaatacacatgtctaacaaaggacttgaatccatttttttttttttttgaggtggagtcttgctctgtcgcccaggctggggtgcagtggtgcgatcttagctcactacaacctccacctcccaagttcaagcagttcttctgcctcagcctcccgagtagctgggactacaagcatgcaccaccacacccagctaatttttgtattttcagtagagacggggtttcaccattttggttggccaggctggtctcgaactcctgacctcaagtgatctgcccacctcagcctcccaaagttctaggattacaggtgtgagccaccatgcccggccaagaatataaaagggatttttataactttttttttttaatgggcaaaagacatgaacagatacttcacagaagatataaaaatggccaataatcacatgaaaagatgttcagcaaatttgtcttcagggaagtgtacataaaaccacaataagagatcacacccgtcagtgactaaaatgaaaaagactgaccacactgactattggagagaaagaatgtggatgtaggtggatatgacatgtctcacataacatacatgcccccgaataagctcatgtttataatatgtagagttcttaagaaatattaatgaataaaggaggcaatttggaaaacaaggcaatttggagtaaaagaaatagaaataacccaaaaattggaaaaggatttcaatctcagtaaataaagacatgctaaatagaagtgataaatctcttttgtctacctaattggcaaaacatttttaaaaatagaatatgtcattttgctaaacgtgtggggtatatggtactttggtacatacttggtagaactgtaaattcgtataaacatgtttttccagtgtctgtcagatttaaagaggaattattcttctgacctagcaatactagttctagaatagtttgtcctagagaaattcttgttcttgtaagagagatacgtacatgtataagggttttgttttgtttggttttgtttggttttgttttgtttgagacggagtctcactctgttgcccaggttggagtgcagtggcacagtctcggcttactgcaaactctgtctcccaggttcaagagattctcctgcctcagcctcccgagtagctgggattacaggcacataccatcatgcccggctaatttttgtattcttagtagagacggggtttcatcatggccaggctggtctcaaactcctgacttcgtgatccgcccacctcagcgtcccaaagtgctgggattacaggcgtgagccaccatgcccggccaggagtttttaaagcatagttcataatagtgcaaacctggaaacaatcaaattgtctatcagcttttgttagttattcagaatatttgaagaagaaacattctggtataataatccttgggtaattaactttattatcacttagtttaaggcaaaggcaagaatataaagtcagatctttactttttggtgaggcatattcagatattgtaaaactgtattttggtttctcttttttcataagcagtgactaattttctgtgtgcatttatttatttgatgtttttggcctatacttatgcccacattttattaactacaagatagtatttggctataaagtgatttatgtaaaaaagtattcccaaactcaaggacttttcaccaaaaacatttttcgtgtgttcctttttcagtcttttaccttgctcagatttgtgctaattactctcctaagaatgtcagctgcaaacttttcattaagcaggtattaatctaagagaaggctgagtttctctgtgtttacttcaattcatcagattggggagaggtgattctggttggaacacagaacagtttaggatgttctgagttagaagtggtctttcccaaccgtacacacagagaagaaaaagaaaaggtgccaactgtcacctgttttttaacattattttggaacctagcattacttgtgaagaattatttttctacaatctggggaagaaatacaaatatgaggaacatagaattagtattattatttgctaatgatacggttgtatgcctagaaaacccaggagaatcagtcagtatatggaggcttataataatatcctcagttactttgtaatacgatttttttttccaaaattgactttttaatagacatttctgatttttttttcagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcaggtgtgtttttaaataagaaagatattgaactgaattttatggtattaactgctctgtcacttcggagctaatcttctaagtagtgttcatttaattaggagtaggcccttgaggcagctgagattgaggattagaagctaaagttagatgccctaaagctgggtctccaaaaggtgttttgtataattctaacaaaatgattaacttcatatactaaggttaattttctttttaaacatcttaaatacatttattctaagaatagccttttctccctcaagtgcttacgcatatccagaaagttacttcagaatgtatttttgtggtaattgtcattgtttttatacctccagagaaaagacctaacaaatttcaccttcatagtttatagtctcagaaaaaacgacatcttttcttttcttaaattgtgtctaaaaaacaagaccagatcatacaaatgtgaataattcagaattagtcctctcttttagatcaaaatgcaagatcttcatggaataataataagtatttaacaaattgaattgttgagtaagcatgccagtactaatttgtcattagaacccaacctgttaaatcattccatttataaagatacatacacacatacgttgattgcagcactattctcaatagcaaagagatggaatcaaaccaaatgcccatcaatgatagactgggtaaagaaaatgttggtacatatacaccatggaatactatgcagccataaaaaggagcgagatcatgtcctttgctggaagctggatggatggatgaagctggaagccattatcctcagcaaaataacacaggaacagaaaaccaaacactgcatgttctcacttataagtgggacctgaacaatgagaacacatggacacaggccccagatttattgtggcctttctagggagggtggggtgggagggagagcattagggaaaagacctaatgcatactggacttaatacctaggtgatggattgatgggtgcagcaaaccaccatggcacatgtttactcatgtaacaaacctgcacatcctgcacatgtaccctggaacttaaaattaaaatattaaaaaaccaacctgttttttaaaacttctagcacttgggctttatgaacatttattataaaaatatcacttgctgttttatgtcttttaaagattataatttttctccttctctttccatctatttctactcacatcttcacagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaaggtcagtatcaagacagaactattgggcctcaataaaagcaggcccaagtgtttgaaacaagttctttgatgattagcaatgtatttttgttttatattagtttagaaaatggataaagattgttgatgatgtataaaattagcgtgaaaaacccgagactcagaaggccagacacattacaaactaaatatttagagttatgagaaaaagcccatctatttaccagctcctgttttcagattaatctgttttataggaatattgtaagctgcagctctcagttttagtgttttaacctgtatttttctaaatacaaattcaaaaattccagttattctatatgctatgttcaaagcatacaggtaaatagaaaaatgaataaggcataatatcacaagcagtttacagttaggaggaaggaattggggcatggaataagatgacaaaagtataatactataaagagctatgaaacaaaatggtataaagtcaaaaatacgtaatctaatgagggagagaggcagaaaggctttaattggaggggtgccacttgaaatgtatgagtagaagaatatagataggggaaaaggtgttgttaaagcaataacctaggaaaatatatagaagtaggaatgtccagcattgctcaaaaagtaagcacatgattcagtttatctggagcccaggatgcgtatgaagggctaacaggagatacgattggaacacaagactaatgtcctgttgtagagttaagtgacaacagcacttcagagttctcagttcagtaagaaatggttaactgttaaagggtgaccttcagagtgagtagttttcagtttgatgcaggataaatgggacctggcagaagttaatggcagagatgtccctgtggagacaatgaccttcagtcccaggagaattacaaataatagatttaacaactttttacgtaacagatggctaataggtggcacacagatgcacagtatcgtaataaccattactgcatcttttcttttttttccttttttttttttttgttgtttgtttggagacgggagtcttgctctgtcacccgggctggagtgcactggtgcgatctcagctcactgcactccgtctcccaggttcaagcgattctcctgcctcagcctcccaagtagctgtgattacaggcgcccgccaccacgcctggctaattttttgtatttttagtagagacagggtttcactctgttggccaggctggtcccagactactgacctcgtgatccacccgccttggcctcccaaactgctgggattacaggtgtgagccacggcgcccgaccactgcatctttggccaagtgtaaatggccagaaaactttttaccacattgcaacaaaagagcacaatgaagagtcaaagatcccagctgggcgcagtggcttcaacgtatattcagtaaatacagtattcttaggagtttttaaatcttgtattatttctccctttaccttttacagggattttcatttattaaaactcagtgatctaggcttctactagcataaagccctatgaagacagactgcctgcgtcagctttgtattcccactgtagggataatacatatattcagtaaatgtttgtcaaatgactaagctttaaaatgatcaaatatgccaagactcagattgttttaattactgataatagaaaattgttctttttcttcgctcccccttttaatcatttttctttccatctactctcaaagatcatttgaaacacagttgtcaagagtggaagcagaattgttaagaagagaagctcctccct

SEQ ID NO: 17068 - DNA, 89584 bp, Human
ctgatcattgtccctcctcctgtgctctcaggtgatatatgatttgactatttctttacctcctgcttttaacctaatttgtattttagtgagccctctttactacctgactggtagggtgtgagctgagatgcaagccccatgtttaaaggtaggtgtagtcaccttccccagctaggcttaggaattcttagtcagcctaggaaatccagctagtcctgtctctcaccatcagtttctccaaaacaagtgttctgagacttcaggcagaggatttcccaccaaagaaatgccagtgactgttaccagaataaggacaagaatatatgcctggtcagcagatgtccaccccacctccccatgacccttcataacccttttgcaagattccatcctgttgcccttcttaaaattctgcattcctgccttccatcacacagacctgtggtctcccttctctctgaccactctgtctcttcttcctcctcctcccctataagcaaagggatggtccaggattcagtgtaagcctatccctcatagcttaaccacagggagtgcattccttcatcctctctgtgcctttacacgctctgttcactctacctggagcactatgtcctcttcccaccactcacctctgcgtgttcacattctctgtatcctagttcaaatacctcttcacaaatcttccatatctgatgtctttaagccagaaataaactcactctttcctctaaattcttatctttatcccttctcaaagatagaatgttctgttttatatattgaaatatgaatgtgtgtcactgttggctgttagctacttgagggtggaaatgtggtttatctttcccacttagccctctagccaatccccctagtcaggtaagctttgtagtccttacaaagccagtatttaagtgaatttgcatggtgcttcccactttattagggtgtattcacagccatgatcatatttgcttctcaaagcaaatatggaaggcaagaacaagtattaatcaattttatatatgagaaaactgaggaaccaagagaataaaagatttaactgaagatctctaaactggttttgtggaaaagctgggagtagaaatttaaatctttagagttacagtaccggttattttccaagaaacacttgctggtatgtgttgtatcattaaactgtggagaatagttgacaccaagtcgttttctttcaaatacattaaatattttactctgatccttccctgtgtctgccaattactgggattatatgataatttgctcctcgcttaagaacatttaacaggaaacccagatcgagtggctctgttctggcttgggtgggtttgggtatttttgttgctgcttctagtgatggttcttgctttctttctccctctggatctgtcttttggtacaaacacacccccaaccaagggaaagggtgaggtggatttctttccctttagcacctaatcttatgatgaaaaacgcaggttcctttctcttaaaattccaagatctttcccttccaatgactccgaagcctgggtggatacctcaactcagggcgcagaacacttggggtctgagtgtgcaaggaccatgcggacctgttcaatcccggcctttgggctccagcccagccttcccggggggaggagccgcatatgcggccaggtcataaacccgtcaggccgccgggctccggatttgcagcctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggtacccgccccgccgcgcccccgccccgcggtacccacggaggctcgggcagcctccccagtcgtcccggggtcctcagcagggccgcctcgcgcggcgcggcgccgaggagctgggtgggcgggaaggagcgcagccccggcgggtgtcagaggggactcagattctcttcgctggggtccctttcaggcgccccttctcggcggcagccgagcagccttggctcaaccagatgccctcgactcctcctttagtggttaatttgacgagtttaaggccatccccttaccctaatttctctataccgcttactccccaaatctccccgcaaccccattttgattggtgttctgtggaagtcgcaaatcttccatacattctttagaatctttttttaaagtaggcacttccagccatttctcccaaccatttcgacccatcctttatccccaaccaaaaccaaatgaaaaatccattcacctggtagttacagccttgactcaaagtgagcagtgtagcaggtaatgtgtctgagtaggctagatgcccaccgtgttcacgttcccgtcccctaccctctgcccccactcccacccccagtagaaaaaatatagccccgaccagggtttagaagagaaagtattccagaaatgatctcgcaacactcacacacaccaacgcagcctcgcagcaggctcttttctccatcccacttgcgctggggacacaacattcttgctgctggagtacccatagttttactgatgttgcaggagggtaatcagatcaccactccccaggtgaaggtaggcttgggtttctctagatacaaaggcctagaagtttgggtcaatgaaaggaaacttaaaccaaacttgtccaacctgtaggccgcatgcagcccaggacagctttgaatgcggcccaacacaaattcataaactttcttaaaacattatgagattttttttcttagttcattggctgtcgttagtgttagtatatttcatgtgtggcccaagacaagagaagccaaagattggacacccctgcaacatttccccaaagctcctcaacacaagatcaagagactaacagagcagctttacaggaacatagagtaaaaattctactctcagcacttgggctaaagtaaagcccacatcctccctaagtcctgtgttttgagctgccttgagagaaatggctccttccaaagtgaagatgtattgatatactaaaggccttggcttttcacttggaccataccttgatgtgtgaaacaagttgggctattaagtccagtgtatagtaggcttccttcctccctccctccttctctccatcactccctcccttctttctccccccactaccccctccacccctctctttctttctattcccatgttactgtggacaggctgacagtcttccaaagcagttttggtgatagctacttcattcatatactgatttctgacagttttgctctccttacacctccccctctccaagttccccaatcctctataattgactggaatgattaacagaaaaaaaggaaggcaggtagatttgacccagagagaaggatctgggcaggctgctcaaatcaccatttggaaagcttcttcctgattactaattatcaacctatatctttatgtcaataaagtcttttgtaggacagattgttgtatggtttgaaaattagcaaactttgttttgtttattcatttttcccttttgctaaaaagtaatatgcactgaatttgaatgaacttatttttccattttaaagaattttttagctatcaaaacaatatgtgattgtaggaaacaattggaaaaataataggaaaattaaaagaagcaaaacattaataatactctccctctcagtgacagccaatgttttggtgtattgcctttatgctttttagcatgctctattttacataatcgatatcatattgtgcatgtgtctgtgtgtgtacacctatatttaaaatgtcagaacttgcagttttcagtcatagtgcaagccctttctgttattacagacttatcattaacaaagtgctttgctgatggcagggcatcccattgaacactcccacctgcaaggtggggagctgctatttctgaccatgagttgcccactagcatcattctccctcttacagctgagcagtagctttcattctctttctgccatcagggttccagatgaagcagcaaagaagaggaagtggaatgctgtgggggaggggcattccctctctttctcaagattatctttgcgtgccccaaggtcctgggaagtggttcttggtcttctatcttttccttagccattctgggattctctagttcagagagatttataattcttaactgagaatgtaggtccttatggcgtatagtctgttgtcaacatctcaaaggatttatccaccagctgatcctctaagcatttctgtacttaaaggttgtgaaaacattaaacaaaaacatgttcttcatgagcttaggatcttaaacaaaaaatgatacggtcagagatattaaggtcaaaggtttagcaaataccaaattcctgttgaatattaaacagtacttacaaaggggctgtgttgcaatagtctagttcagagtcagttggttggatcccaagaggtaaccactcccaccccccgaaacagctgaggcttcataaagtgaaccagatggggaaatatagataaacataaacattacagtattgacctgaattctgaaagaaaggcattatagagttattttgtcttctttcctggcctttgcaataatccccaaagcaacgctggtgggtgtttgttttggggagctagagacaaagataggccttttgtaaatactggttgtatgatatgttaaacttgaaaaacatcttcctattatacctttaagtaacatctattttatcaagtacataccagccaatgccctaagttgtgcattatcttccaaaaatcccagatgccattgtctacttttttacaattgaggaaattgaagcttaagctacctgcctaaggttgtacacctagggctgtaactcactgagtggctcttcaaatttagtactgcctgaccccgtcgctaaagctgttacctattagtgtctgttcttttgaaaaaacatataatgttcagatttgtcagggtggcaagtgatagatgacagagccatataagttgcattttaatgcgaggcatcttttctcaaaaatagagcagagccgtctttagaaaagacagtaactcttcactttcctaaagctagaggcagttaaggttatcaaaataagtacacactgcaggtattcagtttataaggcatttgtataatacatacatttatagccatatcatttgtaagggtacagaaatggaccttaagtacagaaaaagcataaagtaaaaatgatatattatactttcaggaaatgggcccctaaagtttagaccaatagctgtttgcattctacatccagcaggctgatcatttataatacctgacaaatacaaaaggatattatttgtggtactctatttatcgatcactagattgtgatgggactcaattttaaaaatgaatatacattaactaaaggttatttattttgtaaatctaattcatgtcagagattggtttaaagcctataattgattagcttaattacaggtaaaagctttctgaagtaactaatggaaataatgttctgctttaaagaaatcatatttcattttgttggtctataccagatgtacagtggtcttcagataattcaatatctatgaggaaggacaatggaattttttattcaatgggtagtatgaattcaataaatttgaaagaatcgtgactttgcttttactacattctgtgataagagaatgaagtataagagtttggcaagttttcaaatatacataaatttgtattcagaggtgtatgcaggtcagagtgggtggagttgcactgaaaacccggtagtgtcagtagctggcaggaggaacatctttttaaaaattgggaaaccatgcaacacatttttctttttttcttttgttttttctttattgtaaaggacaaaaagttctcaaaattattgagaagggaaattacactttgctttgaaactttttggtaaaatgccattgtggggattacttacaaggcagtgtgtgattaagcaggtaagtgtgattaagcacaccacacatttagttgtatttatagagcttctgcaacttgtggaagagctgtgcttcaaaaaccctggttgcaaatcaaatccccttttctgttgcttgccagagctcccggctgggcttcaggagctgtgtgggctgattttgtgaccttaggcaagtaatttcctctctcaggattgtcagcattttcttgtctgtgaatgaggcaatggttagatgagcaattcaaaaagagttttttaagttataaaaacaatatatacttatcatccagaccttaaaaaaatgctggcacattatagtcactcaatatgcattagttaaatgaatcaactgctttttcaaaaaagaaaaatacagatgagtataaagaaaaataatatttaaatcacctataattttaacatttggctccctatccttctagatatttatttgttgggggaacgtgtaaacatttgtttccttctaccaaattgggcatactgattggagtcagccttgtttattaaacatttccccctgtccttaaataccactggagaatgtgattttgtggcctcattatcctctctgaggataatgatctctgagtctcggatctctctctccagcctgcatattccttaagcatcaggcctcaatttctgcctgtctctggatatcacaacctggatatcccagaagcacctcaaactcagcatgttccaaaccaaatgtgacctctccttcaagtttcaaactcatttttcttcctgtttcccaaactttgatggttcagctctcatcttctccatgatggacattttggtgatctccagtgtttatccactatatagcaatgctgtgacagacatccttatatgtaaattattgttcatattcttgatgattgcctcagaaatgatcccttagagtaaaatgcctgggccaatgagtattagacacatcttaaaggagtttaatacattcattcagactgctcttcagtttatgtgcccattatcattcccatttcactgtattcttgtcgatgatggataatgacattattttattttattttattttattttattttattttattttattttattttattgagacagggtctcactctctcacctgggctggaatgcagtggtgcaatccagctcacggcagcctcatcctcctgggctcaagcaatcctcccacctcaacctcccaagtagctgggactgcaggtgcacgccaccatgcccagctaatttttgtatttttttttttttttgtagagacagggtctcactatgttgcccaggctgatctcaaactcctgagctcaagtgatatactcacctcagcctcccaaagtgctgggattacaggtgtgagccactgtgcctggcctggataatgacttttaaaaaaatctatgtcaatttcagaggaaaaacgtagcacttcttactgtctttaaaagatcatctctttaataactggtgaggctgagctttgaacattcgtgttgtattagtagtttagatgctccagcttcaagggtttgtaattctgtggtttccttgaatggctgtttaatgattacaaacttaaccttcagactcatcagaggaagcacaaaaaaactcaaagattaactgaaaccacttgatgctaactaaagctttggttctgttaagggtgttgtgtattaggaatcctttcactgacttagattccaagacttgccttatttcagctttgatagtccatagttcatgcttttcacctccaccccttgttttctctctcacatgtctggcctgggtattttcaatgtctctattagtctgttctcacactgctataaagaagtatttgagactgggtaatttataaagaaaagaggttcaattgactcacagtttcacaggctgtacaggaggcatgaccggggaggcctcgggaaacttacaatcatgttagaaggtgaaggggaagcaagcacatattcacatggtggcaggagagagagcaaagggggaagtgctgcacccttttaaacaaccagatctcatgagaactcactcatgagatcgacaagggggaaatatgcccccatgattcaatcacctcccacatggtcactcccccaacattggggattacaattcaacttgagatttgggtggggacacagagccaaaccataaaatgtctgagagaggtagtctagaaatcaaggtttccatgatgcttctctcagggaggaaagtcttttcctttaccctcttatgtttagtaattgggggcctgcaaattaaactgacaaaagagagattcacaaaagaaaagacaaattaaaaaaattcacatacatatataggaattcacagaaaaatgtgactcaacgagggggctagatttggggggttatacaccatcttaacagaacaagggaaggcggagcaggcacttacaaaaaaacaacttcttaataggggatggtcacagggagaaaagacacataggaaaacaaatgacttttagaaaagataaatgggcccttagaaggagatatgggacatatgacagttttgtgacagtgtctatttaggtatggtgtcagcttccaagtctctagtgataagtcaatcttccctggttgtgaaactcctagagaggggatttatgataattgaggtctttggggaggctttgctttatagcagatttgggacttaaggaaaaacaaaaacaaacaaacaaaaaaacacctattctcaaatatctggagctcaaaataatatttatgctacagtggtatattctagagtctcaactgccatctaatatggaataatcccaaactaaggatttttcaagctggctgttaggttccattaattcagtcaacaagtatttcttggaaacccactaagtgccaggcattgtggctggtgcagaggttatagagatgaaaaccatggtatttgttctcagcggtaaacagactagaggtatatgggtctctaatctgtctggactttgataataaattttatatagtaagtttgggctttatagactttgctttgatgattgtgacaaatttttagtaaacatgtgaggtcagtgacatctggcattttccctgttgctgagtcatcaatcacagtggcctgcatcacctggctgtgtttctgacctgcttacttggctgacaagtgagcctgggcaactggccaccatctacacctcaacactgctttgtgctttcttctcacacgtcaagtaacaagttgagaaaggacacttcaattttttctgttatgtttcattgcatctaacagggagactgtattatatagtgatagtcatggatgagttcctgagcctgaggatcttttcacacagaaaagaccttaacattcacctgaaagtaaaacaaaatgtaatcatttttagaagtcaagaaagtatttgaggcatagatacagaaataaactaaaattgtgtttgttaaaagtcttagttaacactgctttggtaatgaactttggaaaaactgagcattcagccttcagatgtggtctgcattgacactccatattaacatgttcatagaaggatctaggaaactacagggccaggactagcaatatttttgggaaatgacatttcacactaacacgcaacttacacagctttcccagtttgctattggaaaagtgaaccatcataattattccatctcgtgacttttagggaaattcactggtccttctcttcctttccccttcaaacatttagagaatattcatgtgccaggtactgtaatgggcacagaatatacagagatgaaccaacattgattaaatcagaatctctggggaatggggtaaacgctttctatatgattcctgcatgatccagggctaagaattgcttggactcagcacaggaatgggtagaggagggaagaacatgaatgatgtctctctctgaaatgggaaagtgctcaggtctcctaagagaggcagggacagtgtcagtggagtggagtgaatgagttgagagggaatagctcaatagacagctttggagaaagctaaagttcaggtcatgcaggaccttatgggttgggcaacaattgttttttctccatcttaagagcaaagagaagtcaataaaagattggaagtggcagatatggctgggcagacatatagtaggtatacctcctaccttggagttgtgttcacattgttgctctgaggattttctggggactgaactccggttgctcacagtggtaacctactcattaacacaccctctttatggccctcttcctttctgttttccctcccttctcatttcttcactgtgctagtccagtgggaagacgaaggtggcaccgggcagtagaggtgaagacgcaggagtagagaggctcctggagttcatagaagacagcctccagggtcttgttgatggattggatttggggatacagggaagaagagaagtaggtgtcaagagtaactcttaagtttctggtgggttggatgatagtgtgattaatattccaaacttagggaggcaagaagccaagcatggacaggaatgtgcaagacatctttacaaagctgagtgtgcttctggatttgggacagacgttgggaccatgaaacttgtttttgtaggtttcagtgattgtgagagagctagaaattcagccacgaacttttctcattaaggctcaaacataccgttgggtttctttttgttttacttgggtggtgcaggttctgtgatggattttagtgaaacaaagtcacttgttttaggataagcttagaaataagaatttggtggcaccataaaagggaagaaaatgcatttggatacagtagtgtaccctgaatcacagtttcaatttctccagttacctgaggtcaactgtagtccaaaaaacttaagtggaaaattccagaaataaacaatcataagttttaaattgtacaacgtcctgagtagtgtgatgaaacctcaagacatcctgctccatcctgcctggtactgggacgtgagtcctccctatgtccagcacattcatgctatagacgctccctgcccgtcagtcacttagtagttggctcggttatcaggtcaactgttgcaatattgcagtgcttgtggccacccacaagtcacccttattttacttcataatggccccaaagtgcaagagtgatgctggctaattgttctattttttattagttattgctgttagtctcttactgtgcccagtaataaattaaactttatcacaggtatgtacatataggaaaaaacatagcatatgtagggttcaatactatcctcagtttcaggcatccactggaggtcttggaatgtatccctcttggataagggataactcctgtactttcagtaatgatttacaatggaatattcttaaacaaaatcttgtgtaatattatgacccactgttagagtttatctcaatttctgttccactgcatttcttctggaagcagtgtgggctcccctgtcccccaaaagagttttttagataaactggaaggtttacaaggaagaacagtgaaagtaattaggagctgaaataattgatttgtgagccaggttagaaaagctaaatccattttgtttggctaactgacaaataaaaatggaaataagtcaatcaggaataaaagcaaaggaaataactaggcttcatgtagctatctgagagaaattggccccagccatcctttcccattcaatacagcttctccaaactcattcccagtctggggttgaggagagggagataagaatggggataagaaacagaacaagaagaaacaaaagataagtggttgttcctctcctgtctctttcctgctcctagttaattaggaaggtggagcatttgtgatcaaccctcatttaagagctttcaaattgtagccccgagaattttcatttgctttagttttagaagagtggccctttgactatcatatcttcagtctggtaagaagaccatcaacagctctgtctatttaatttatacaccatttatggtcatgtgtcacttaatagcaggaatacattctgagaaatgtgtcattaggcaaatttgtggttgtgagaccatcatagtgtgtacttacacaaacctagatggtatagcctactacacgcctaggctatatgctatgacctgtggctcctcggctacaaacctgttcagtagttactctactgaataccataggcaatgacaataataactgtgtatctaaacattgctaaacatagaaaaggtacagtacaaatatggtactgtgatcttatggggccaccgtcatacatgtggtactgtcattgatcaaaacaccattatggtacatggctgtacatatatatgccctgtgtcatatatttatatgtaaaatatttatttttcatataaaattatgattttaatagaaagtttagcaaatattgaaaataaaattgaagtaggggaaaattaaaatgacctggaattataccacctagaaccagccactgtaaacattttgtcttggctcagtgtggttttgtgttcgtgcagagtgttggtatgttccgaagcatgttattgtggctcatgttgtcatgtctggcttctcgctccctggccatttcggccagtctcgggacctctatggcatcctctaataggtcactcctacattttctcctagtcttgtatgctgtttggaaacaggtctgtatgtcttcctgtctgcaaatgccaccaggtggacacgtgcccaagcacctcactctcaggatgttccccacttcattcacgtccctcctaagtgcagatcatgctcctcctctgtccactcgcctgccatcgtctcactcatcctagtcaaatcagctcacctgactcccttcgcaactgaaaacaatcattgccctgttttcctcctctgggaccaccactttatatggtccccagtcaccttaattctgccctttaacattttctgctgagctgctacctcttccccccagatcttcttcctcagagcgtctcttcatgcagttcacgtttcccagaggctcaggctctagggcctgatgactcagattccaaccctgccattgctccttgctggctatgagactttggccaagttattgacggttctgtattaagtttttttttctttattttactttaagttctgggatacatgtgcagaatgtacaggtttgttacataggtatacatgtgccatggtggtttgctgcacccatcagcccgtcatctgggttttctgtattcagtattcaccaccctaaaatggagttaaccatagtacctactgtggagctcttgagatggttaaaatatgcaaaacattggaatagttcctagagcatcatggtgcacaaaaacagcatcacagcacttgctgtgagtcagatatcattatacttaattggaaacttccacgtgtaggtcctaatcctgattgaaatccaagccgtctctaatctctgagttgatctttctctcctctgaattcccagtcatcttttctctgtacctcttctagggagcttagcaaattttacctccctttagcaatttttatactactgtttattttaaaagtagacttgctacctgttattacaatctaactattttatatttatttattcatatttctgcttctcctataaacaccctgagggcagaatcattgcctaattatttgtgtgatctcccactcccttcactacatacagtggcttggatgtggtagaacttttctggttttgtggagatagaatccacctacaatacaattcggccatttaaagtgtataggacaatggcttttagtatgttcacagaattgtgcaagcatcaccacaatcaattgtagaatactttttgttttgtttgtttgttttgagatggagtttcactcttgtcacccaggctggagtgcaatggcatgatctcggctcaccgcaacctctgcctcatgggttcaagcaattctcctgcctcagcctccctagtagctgggattataggcacccgccaccatgcccagctaatttttgtatttttagtagagatggggtttcaccatgttggccaggcttgtcttgaactcctgacctcaggtgatccacctgcttcaggttcccaaagtgctgggattacaggcgtcagccaccatgcccagccagaacacttttgatacccccaaaagaaacaccataccctttagctatcaccttggactctcctcatcccacccagccccagacaaccactattccacttgctctatggatttgcctcttctggacatttcatataaatagaatcacacaatatattatctttgtgactagcttttctcacttagcatcatattttcaaacttcacccatgtcatagcgtatgtcagtacttcatttccttttatggtaaaatactatcccattgtatgaatctattagattttatttatccattcatgagtcgatggacatttgtattgtttctactttttggctaccatggatcatgctgctgtgaatattcatgtgcaagtctttacgagaacatgttttcatttctcttggctataggcctaggagtggaattgcttggtcttgtggtaactctatctttaactgtgagaggaactccaaattgttttccaaagtggctgtaccattttgcattcccaccagctgtgtatctagtttctccacatcctgcgtgtggtagattttaatagggaaagaatacaaagaatagttctttaagcttgattttctagttcagtagatgctaaaagaggactttcttctaatgctttaattaacagcagattctattagaaaaatgtccttcatcctcaagggatgtcttgtcatactgggaagacacttttagaaggaagaaggtaagaagattaatctgtattcaaataaaaatacaaagcctgaggaatttttttcctagtattttcattacatcaatagggatttcttaagaaatgcaaatatgtattgttttgccacagataaggcagtgttatttaaaggtggagacaacatacaggatcctgtataaaaagtgaaatttttgagagcaaaaagaattggagtggggccaagtaagttaaggaaaaataaaaatctattgaagtaagcaagaaaagtgggagtagaatagagctggcatatcaggtaggacatgagggcatccggtgtatctggaagctgttgggggagggtggtgggggccggaaagagagactgaggcactgccccctcctgtgttgtaacatgaccacatttctggtgatgaggtaacacgatatagggaagatggaaaaattcctaatcctgaaatagtagtgctcaacccataaagcacttaccatgaatcaaactctgtactaagcactttatttttatttatttgtttatttttgagacagggtctctctctgttgcccaggctggcatgcagtggtgcaatcatagctcactgcagcctcaaactcccgggctcaagtggtccttccatctcagtctaccaagtagctaggactgcaggcgcatgccaccatgcctggctaattttacatttttgtagagacggggttttcaccatgttgcccaggctagtcttgaactcctgggctcaagctctcctcccgtctcagcctcctagagtgctgagattacaggcatggccaaggcgcctggacctaagcactctgtatacattacttcagtttaatcctcctatcaagcctatggtttaggtacaattgtcctcactttgcagatggcgaattaaaggccacagaggttaagaaattgctgagattaccacagcgaataagtgttgatgctgagctttgtaccctggtgtccgtgagcctcccaggtccgtggtctaagccactgtgcaacatccctcctgtctctgttttcttcacctacattgtttgaatacaacaattaaaaacaattaaccatcttgtgattttagtttaaatgaaattgatttaaataattagtcaaaggcatgtgatttagtaacagtttttaaattagtagtgatgtaatgtaatataatgtgctaaggggtatattgcaagttgaggcagaatgcagggatttatagaccatgttatgaagattccagtttgtgcagaggcagggagaagcactcagttttcatctttggagtcaagtggttacatttttgctttggaaatatctctctcgttgcaatgaggggtttgtattggagggagtgggagatgaagatcaatcaggactcttacaatagtcaagatgaggaatgagatggatctgaactaagaccagggtggtagcagtggacagaaggacaggtgcaaatctaagaaagataaaggggtcaccatttggtttctgggaatggaggcaagaccggaaccatgtaagtctcccaggattctgagagtaccacagggcagttagagatacagttcatcaggatggattctaataaaatggaattttataataatgaatatcacttctcaagaaaaaatatgtgcattttttccacttttccattttgatttttctttacaatcctcactctgttttctttgagtcaaatccattttcatcttatcagatatgacattctttttgcagaagcaattccagcaggtttaatactttaaacttaatttatgaaaagtctattcatgcccttctgggtcatttaaacaggcagcatctttttgcaatttcctggacccatcgagtttgcccaagtgcttacaaatgcacattgttcaagatgacaaatgacttaactaggaaattgatagctaatttgttgaaaacctcttatgattccaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggtaaagcacctggatttcaatgtgttcccattgtcctcttgtcctcactctgcacaagagcaagaaactggtgacattgattgcttcctagacaacaggaggacagaactggcaggaagacttttcattgcatattcttttgtatcttttgaatttttaattctgtgaagtattaccaattttaaaaactaaattaaaaaaatcatataaagacaataggataaatcttttatgctcattcataacagcttctcctaatatttaatcaatgaatcatcaatgctttaagtgtaatgtttaatatactgatttctctttttcttaaattcaatatcccccgaatcttttaaacagtattttcccacaggttagaacttcaataaaaaatgtttaatttctcaaaaataaaatcaaggaaattctaaatttagaattctctagaactagaagcctgccttcccactcatgagccttctttagagaggaagggacaggcctggactgtttccagagtcttctccaagctgtatcttgaccgagtgatcttcctactctgctaatgttaccacacctggtcagatgatttcataatagagcttaaaacaaccttccatgtccactaattgcccaggccatggcagaaataacatgatttagatagaaaagacagttctgagagatgttaaaatatgttgatttcctcccacataaatgtgtgtgtgaattttggaagaaacttttacttggaatttaaattgcaacatgtttttccacattgcacttaattcagcaatctttttaccagaaagagttcaccattaggacattatttgagtatcttataatctcacatcccccacaaactcgggctttagacagcaagttaatctaaaacaaataatcaatctttaacaggtagttcagcaaacataatagcaaggtttatagtccacagctaacgttagtttttctccaaaaatgccatttttagtgatgcatctgaactcttatgcttttaggatcgtccctccttttcttcccttccctcccctcccttctcttcttctttctccctccctccctcccttcctccctcccttctttcttttcttctcttccctccctcccttccttccttctcttcattttcctattctcctattttataagatggagcaaaggtgatggtgtttgtccttatcagtgcttctcacactttagtatacaaagagtcacctggtaaaccttgctaaaatgcagattgcagattctgttcaggggggttattcgtttgctagggctgctgtaaccctagcaaacagaatgtacgacaaacagaatggcttaaacaacagacatatactgcctcacagttgtggaggccagaagtctgagatttaggtgtcagcagggttggttccttctgaaggctctgagggagaacctgttcctttcctctctcctaacttctggaagtttgctgacaacctttggcattccttgtcttgtagaagcatcatcccaatctctgccttcatcttcatatgatgttctccccgtggaggtctgcatcccagtttccacttgatataagggcagcagttacattggataaagcgcacatgctcgtgtcctcatcttaactaattacatctgcaaggactctatttccaaacaaggggttaggacttcaacatatgaatttttggctcacccaagtcaacccatagcagtaggttaggagcaggtgggacctgagattctgcatttctagcaagcaaccaggtgacgctgctgatgctggttcagttgccacacttttggaggaggaaggctgaagctaatatgcttgcaagttgtataatgagattcttccatggatgtggatggcagggatgattaatgagggctcttctactcagggagcaaaagatatttcatgtaagcaatgcagatcataatcccctttggaagcccattatgtgaatatgctaacaatgtttcaagcatttttttttctgactataaaactaatgtactcattgtaaaaaattagaaactgttagggggaacaaatgaggtgcactgtcccatgttctgtcccttgctgttgtcacttaacctaacttggagcacattccatcacttgtccactctcaatattttggtgcttttttctagattaattaagtagcaattaatttattcaataaatagttattgagtgggcactatgcaccaggcactgttctaggatacagcagtggacaaaccttacaaggccccttctctcatggggctgaaatcctggtggggccgacaggtgatcagcaagtaaggactgctatgccgggtgataagcaccatcaagaaaagggagggacatttccaagggaataaacagtggtagcaatgagtaaattcacgtgtaatattatcattcttaaactttgctgactcaatagaattacgctgctttattttgcactttttagttagtaggaaatttcttgcatgtgtttttagtcatttattactccatgaattgttgccaacatttttcaacatgtttttcttatcaagttgaaagaacttttattagctaagagcaataatcctatgcttgttacacttttcattgtgtgtgtgtgtatgtgtgggtgggtgggtgtggatgtgttttaacatatagaagttcaaacagtcttatttggtcaaatctatgagtttttcctttggaatttttgatccttattgagacttgaatctgacctacaaaagcaattattgaggctgggcgcggaggctcatgcctgtaattccagcactttgggaggccaaggagggcagatgacttgaggtcgggaatgcaagaccagcctggccaacatggtgaaaccccatccctactaaaaatacaaaaattagctgggcatggtggtgcacgcctgtaatcccagctactcaggaggctgaggcaggagaatcacttgaatctgggaggtggaggttgcagtgaaccaagatcatgccactgcactccagcctgggcaacagagcaagactctgtctcaaaaaaaaaaaaaaaaagagcaattgttgcgatagctttgatactaacttgcccctgacccctggcaaccctgaaggcctctgagcttccaacggatccagagtggagtctccagctgtcacctcctaggagctgccaatgggtcccatgccaccacggctggctctacagctaaaccatgagtttgtgctttcttgggcatgcccgggtccatctgcatcttctactttctccttctaagaactccacccatggctttcagattggaacctgaatccttacctcacattaacgttcattcctgctggatccatgattgcttctgttgctgccaacatggcttcaaggtcattttttagaataatttcctcgaatcgggagatagatgcagagaattttacatccaagtacagaaataaagcactttgggaaaagctattcactttttcatgatttaaaagtatgagagcagcagcagtttatcagatgaaatggggtataacctgggaaaaagatcaaggccttaattgcatttttgtggaactaaactattgtccttattttccttattttacttagttctcttccgaatgcaacgttttagagaaggttgaaattatcatttaaattagagtaacatattgttgttatggttgctgcttccttttaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagaggtacgcatttgcattccaaagcttctacagaaatgacagcagccataacataaggtgaagatgattgggcctacataggtaaactcatttaatgcattggaagatgagaaatccagaaatggattttccgtggctcggaaacggattttctgtggctcagaaactcccaactccatttccttgagtccctgctctcagctttatgcaggtggtatatgcactagaatgaggatttcccctttgcaaaccagctcttagatctcaaacatgtgcagttatgaaaacacaaatacttttctttgtgtcctccagcatacttttggctttgttgttgtttttcagaagcttaggctgctggttcagaataccaaagcgtggtcaacatcagtgtcatctgatgacttaagcagtgtattaggtagctgtttaaagccctgctcttttcagaaactggatattaaaatgtgctctggaggaaactagatgatatttatttctcatgttagtcccattattaatgcctgaaggatacaccatctgcaagatttaaagagctgtctcttgccctttatattagctgactttttttttaatctccttaggctcagctcccattaaagtgagtgagattgaggctcagtggccacaaggcagagaggaataatgagaagggagcgtgagctgtaaaaacaaaacaaaacaaaaaacagaccagggtttaaattggacttctgctttatagtttcatgacaacaggaagtatttttaccactctaagtctggactgcatgctctttttgtaaggaagaaataacattttgaagaagaaagataacaggtccaataccatttagtgggttggattggggagcaagtgaagaggattattccgtaataaaagtaaaactgattacatagtatgacagtgagtcacttcaacaaggatccacagtatttttattttgtttgtctgaatcaatattgtcttaaatatagatattgcttttcaaagaatgtgattagaaataacttcatatctttttcaccttttctttttaaatttttttatttttgtggggtacatagtagtgtatatatttatgaggtgcatgagatattttgatacaagcttgcaatgcataagaatcacatcgtggaaaattgggtatccatcccctcaagcatttaccctttgtgttacaaacaatccaattatattattttagttattttaaatggtgcaattattttttatttgttgttattattattattttttgagatggagtcccgctctgttgcctaggctggagtgcagtggtgcgatctcagctcactgccagctccacctcccgggttcacaccattctcctgcctcagcctcccgagtagctgggactacaggtgcccgccaccacgcccggctaattgtttgtatttttagtagagacagggtttccccgtgttagccaggatggtctcgatctcctgaccttgtgatctgcccacctcagcctcccaaagtgctcggattacaggcgtgagccaccgcgcccggccaaaaggtgcaattattgactatagtgcccctgttgtgctatcaagtactagatcttattcattctttctttttttttgttttacacacaaaccatccctaccttcccccctctccccaccgccatccctccccactaaccttcccagcctctagtaaccatccttctattctgtatctccatgagtttaattgttttaatttttagatcccacaaataagtgagaacatgcaatgtttgtctttctgtgtctggcttatttcatttagcataatgacctccagttccatccatgttgttgcaaatgactggatctcattcttttttatggcagaatagtactcccttgtgtatatgtaacacattttctttatctattcatctgctgatgggcacttaggttgcttccagatcttggctgtagtgaacagtgcagcaacaaatatgggaatgcaggtatatctctttgatatactgattttcctttcttttgcatatatgtccagcagtggggttgctggatcatatggtagctctgtttttagtcttttgaagaacttccaaactattctccagagcagttttattaatttaccttcccaccaacagcgtacataggttcccttttctccacatccttaccagcaattgttattgcctgtctttttaatataagccattttaactggggtgagatgatatctcagtgtagttttgatgtgcatttctctgatgatcagtgatgttgagcaccttttcatatgcctgtttgccatttgtatgtcttctttgaagaaatctctattcaaatcttttgcccatttttaaatcagattattaactttttttcctgtagagttgttttagttttgtatatattctgcttcttaatcccctgtcagatgggtagtttgcaaatattttttcccattttgtgggttgtttcttcactttgttgattgtttcctctgctatgcagaagctttttaacttgatgtcatcccatttgtccatttttgctttggttgcttgtgcttgctttttccccttttcaataaaaaaaagtgatggtaaaatatgcatatggaaaattaacttatatgattagaatatcaaaattatttttaccaaatatacatgttatatatatatgtgttatagatatatttacacaaatatgttcatatacacacacacacagacacacacacacccctatacctaacagatcaaaagcctggcattgcatttaatttatgataaaataatgatatctgtcattagtaaaccttccttgcacatatacacattcctgctgtctttttagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatggtaattctcgaatgtaacctcacttagaactcagtgttagctgaagagaaaagtccacgtctgtagcctctgcttcagtttaggagaaagtgcatgtggatttccactacttttcttcctccctttttattagcctcctggtttcatttatccttatgtgtgtctgttttcccccacttttgttcatcttcatccttgcctctctaccttcatgttttatttgttatttcttctccatccttgcgaccccaggacatttcctttagccacatgcccccacactcaatgccactagcagccacttttaaatatgatagctgaatgcaaagctctccggtttttgtttgtttgttttgtgatggagtctcactttgtcgcccaggctggagtgcaatggtgtgatctcagctcactgcaacctccgccttctgggttcaagtgattctcctgcctcagcctcctgagtagctggaattacaggtgagcaccaccacacccagctaaattttatatttttagtagagacggggtttcaccatgttggccaggctagtctcaaactcctgacctctaatcatccacccgcctcagccttccaaagtgctgggattacaggtgtgagccaccatgcctagccctctttcgttaattttgaagaagcttccctatctcttaggcagctccactacccttcccactacctgaatcagggcagtgcaaggcacctagtacatgctcaataaatttcttttgaattgaattgattcatctgacagccacttggatgttggagcaattgaagcaattatccaaatggtatttttatgatggttattttaagattttaaaatctaagttatttttaccccaaactgcctaattgcctcagttctctggttcagcctagtatgtaaatactcatcttaaaggaaagagaaaatctcctatttttgataagcactgggcaaagaaatgatttcactcttttgccaatactggtagagaaaggaggaaaaataaataaggtgcattttactcaatgactttagtcccatggtagcttctgtcatctcaattttaggaatgcagataatcagagacagtgttataattcaaccttgctgtttttgtttgttttttattaaaacaggctgtatttttgtaagattcattataaaaatcatgggtctcactctgttgcccaggctggagtgcagtggtacaatcttggctcactgaagtctctaacttccaagtgatcctcccatctcagtctcccaagtagctgggaccacaggcatgtgccaccatgcccagctaatttttaaactttttgtagagacagggtctcgccatgttgcccaggttagtcttgaactcctgggctcaagccatcctctcaccttggcctcccaaaatgttgggattacaagcatgacccgctgcatggttttggcatgtatataattgataccaaaacaaattttgtcaaaatttcttcttgttgcattaaggttcagtaatgattttgtgcaagctgtgtgcacttttaaaatgtaatccatcaacatcttgccttaagtgtaggcttatttcacctaggatttaataatatcttactaaccaaccatttctgattgctactctcgcatgtaaaagaatttcgccccttaaaaaagaaaatataagtactgcgattttaaagttataggtttttcccaccagatggtgctgttgccaacgctatgagatgagtcggtctataattatttcctttgttaagtcgtgtaccgggtccataatgtcagaatattatttaaggaacagtgaaatcagcagaaattttcacttctaacccaccttcaagctccaattttgactgttctgtcaggaagcagtttcttgatcttgggtatttgttttgcattgggatagaattccattaggagcaaagtaaaagtctagggagggttttagaatacagaacataggcagaaaactagtaaatacagacattttaattttattgtaaattattttaaaattcaatattatttcttgtatctgtaaaatatttacatggcccaagagtcaaaattatatataaaaatgttcaatgaagttttacttgccttctctagctccttcttcccatacagtataagtaatgatttttattaatttatttctggcctatctttaccatgtttctctttaccaaataagaatatagtccttctttcctacataaaaggtagcatactatacaccttgtctacacattgcttttttttccacttgaaaatatgttctgaaggtgagcccacattagatacagagattttcctcattcttttttgtaagtgcagggtatgctactgtatttattcaacaagtcccctattgatggacatctgggttgtttccaatctttagctgtttcaagagaaaccacagtgatggccttacgcatatgccatttcaatttgtgaaagacacattagttctggaggtcagaagcctgaaatgggtctcaccaggccacagtcaaggtgtctgcagggctgcatccctttctgaggtcctaggaagcccttgccaggcccctccaattacttggctcgtggccccttcctccatcttcggcaccagccacaatgggttgagatcttctcacatcacattattttgacctctttgcctctctctttcactttaagggccccttatattaagcctaccgattaattcaggataatctccccatttcaagggccttaatttaatcatatctattaatccctttgccatgtaaagtaacatattcacaggctatggggattaagatgtggacatctgctgggctccatctttctgcccaccacaaaatgggtatcttgagggtagattcctagaagtgggattgctggttcaaattgcatatgtaatttttgggacattgctcatattttccccaaggaattgtaaacatgaaatatttaaaatacctccctaaacgttgtagttgagtcagacttactgtgacagtataatacttgtgaaaataccctcatgcgcagttgtcaaagaggcaaaattgcttcagaataaaatagtttgaaagatttcctaccccatgcatgtgaccaaggcatgggatcaagcaggggcccaaagaggaagcgttggacataaactgtgcccagctgttcacatggtgactgcatcagcaaaccaaaggacagatccctgggtagtactgtgggacaagagctgttggaccacactgaccttttacagaagatgctgtctgtactcatttattatctaacatcatttctaaatgtaaaagagcaagatagatgtaaataagaaatcattcagttttacacatttatactatgaaaatctcccatctgtaaataccattgccagcccattcttttttttgttttttgttttatgttttttttttgagacaggttctcactctgtcacccaggctggagtgcagtgtcgcgatcttggctcactgcaacctccatctcctgggttcaagcgcttctcctgcctcagcctctcgagtagctgggattacaggctcccactactatgcccagctaatttttttgtatttttagtagagacagggtttcaccatgttggccagactggtcgaggtggctcatgcctgtaaccccagcactttgggaggccggggcgggtggatcacctgacgtcaggagcccattctgtcttcaagggccttgactctcacagtgtggtccctagaatgcagcctccacattgctccttagacatgcagagccttggggcccatccagattccctgaatcagaaagtgcatttataactagaatcccaggtgattcatatgcatatgaaagcctgagaatcacggctccaggaggcacaaaggagatccaattattgattgcttcattgtggtagcctagaaatataatgctattaaatttgattttattgttcaattgccagctctatatccagaagagcgggatagtaatgataacaactaacagcttgttgagtgcttaatatgtgcctggcacatagtagtattttaatctcttttatcttatttcaggttttactatatttttatcttatcaatgtgttttaatacacattgtcttttaaaaaattgtcataataatgcttcatgctcaattttaccactcttttgtgactgatgaaattgaggcttgggagagattggtgaattaagccaaagatcactttattagtaagtgctaaacttggaattcaagtccaagtctatgtgaccccaaagcccaaactttttctgtcactctccactgtgttaaaggagaaattgatctgaagttgggaaaacctggatatcaagtttgtatttaatgggtttggggtttatttatttatttttagagacagagtctctctgtcacccaggctagagtgcagtagcacagtcttagctaactgccacctcaagctcctgtgctcagatgatcctcccaacctcagatcccaagtagctgcgactactcatgtaagccaccacacccagccaatttttaaaatttttttgtagaaatgaagtctccatttgttgttcaagctggtcttgaactcctggcctcaggcgatcttcctgcctcagcttcccacagcactgggattacaggagcgagctaccacgacccgctggctttggtgttttaaaatttgtaattgtaattggtttttgggttttggcattacatttacattttttatttaagacgttatcattttgctatttttatcattattaaaagattaattttgggggtggaaatgatgaagtattaaatggaaagtaagtatcttctatctccctcagctcattctttagagccagtgattttaaacttatctatctttagtttttggtggtgacctctaaaatcctaaactataagtttgtagtgatttgtaacttttgacagtatcacttgactctcaactatgaaaaatgaatgacttagttcctgtaaacttctcacgtcctgagttttgtcagtaataaatgtcacttcaaatgatatatttaattttacgtgttttattttacctgttttaggtattcctttttttttttttatttaagaggcaggatctcacaggagatcttgcagtggcaagaacacaggtcactgtagcctcaatttcctgggctcaagcaatcttcctgcctcagcctccagggtggctgggactataggcatgcaccactgtacatggctaatttttaaatttcttgtagagtcgggatttcaccatgttgcccaggctggtctcaggctaacctcccaccatggcctcccacagagctgggattagagctgtgagccaccacgcccggcctgacatctcttctctacaggctgaagaagaaacttagaggccctaagtgctctctctctctctgcctcctccagatgtctaccagctgtattattatctttacacagactctgtaactctaattaggtcttccatgctttgtctataggttaagtctaaaatttagaactgtcacagggtaaaattatggaaatattcttctctgtagaaacaattagtgagaagagaacttcagagaaattcatagcactaacttgcagtgcaagttagtgttattcaaattgactctcagagaagcaatttccaagtgtcaaggtcaagtgagttttcttcattccagtaggactcaaaagcatgccttattttagtttgctacatatttagaccattattgtcttgcaaagtttctcgtttctcctgacatttttccaattagctctttttaaaataggttgagaaaagaaatatatgccttctttaccatatcatgaagagttctagcttcttcatcatactttctattgaatagaatcagctctacttgcagagattctttgtgggaggagaatctgctgactttccctttcatttttgatagctgcttgctaagcctgcagtagagatgtcattctgggataatgaggttggatatactgattcctggtttccatatctccctttttcttgaattactttgaagattttcaggtaatttttaaggaaaagtgtgtaaaaggtaaattttctgattccttgtcttcacgcttactgggtgatttgaatgggcatggaattcttggttctgaaatatttccttctgaattatgaaggcacagtttccttctctgctggcatccagtgttactgaggaacaggaaaaccctatacaatttcttgtcttcttatcacaaacttttcattatctgtaagatttttatactttctcttcattttagatgtccagaaatttcattgagactattactggaaaggagttccagtccagaccccaatagagggttcttggatcttgctcaagaaataatttagttgagtccataaagtacagtgaaagcaactttattagagaagtaaagaaacaaaagcatggctactccatagacagagcagccccaggggctgctgattgggtatttctatggttaatttttgaatatctgctaaataaggggtggattattcatgagtttttcaggaaaggggcagggaattcctggaactgagagttcctcatttttttaggccatattgtgtaatttccagatgttggcatggcatttataaactgtcatagcattggtgggagagtcttttagctaatatattttagctaatacattataattagtatataatgagcagtgaggatgaccagaggtcactctagttgtcattttggttttggtgggttttggccagcttctttaccacatcctgtttctgcagcccaggagatttcagcctcattttacccagcccctcttcaagatggagttgctctggttggaacacctctgacaaggctatatttagtagtaggccttttaaaaattcacctgcatgttcagagggctttatcaatctgacgactgagctttgattctgaaaatgtttcttctgtattttcctccatattcatgtcctctgttttcttttcctgggactccatcataatcctccatgtcttttaactattttcacctttttaaaaagatatttgaatttttgctatacattttaggaaatatttttgtttactttttcctgcccttctaataaacttgtgtcttggtaatcacacctctatttccaagaaaacgttcttgttctctaagcgctctttttttccatggttctgtattctttttaatgtttttctttcaatagatgcattactttctttttaaaaataatttggtactttatttgtttttttatttatttttatataaagacatagtcttactatgttgcccagcctggtctcgaactcctgggctcaagtgatccttctgcctcagctgcccaaagtattgggattacaggcatgaaccattgggctcagcttatcttcttaatttaagagtactaatgaagatttttttttaattctcttctgtttcctgggttactctgtttctttctagttcaatttttcagggttttgttttgttttgttttagatggagtctcactctgttgcctaggctggcacaatctcggctcactgcaaccttcttctcccaggttcaagtgattctcctgcctcagcctcccaagtagctgggattacaggtgcccaccaccatgcccagctaatttttgtatttttagtagagacagggtttcgccatgttggccaggctggtcttgaactcctgacctcaggtgatccgcccacctctgcctcccacagtgctgggattataggcatgagccactgtgcctggccaatttttcagtttttaaaactcctggtcttcttttttgtgtgtgcgtgtgctgtttgtgttttcttcaaaagtctggtgatccttggctgtccgtatgttgacgggacagttcagttggtcagtgtgggaacgggcatggatttcctcttccaccaagcgtgtctgtttcctgaacttgctgtgtgaatgcacatggggcatagtcactggacagcttcagtttaaggtgcagggacctcaatctagcatcaataccacctaagaagctttatttcccagcagaggtaagggtgagtgttgacagacccagacctcctcttcccctccccttcactgccctttctgccccaggaggaaagctcttcatgactccctctactccttcaggttaggctgtcactccccctaacttttctttatgaattattgccatcccatctgctttccacattcctaaaatctaccaaaaccccggtcagccatgatccttctttcaaccccagtacagctctggattctttcccttttgtctgtcttcaccaggatttttttgtgaactgggaaagaagaggtgggcaatattcagtgcatccaaagcctgagatttctttttgctcatgcttgatattttcttttagcattctgcaataaaaagtgaaaagcaggttacagaaataagaaaactttcaagtccaagccatcaaaagtggtgtcacctttgacagtttgcaaagaatgcccatttcatgcttaagtattttttcatccaagttgagtaactattaggctggtgcaaaagtaattgtggtttttgccattactttcaatgggaaaaaccacagttacttttgcaccagcctaataaaactagattagttctcatccacccttcttgtgagaagacacttttgcagagatgaggcaagggaatccggcatttctccctaaagcgttatccttttcttccagaagcagagtttgtctcccttgctccatagcccaagtgtgaagttgaacaaacaagttgtcattgtgtttcatgtggacagtccagtctgccagcccctgacttctatcacccacttcagtccagtttttgtccgaagaatgtatgtgtcaatgtgtgtcattggcttcagtgaccctttttaaattttggtctgagtagctatacatgttctttttctgccacagtgttggcatatgggatcattaatggctttttaggaaatgcattgttcacttcacctttgtacttcccagtagaacctgtaggctcatgaattcactacctttctgtgatttgtttagaatggtgacaatttctcaaagcaatttaacttgatgccctaattgctatgtatctggcgttgtttctcatttatgactgaaattgtcaatgcactgctttgctgttgttttggtttacagttaaacttgttttagcttgtcttaattaagtttacgtctattttaaatccatgttcctttctttacggtaaaaatatgatgctcatttgaacgtaacaaatattttccttatatttttcataaacaacaaagttcttggatgccaagcgcatgctaggtactgtgctctaggcattagatttgctaagatgattaagacaatttcagatctcaagcagctcacagtaaactgggctagattgtggttgtttaatgtgtttgtatatttgattgttgtttatttgatttgatttcgtttggttttggttttgcttatagttttacttaataggcatatctttgtaaaataaaaagttctcttgcagagaggtgtaaaccaaaaataaaattctaaggccccttaaccatctgaatggacccctcctctcagtcagggcattccaaagttaacccgaaaatctgtttcaggccatgcggggaagggagggttggacatgcctcattatgtcctcctcccttttggaattcaggaaaggctgaccagcatttaacatcaacacagaccttaagtctaataaaaaccatttacaatttattctctctgaagcctgctacctggaggcttcatctgcatgataaaactttggtctccaccgccccttatcataatccaaacatttctttctatcgataataactttttcaaccaattgccaatcagaaaattttgacatctacctataaccaggaagcccccactttgagctgtcctgcctttctgtccagaacaatgtatagcttacatgtatttgattgatgtcttgtatctccctaaaatgtataaaactagactgtgccccaaccaccttgggcacatgttctcaagatctcctgagggctgtgtcataggccattggttactcatatttgccttagaatgaatctcttcaaatattttacagagtttgactctttttgtcaacataggctttggaattcctattttccattttatgtaaactctgtctcccatatattcctcttgtgttttaaaagatgcggagaaaaatctacacagtggcccctctcttcccaagtagtcacgctgagtgctgcttggcaatgttgaacaagaatacaccaaatttcatttactcatgtgcaacgaactgatgcttaggcactagtgctgtaggaagaatcgatgtgcaactgagtcaaggtgattttgagtctcaagtttcctttcttctcttttttttggaaaaagagtcgcgttctgttgcccaggctggagttcagtggcatgaccttggctcactgcaccctctaccttttgggttcaagtgattctcatgcctcagcctcccaagtagctgggactacaggtgtgcaccgtcatacctggataattttttgtatttttagtagagatggggtttcaccatgttagccaggctgcctttcttctttcttgcatatgaacatcagaacactccattgtcctttaaatttagaacaagataatttacattatatccaattgcatagcagttaaaagctagccattaaaaaaatagaatcgtgtggctatcaggaaactaacgtttgtggagtgtatgaattttctatggctgccgttgcaaagtgccacagactgggccgcttaaacaacaggaatttattttctcacagttctggagtttttaagtccaaaaccaaggtgacaacagggttgaacagggttggctccttctgagagctgtggaggaaggatgtgttctaggcttttcttcttggcttatagatggccatcttcttcctgtgtcttcacgttatcttcccctctatgtgtccaaatttcctcttcgtataagaaccacagtgttattgaattagggcccaccctaatgacctcactttaaattcactacctccataaagatcctttttccaaatacagttacattctgaggtaccagggttagaacttcaacatgtggatttgggcagaggacacaattcagcccataacatgaaatgtctccagggtcccaggaagattctgggtactttcataaacattaatttatttgactttcacaaaattgccacactagagggacactatgatcccatttcacagatgagaaaaacagactaagaacaatgacttaccttgtacaatgtcaccagctaaaaagtagcaaaagcaggatttgaacctaaatctgtatgatccattctaccaagctgcttctatgtatttgccttctcaattcttttcttcctttgtaaatgtaatgttttgaatcaaaataaagtccaggaaagtttggctgtatccttttggctaggaagatttatttctatgaatatgtttggcctcctatttagtggccagggcttttggtcctggatgcctatgctttttctgtgcatctttcaaccttctctagcagatctcaggactcaatatttagcgttgcttgcagatccagacaaggtgttaacatctgctctatcaccgtcatctaataaatgggttgtctggtcagtggagagtttggattggtttgatctgcttcattactgggaaatcttgagtatctctcaaagggtaaaactcctttaagtgggagattgcatcataaagggcagaatcttttgtttgtttgggtttgagccaaaaaatggagaaataaggagagaacatctatgggtagagacgatacaacctaatgtgaagcttgctaagacagtgggaggagattaatgatgaagatgttcctttctcctaagagttgttgaaaccctccagttgtgaatgtaatcaggatagtaccaggctgaagacagatagagcactcttcattgccaaccagctaagtgtagtaaatgaaaccagtaaatgaaattggaaaaatgctcagccacatccacaaacagcctgtggttgacttaaacatttagaaatacatgctctttcccaagtaataaaaaatggcacttttcctagtaacatagtgcatatgatatgatattataatactatgactgtaattctggctgtacaacttagtgccagtgtgtgttgagcacattagtctcattgaacatcaattttttcatctgtcaaaccagcatgaaggcggctatgaaggtcaaatgagattgtatttgggagccttgcaaactatagaatggtatgcatgtgttagctatttttattgttattttatttttagcccaaatctaacacaacccataattatgctgaattatccagtttgattatccaatttatggattatccaggcctcctgttttccttcccctttttagttcttgcatgctttttagtcctttgaaaatgccttagaaatagtgaaataggaaatagaatatgcagttaggaatttttactttttaaattttattttggatattaacagatactagatggggagaaagttgaaaatagcccagttaacgaagagtttgttgtatataccactaaagtggcctgtcacattttaaaggagctaagcccttccaaggaaattacctgtcatctggtttcaaaacagtcctggcagactcccggtagatgctgacacttttaatttttcctgagtgctgttaaaattgcagaacttttggaaccatattcccgtatcaccttgatgggccaagtgattgaatagaacatgtgataaggatctttcctcaatgataaagcaccatggaaaatcctcagtcagcgacttgtaaagtgattgcagatcaagtctctgagttttcattgtccaagcatctgtaagacgttcccttggaataggaaggtctcttcatacttgcaaataaaatatcgtgtccatcttcccagttctccagtagatagtacattacctcttcattcactaaaaacgattgggcatattctatatttagaaagagttgctaatggtgtttctccttttctggggatagggcagtaagaatccgaatggagatgggattcatccagtagggtatgtcacggaagcaaagtaacttagccatggctaagtccctgggggataacttttattgatacttggttacttaagaattgaagttcttaggcttcaataagccttgctttcatggtttttcaaattcctaagctagctagtggaagatggctagtttgaagaaggatctatgaaataatagggtgctgtgttccaatttgatatgactcaggcaactggcggccatctactgtcagtactctctgaggaaatcgttaatttcagttatatatcaggattttaactaaaactcagcatctgatgaaccagagtgaactaatttggtatgccagcatctctctactgtgcactctccttaatgattgcctgaatttgatcaggttgatgccaacaaacctattattctgacaaatgctaatcagagataggattctgattttaatttcaaattcactgtgcactattaacttttctaacattgtacgcttttttttttgatggcctcatttgcatgatttttaaaatatgcatttctggctaagactttattatctgagtgttctttcatttaatacacgttttttgaggagttctttttttcaagggcatgaaaagattatcaattgatttgcagcagagatatgctgtggttgaattccatatgacctaactaataattatctgtcatcagggtagtaaagcataaaagttagaaccactggagtcaaattctgggttcaaattctaccttctccacaccacatagactgtatgtaatgtaaatgtagagaaattattactccatagctttattttcatctttttatggagataacaatagcatttatctggtagggttttggagaaggtttcattagaatggctcttgtaccagccagctttttctaggttatatggccataaaaatggatctaaaatatgaatagcttatacttacagaagtttatttctcattcatatttatgttcatcatggatttttaaatcctgtccacaaaagtaaattatagtttgggattctgctaaactgtagatattaccctctgctaggggagaaaagattaatatttatgtgtttgtcatatggtcctcttaagaataaaattaaagtgatgaatgcttcttttaatctttccagggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaagtaatcattttgcagatgactgggaagtgtattgccaaaagaaggtttgggtagaagggagctcgtcctcccatctggatcctccactaacctcccagtattctcttctacttgacctgtcaggtcctgggtacccctcacctgcagagcaaaaaacattgacttaattatgctgtgatatgttgtcaaagcctttcctagactctcagaaatcagatcgttttcactgaaactttactcttttctgacttttttcatctcttgttgcccaaacccagggctcttcattacaccttactttttatcagaatattgttgaatttttttctatgctgatataatatgggaactaggttaaccctgttactttctgggaacatatgatcatttttcttgaaaattctaccattcttgggccagatgcagtggctcatgcttgtaatcccagcactttgggaggctgaggtgggcggatcacatgaggccaggagtttgagacaagcctggtgaacatggcaaatccccatctctactaaaaatacaaaaattggctgggcgtggtggcttatgcctgtaatcccagttactcgggaggctgaggcacgagaatcacttgaacccaggaggcagaggttgcagtgagtagagatagtgccactgcactccaacctgagtgacagagcaagactctgtctcgaaaaaaaaaaagaaaagagaaaagaaaattctatccttcatggacatcccgacactccccattcacagatactcagtctcaagctaagagtttttcatgacagaccgtacaagagttcacttacccattcttttcagcttccttcctccttcatgattcagcatccccaagattactcacaagtcaaagcaggattcctgtccctggtaatatcagcatccccagccagtctcaccctctgttcatcccagtgtggccgtgtggctagggactgccccggagggcctgccctccattcatgaggatcaccatggtgatgtctttgtggatgcagcattctgctcacaaggagttttctctcacatatttgctggtgattctgaagttatcttcatcaagtacatgtgactattcatttctagatgagaaatggagtctcggacaagctcatatcacagagctagttaagtgacggagctgagcttagaactcaggtttcctaacccatcttggatcatgcttccgatcagtgtgtcctctgaaagtgcttcctagaatagagacaggagagggatgaaatatgttcttgaaaaaactgctcattctccattggatttttctgacttcaattgagaagggagccaggagattaggaaaggttatggcagtttcctcctaacatattctgtatactcaccccatcactctcgtgttttttcttttacagtgatgatctaaccacaacagggactgataactgcactttcaacacctgccagaaagctcttgggaaggatgattttaccaagatccccaatggggtgaatggtgttgaagatcggatgtccgtaatatgggaaaaaggcgtggtgggtttcacaggttccagccttgctttgcctagttcttcagccaggatcctgcccatttgaggaccagagtggcacaaattttcatagagaagctttttgattgtttttactagggaggatactaggaatgcaatactatcacctcgaccaccattccatccctcagtatagcatcagcaaagaaataatcttctctgcatagtttattttagtttagacgatgcatcgcactattttgcggagacattagaggatgaattaagattgcatacaaagagggttattcttcaattctctgaaatggcatagcccttctgcttgatttctcatgctcttgaattccagtgcgtcatgtgtcattggcacgaatgcttgaaatgataaaaaatacacgaaggggcagggtgcagtggctcacacctgtaatcccagcactttgggaggccaaggcaggtggatcacttgaggtcaggagttcaagaccaacctggctaacatggtgaaaccccatctctactaaaaatacaaaagttagccgggcatggtggcacgtggctgtaatcccagctactcaggaggctgaggcaggagaattgcttgaacttgtgaggcagaggttgtggtgagtcaagatggcaccattgcactctagcctggggcaacacagtgagactccatcacaaaaaaaaaaaaatacacgaagcgtattcgttatgctcatacctcctttccatgaaatctttgttgatgtcagttctttttttttttttttttttgagacggagtctcactctgttgcccggactggagtgcagtggtgcaatcttggctcactgcaacctccacctcctgggttcaagtgattctcctgcctcagcctcccaagtagctgggattacagatgtgcaccaccatgactggcaaatttttgtatttttaatagagagggggtttcaccatgttggccaggctggtttcaaactcctgacctcaggtgatccacccgccttcgcctcccgaagtgttgggattgacaggcgtgagccaccgtgcccagcctgatgtcacttcttaaagaatccttggatatcatgtttttaaaattgctatatgaagtcacaaaagtaataatttaaagtctggaaaaaaatttaaatgtccatgactacaaaacttctccctgtggacggagaagaatcacatgactaaatgtctatgtgttaacttgtccagccagttgacatgtggagctgtgaagactagcagaggggacttgcctggttagacttctggtccccagtgtcatgcccttttcacccatctcctaggatgcctacctcaaatgacacattaattatatctcacacttcagaatcctcttcaattgcttttaccctacacataccacctacttctaactctaatgaattattcaccaagtcttgtcaattttgtttccaaagggcctccttatttctttcttcgttgctaccattctagttggaggctcatattttgtttggacctttgcagtaatctcacagctggtccccatctccagagtctcacttgctacagtgtattctttactccagtacaagaactcttgttctgtactgagaacagctgacaatgcttttattattatttttacaatattatagagggaggataggttttgaatgggagttctcatttagaaataaagttctgtttgtgctattgttctctcaaaaaccctttacttgcctccattacttattggatgatagttgaatcattaacttacaattagatcttcaaaacatctctatagcctcatcttctgctgattattttcctcaccccccttcctccaccctaactctaaccatcccagatgacttctcttcacttagattttcttgataaaagttcaagcttccacttgaacttctgttttacaatgaatatctttattatagcagattttcataatctatatagttccctggtatataaatggctttacagtgactgaatagttcttaataatatatagaaaaccatgtcattttatgaaacattaatatggtttacttatgggaatattactttcagggcatggttcttagtcatttttaaggcaagcattgtttgataattaaataaacctttagtaccctcttaccatataaatagggataaacccctaacactttccaattttattttagaggagccacacccctctgaattctgtccacattaaaatctcttgcaatagactatccataattgttggttcatgtaaaacttcaattgcataaaattgaacctcttgagttgtttttttatcttttcaaaaggattgcatctgggtgtggtggcttatgcctgtaatcctaacactttggggaggctaaggcaggtggattgcctcggcctcccgaagtgttaggattacagttccagaccagcctgggcaacatggtgaaaccccatctctataaaaaattagccaggcatggtggggcataccccaccatgtagtcccagctattaggttggtgcaaaagtaattgcagtttttgccattaaaagtgatggcaaaacagattgctttcgcaccaacctaatgcttgggaggcagagtggggaggatcacctgagccaagggaggttaaagctgcagtgagccatgatcacaccactgcactccagcctgggcaacagagtgagaccatatctcgaaacaaaaaatttaaaaaaagcattgtcacctgattcaaaagtgttgtcacctatcctctataatattcttttaaaaataataaaagcattgccagctgatttaaaaatgttgtcagctgggtgcagtggctcacgcctgtaatcccaacactttgggaggccaaggagggtggatcacctgaggtcaggagttggagaccagcctggccaacatggtgaaaccccgtctctactaaatacagaaaattagccaggtgtggtggtgcatgcctgtaatcccagttacttacttgggaggctgaggcaggagaatcgcttgaacctgggagatggaggttgcagtgagccaagatcgcaccactgcactccagcctgggcaacgagagtgaaattccatctcaaaaaaaaaaaaaaaaagtgttgtcacctattctcactctataatattctatctaatgtctacatgattatctcataaatcttaggtctgtaataaataagtcagatcataaatgtggtattgtcaaactttaaaggagaatcgaaaataccattaccaaaatttagctgtcacctataacaatttttgtgattctaggatgaatgggaagaattagtgtggatgctaagtagtggggtttctgaaaagtcatcttcaggcttccatatgttaccccatcatctccatcattggcattatgactgtttaatacttaccagcatcctcagatgctctacaatataagaaattaggtgcagttctgtttgtttaagagatgcaagtcttgtcattttatcgataggatactttttagtatttgatcattagaatgattctttgaattgctttacagcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggtaagtctaagttcttgtattccttggcttcattgtggagaaaatgcactaacttgcacagaaataatgctttggcattaatcagccgcttctccttagatgacttctttagctgtgctcaggtattttgatcctgtacacaagataaaggttttgatgtgcaaatattcctttgtttttcttggcatagaggatgtagaagttgtgttgcattctctgacaatggatctgtatataaaaccaatatgaatttaccacttcagtgcctggcaaatgcccgagttcacatggaagaaaggtaaagcgtgatgaaggaaataaaaggcttagtttgaaaagggttgaattgaaaactcaaaataattacagcctttttaaagctttcagatagaaaaattccagcacaaaggatgtcactttcagttagccaaattttccagttgagttcatcttcagcctatcattcctagtagattccagctttttgtttccaatttccataattctatgttaatattgcaagtctggcaaattccaccaactcaggaaagcagtcaatagagactggagctctgttattgtctccttataggacgttagtacaggcaacacctgcagcctgatttgtgtttttcataaattttgcagtcgtagtggagaaaatcccattaaatgctttaataatctgtatgtatgtgcacttgcgtggacttctgcctcctcgtacaggcatttgttcaaagtctgttagggtttttattgtagtaagaaaaagtctacggtttcttgggctaatattgtcacaaaggcccagcttcaattgaagtgctcctgggttacctttgggaaaacgatgatcatttgaaacactaaggtaccatcactataagcctaaaaacaagccccagatattcctataggaaatccttgtttttttccacttgacactctctgggcacccactgttcccactcagggaccagttcacatggttggcaggccgtagtcatagcaagcaagcagccttcagttaaacacttcagcatatcacctcatcactggttaagatccatgcaatgccataaagggtggtatacacatcttactcacataagtatcttaagataacaacaagacatggttcaaggtctttcttatgttaataaggaactattgcccatttaaggactaaatatctggttgcatacaaaataattacatgcaaaatgaagacaagtaaaaccaaatgtaggcagcttctctacaaagctagaaaaattgtgcttggaaaggcaatggaaaaaaaattgcttggattttgcttgttctgtggctgaattgagcatgctgtgtttagagaactcctgatatttaaaatatcactctacagcgggctgctgtacacccagcaggggcctgcccagggccatcttggctgtaattcaaacaatttaggctgcttcaagggctgggaccaggcagaccttttgaaataacttgtggcttaaggagattgtgagctttaatctgaaatcctagaaattttcaaaagggagaaaactattctgtaaagaaatatttctgaaaaatggtgtttttgaagcataacatcagggagcatcatactaatgttaatcatcagtaataatctgtacgtcacagctctcgtgggtttttaaaatgttttggtgccttaaatgtaattttaccaggaaagacaaatattgattaccttatgacaatgagaaaacggtagctgtacaaccgtgtaagtgacaggtttgctatgagaaccctgacctagtgactttgacttcataaattcagatgtttcttcatgagattcagtaccaggctgtctgatagcaaagcagagcactttataattttcttgatttttcatattccatgttgtcttccaatcaggtgggccaataactaaaagcatttttggatttgatttcattctctgtcattctttatcaaaggtgagggaaaaaatgaaaatactttattgtgtggtgagactctccagtctaattcttaataatatggagaatctcaggaggccatttgatgtgcttcttcttttgaatcctacacctgagtatctccaacagggcccagcctggggagccctcgtctgccgttttaatttctagggatgacaccagctcaggggtagagcattgtcttccctagacaactggacaaagagagatgacctgaacctaaggttgtgaataattcacttgctttatttaccacatattgctgcttggaggatatttataggctgtgattatgtctctttgagtcacgttttagactatataaatttagaccactttctcacaagttttgctactgatttctataacattgtcttgcccttcctttcctattcagttgtttcagaatagcacataaagatccagatgtgtagattttttttaaaagatctatatatattacctgcttaatttccctcatttctagtctaagaataactaacttaaggtcaaactaaaaagctcctatgtttttacatttctttctattgctttctctcataagttctttcacatttcttttttgtttgtttgtttgtttgagacggagtctcgctttgtcgcccaggctggagtgcagtggtgtgatctcggctcactgcaagctccgcctcccaggttcacgccattctcctgcctcagcctccctagtagctgggactacaggcggccgccactacgcccggctaatttttttgtattttttgtagagatggggtttcaccgtgttagccaggatgatctcggtctcctgacctcgtgatccgcccgtctcggcctcccaaagtgctgggattacaggcatgagccaccgcgcccagctgttttgcatttttgtatgatttccatccttcactttatgaaggacattatttatcacattaatgatcaaatatatttatcacaataatgataatagaaaattaaatatttacatttttgtatgtgtgtcttttgggagaaagatacatattctgcattatcttactagtatgaagccttctttatctatgtctgctgattgtgtacacctcggtgccagacataaggaaaaccagcataggccccagagcctgatgtgtaagttctggtcccagatccatcgaaggccatttaaagtctctgaaaatccactctctcatatgtaaaatgtgatcattaagaattgttatgcctacctcataaagttttggttagaatcacatgagatacatgtgaaaatgctttgtcaactaagaacgtgttacacaaagacaagatatgtattattatggttattttctatttctctagtttgactagtttcattctttgcaggacattttcatttttagatgttcttagctattttgcctgtggtgatcagaaggcagatgaaccatggggttctatttctctgactctagatccttttaaaaagctggtgacctttttgtctttcttttcttgttttatcgtttttttttttttttttgaaaagtggaaaaatattctcagggtatattgaattgattgagcctcccttggatttctttgacttatttgacttactctatatcttgcttctttactcctctaatttaacattttcctctaaaccatcatcagaatgtttttgcactatcattattcatttttttcagttacagaatgtgggaaaaaggagagaagggggctgttgaagaggaggcttcatagaataatgaatctggaagaattcaaggagaaagcgtgtttgttgtggttcacgttaaaagagagagatcgttgcagaaactgtatgctgagcccttatctgggtcgatcacagcaccagctttctctattcttggcctggttgttatgagaaagttgctcatctgggctggctgttcccgaccaaaatttatgctgatgacctcaactaggacctttctgaagtgcaataatatttttagccttttctaactgtccatgaatcatccatagctttccactgtccttagacactacccctaccatcgtcactgtctgcctcttctcaccttgcagcccgagttctactgaatccagaaaacccacttacaatcctgtaccacaatctgtcttccttttctttctcattaatattcttgaggtctagttccattttttaaaataaatgttttattttagaatattttagatttacagaaaagttacaaagatagtacaagacactcctatgtaccccacagctggttgccactattattatcttacattagtatggtacacttgtcacaattaatgatccaatattgatatgctattattaactagaatccatgctttatcatatttccttagtttttgcctgttttttcccttccgggatttaatattacatttagtggtcatgtgtccttaggctcccctgacttgtgacaatttctctgactctgtttttgatgaccatgacagttttgaggaatatcgatcaggtattttgtagaatggcctctgttgtgattttcctgatgtttttctaattataagcttcgggttgtgggtttgcgggaggaagatcacaaaagtaaagaaccattttcatcaaaagacatacggtgagcacgacttaccactactggtgttgacctggatgaactggctgaggtcgtacttgccaagtttctccaccatacagctgttttccccacccctttccatgttgtattttctggaaggaagtcaccatgtacagcccatacttaaggagtgaggagttatgctctcgatttttgttttaattgatcctatttgacgtgggccagttcggttcagcatagagaagaagcacaataaatgttgaacaggtgagtgagaaggatgcagccttccacacggcatggaagatcggcaggactaagaaacagcataaaggaaaattagaaagattttattcagcactggctatggtgagaggaaaagtaagaatagcatcttcccatttcatgctttttacttactgcatgtgatcaatacatgactgtgttagaagaatgaatggataaagatgaatttaagtagaaaagattttccaaggagaggaggaagaactgtctcgctggtcttattttctttaagtgccccttcattttttaggttggagcaacgagtttgttaagcagagctcttagagagatgaaatgaagccaaaagagtcacctttgtgtgttccttcattcacaaattcactctgcacaggagcacctcggcaagccgcaggctgagggtcaagcttatacaacagccacaccctgcctttaagaagctgacagtctaggagaggagaggagatgtaaagtcaaatattctcagcctaagaagggatgggttaagaatatcacacgagaggcagaaacaagatgccttagaaattcaaagaagaaagatcattgtggagttagagcagtcatcgacatgaaatcgtacgagagaggtgagtagataacgtggccctgtgagtcaagactaaacatggaggtgagataaaccaaggcattgacagggggttctaggaggaagcagttaaggctggggattgcactacagagagaacagcttcaggctgtagaaggaaatgagaaggtgaagaggttgtggctgtctccacttttaattgtgtttatcacagacagaggcaattttaaatagagttcaccttgtagagaagtgttatttaatcaaatgaataaatgaatatatctatacggtttttttttcttcttgcaatgaaggcctcccttttaaattttacgtgcctgattttaacattaaatgcaggctggtaatgtgcaggatttttgtctcacaccattagatgttggcccaaattttcctacaaaatttccttaaacagttttagcaaaaataattgcccagccgtcttgttagtatctaacaggaaagcaacatgcattgcaccctagatgctgaagggggcgcccgcagcccgagcactgagctaggctggctccagccaggccattcgagctgctggttatgcaagaacaagccagcctctggagaacggatgcatttgctaaagatttttggcttcatggtacatagatgttttcgtttttaaaattcttgttacttattaatggcatgtagacgtaagtatgcttgccacacaatctgtagccttaaaaatggaccacgttaaagttaccaggggagaccagtggaaagaaaagcagggcagccatgcttattttttccttttaaatctgtaaaaagtgagatgattccaaggtgaggaatttgacatatggtgatggatggcgagagagaattgggagtgggcgtagtagggaaggtttggacatcctgatgaaagattacctaagacgtcactagcctgtaaaaagttcctgcaaaaatcaactgcaatagctcttctgtgtcattgcacaataaagaacaaactgcatttagtgtaaagggagcattcacctttttcggaaataaagagcctgctgtattcagcctgacagctcattgaactggtgtctattgcttatgacggaagtatgtgtcctactgcttcactacttgggtcaaagtttcaaatttaaggacgttttccatatctgaatgtctgacccatttctgtagaagatcttggtacttagagtcaggagaagaaatcaggaacatgcttttcatgtgatgtaaagacagaatcttgtggtgtcatgtggtcaagacagagatcagccaaattggccaacttgttaaaaatcttattagagagagtgacatgtcagttacttgcaagcccatagctgcagcagtaagtcatgttctggcaatttaaaaccatcctcggagcttcagttctttggtattcattaaatagcacttagttactatggtaactgtcccttttcagtatttatgagctacaggatatctcacagaatctcaagcacacaaacacacagctaacacattgtgtgtactggaacatttaatgaagacttctagctggaccgtattctgccgagcagacatattttcatttattattttttaactcaattatggcaggctttgaccttgaatacaccattcttgaaagcattgtgccatctttcttgcttaatttccttccttttctcattgaagatagagataaatgaatttaactttatattcagtgaagagtaatggcttgcggcttatgatggtgcccttctggattctagagggggccttttgtgtgaaataaagcgggggaagaatgactgtcatccttgggtagtagggattgtagggcgtggggagggagaagaaaggaggagtcaggtaccctttggcaaagagtgatggttatggcttattaggatagctacatcaccagtgactgtttcacagaagctatgaagcattttcccttgaagttgcacattgtgtatcctctgactaatttgtgcgttataatcctcctcctcttcctcaaagaaagcgtgcacacacacacacacacactcacatgcacatcagcacagcagcctgtgttcctgctcataacagttgatcggcctaaagatgctgcttttcatgcctgtttctaagagtgtctgtcactaacgcgcccgccactccccacacccacaagcatcccagtgtgcattgtgtgggtcttgtcatgggtgcataagtggaaatgaatatgatttatgccatgatttgtcactgtgatgtcttgtaacacaatatcagggctgtaccatggtgtcagggctgctggctgaggtggttcaggttgtgcttttgcaaagttacaggggcactcttcacatcatagttaccacagatatatgtggatagataggtagctagatatagatacaggtagtaactatgccagttttctagcatatgatagcaaagcaccttgaggaacaaatatctgttgctaatccacacaaaatcaaacctgccatctgggctattgggggggagcagtaccatagagtgaagagaaaggctttggtgataaattcctagtctgccacttatgagctgggtatgaccttgggtatatcatttaatttttctgaatttcaatttttttatttgcaaaatgggcatgatgatgatatttatttcctagctttgttgtgagttttaaggtagcgtcataagatgcttggaacatagttagtgttcagtagcagttggcatgtagtaggtagtcagttagtggtaatagatagtagtagtaggtggtcagtttgtgaaatgagtgggagctcttattagctatagctgtgagtcagaaatctttgtataatgacttaattcagacaggaccaaaagatactataattatatttcatataaaaactctgtctcccaggtttcttgcacacctttaattttcaccactaaatttcagaatgactaaaattaagaagcttggatggattattttggctaagatagcccgagcctccagaactgacaccttttaaaaattattagcagtgaaactgttcaaacaaacctcctaagattcattttgtggccttcagaagacatttgctttaaaaaaaaaaaaaagtctgggctatgcatgaaaaaaagctaacattgttgattacatatgcatacaattttaaccactctttattccaagttgtttatttaaacatatttttatgcaactgaacctttcaagtgaactagaaatgatttctagggactttactactaataactgcattttcccccaaattataaaagaaaagcagcttagaaatgaatcacagtaacccattctatcactgatcatttggcttggccagagtaagcagtttattttcagcattagcattgggcaaaaaataagcaccaagcgaggctgtgtgaaaggcataggctttcctaactaagcacctgctgtatttttcttcctacctgacatagattctatgtttttatatctttgacatttgcttgtattatttacaactgtatccctaggtttaagcacagctccaggtatatatagaagctcaatagtcatttgttgagtgaagaaaccagatactaatggacaaatgtgtgatttaacatttttgtctgaactttatctgcccatggaactggttcaagagccgtgttttacattcttcccccctttgaattaaaaagaagagaattctcagcacttctgtcttcttccccaaagcagtgcttgacaaagatgcattccagagacagtggctagttagtgtcaccagacctgttcgtgaatgtggtttacaccaggtcagatccttctgtgggtcaaacaacactgttttttggactcagactcatctctaattctggccagttattttaaaattatggccatcggttatggaggaaacagaggacagagtgaaaatggctgaaaagaaatttaatatcagtatctgaaaagaatcccagggtccttatattcttattgtacagcaaagaaccttgtcttcctataaaggccttagaagaaatcacctataaaagtggtcccctccctctagaagactacagtggaagtctatttggaggcagtgagtaattcaaggaagggcctgcattttaatggcctgaccaaaacaccaaaaaacttaagttgatttactattttttttttaagagcagaggttctcaaagcatggtttctggactagcaacatcaacatcatctgggaatttttcagaaatgccaactctcagaccctaccccagagctgctgcctcaaaaactcctgtagttggttccagcaatctaggttttcccaagccctccagcggcttctgatacacactcaagtttgagaaacactggtttagagtcataaaattagataacactttggaactaaaaaagtccaattagcgcccccaaatggagttctctatacctttgcttgattgctgctagtttcagggaacttactacctaaccaaacagtccttttctttctgggatgcctgtaattatgaggacattcttcttctggttgcattaaaattatctcctcttagaccttcacatgtttagcctttggaattatgcagaatatatctacattctcatatgatagtcctttcatttattcattcaaatgtttgaagaaagttactggctcccagtaagccttcccatcaccagatatgcattcccaggttcttcaccagatccttaggcccatgagtagcaaaatcccaatcacctgacctctcctgtatccacccttctcttgacacacacttgtccatgtcctgcaaacatgtgagtcccagaactagacatgttcctgcctgtaataccatcagagcaggaatatctgaggctgattagttttataattaaatgcagaactttgcaattttttaaaataacattttccttgaatacaccttgtacatccaaaacagtaattgtgagcaattgcatgaggtttgaatatcttaccacatttattcagtgagtaattaaaaaacttatattgggtcttctctgatgtttatgttaaaatgactaggattatagtaaatggctggtttctgtgttttaagtctctttgagtagacagtaacttacaacgtccataatttttttaaaaagtacaatatttaatataaacaaaaggtacaaagagtactatagctaacacttgtgtattaaccttcccaggcctgtctccttcctcatctcaacaactacccaatttggtgtttatcatttccatgcatttctttctatttactatatatatataggtgcatttctaaggcatgactatatatttacataatatatattatatataatttttgtgtattcttagcttcatatgaattgtactatatgtattgtgcaactttctcaacattataattgttagatttatctatgttgaaatgtggtttttttattttcactgctttatactattatgctttatgaatataccataattgatgatatattcttttgctggtggacattcaggttgtttgcaatttttcactatttcagacactgtatgtctttgtatatatgtgtgagagtttctctggggcattcatctatcccctggtttgttttatatgaaatgctctcacattttctcaatagaaacgtataaatttatgggcctttgcaactaaatgcagaaattcccatttctctctcttatgcttttatcttgttccacattcatttattcagccattacaaaccatatcttgggccctaccatgtgccagagacatagtaggtggtggagacaaagtgattaggcataatcccattctttaccagggtggtaagggcatggccagcagagaagtggtagcttttgctttttgccccagttgtcttttgaattgtgattctgatggtccaggtaccagctctcactgccagagtaagcccaccaatcagacagtgggttctctgaccagatctaccacaccagagccacagaaacaaagctggtgggccctgcaaccctggcaggggtgggcctggagctggaatatgaatgggggaggaagtgaagacaacaaagctccagaccccttccagtcccctgaggcgacacagccgaatattcacctatttggtgacttgagtctgcacgtatttcatcattctaaccgcacacacaatgcttgaaatatataatattggcacccacccaagacacacgcacatagacatataactgtttcctattaatcagtacctctctttatagccacattttcacaaacattcgcattggcccttgattttctgagctcatcacatagaagctaagatctgtgaatctgaggttagtgctttctttctgtgctccagggcaacagattgcgcattctgtccttggttacaagtgtgcacttggcaggagcgtggcctgcatccctgcaaatctgccaacgctcctggacatcggtttcaagcatatcctgctggcagtggggcttctttgaacaccagcagtcagttgacttctaagtttaaaagatttcatgtacctgcagaacacttccttggtgccctccccaaaaagtggcctgtgcaacccagagagcacatgggaaggagagtcagagtacattaggtttatttcacaactgcagctgcagtcacattaaacttattgcctaatttcctttgtctaacttgatttctctttggctgggaggcaaatagattgatatttttttttatgctgaggttatgttgcctgaagaaaattttccattggttcactatgcctgcctttagtccagtaaatggggccgcgtgctgtctgggcaaggaagggcctccccagatgtgctcttgaggccagctgtctgcgtggaggaggcacctcctggaaggggtaacaggggctgcccctcccatgaggggtattgctgagcatttgtgctgggctctcagctcatttctctggctgtcttctaataaatagctttgttttattttttcctttcctgtgaagtccttttctccctatgttttctctatcattttgtatatttgcaatgctctttccctctccaaaatttcttaaaggtggtttcttcacgtttttgttatattttcttcccgtgagccctccactatcatcctgtgctatgattgtgcccttttcttctcaccagagaagggaaatgttcttactttgctctcagttctgtcctcctaccaggcatttatttaagagagctaagtttctggaggcagaataatgagaaggcaatttacccacaagaaaaacaaatggagcctttatctgtgtagaaggattgctgaattcctcacatggtggaggcgagggggatgaggacaatgttaatcagttatctgaaaacatatattgattgcatgttcattgtgtgtaagaaatgtgtgagaaattactgagtactgagggagacataaatataaggtgtaatacctgtcatcagagaggttgcattttggtaagacaaagatataaacatagtgaaggataactaagttttggaagagaaaaatatcagctcaacacatcagtaccagagatgaaggaggtctcacgtgctggtctccttgacaaaggagtagtccaaataattgtcctaagttgaggtcatctgtgaagacttcacagatgactggtttgggcttgggaaggggctttgcactaactgaatccttggaggtggctctggacaggtggatggggacagtaaagccatccagatggtggagtcaggggcaaatgaggaaaatgggaaagatacagtcgtgggataataaaaactggagaatgagagaggggtcaggatgggaaggagttgaagatgagatttgtccttgtcagactgccaagggctttgaatgttaggtgaagtatagcagattttatgtgaggcagcatgagctattgaatgtctttgagtgagggtttgagttgatccaaatctgtgcttcccaatttgcctggcaccagtagaaaatggtgttatttgtagagtacatggctgtaaagagaaggggctttggagatggggaggaggatgtagcaaaaccaactcaccctggtttgcctgggactttcccagttttagcactgaaactcccatgtccttggaagcgctctcagtttaagcctaagctgtgaatgtcactctaggaggttgcttttggtcaaaggtgttggcctaggatctctacacctacctggtcaccctagagtctgagggttttagtcttgtgtctaggcctgtcggctggggaaatctgactaaatcgtattttagggtgatgagtgtgtaggatggattggactcacagagaatggtcaggaggctattgtaggagtctggccggaggggataagtcaagatgaaagcaaacaaaatgaaggcctggaaaatgggggaaaaaaggagttaatttaggttggtgaaaaattggaaatggactgaaagagaggagtcagaagtgacttcaaaataactgcagccttgctcatgtatgaaccaagcatttatcgagtgccagctggatgcaatacattgtactcaaagttgagtgaaaaaattattaccctaagggaacttaggatctaattagacagataaggaacaccccaagtaacgcaaataactataatacaaggtaaaagattaggcccaatggttaagggacatggcatttagagccaaattaggcaactgtatttaaatcttaactgtgccagtactggctgcaggaccttgggcaagttactcccctcttcgaggctctttcctccccagtaaaatgtagatatgataataattgtagcaacttttggggcttgttgagaagagttaatgcctttaatatggtgcctggcatatagtagaactttaaaaaccattaatatcatgatcatgtatcaagtgataaagcactagagagttatacagtagtagggagataccaaagtaaatgacttttataatgtgggattctaggaaaaaaagcttagaaaaattcaactatcccaaatttcagtttgttttgtcaatcacagtttcatccttgtttatacatttcctgtcctgcatatttagtttgtatttttttaagattttttaaattttatttaattaattaatttatttctctgtcacccaggctggagtacagtggcacgatcttggctcactgcaatctctgcctccctagttcaagcaattgtcctgcctcagcctcctgagtagctggaattacaggcgtgcaccaccacgcccagctaatttttgtactcttagtagagacggggtttcactatgttggccaggctggtcttgaactcctgacctcaagtgatccgcccacctcggcctcccaaagtgctgggattataggcatgagccactgtgcccggccctgcacatttagtttgtgactggcatgttggtgaggcacagtggtaaccacaattttagtagaatgccccttagacatttaattgtacagtgccattaaacatgtgtggccgggcacagttggctcacacctgtaatcccagcactttgggatcacgaggtcaggagttcaaaactagcctggccaacatggtgaaacctcgtctctactaaaaatacaaaaattagctgagagtggtggccggcgcctgtaatccgagctacctgggaggctgaggcaggagaatcatttaaacctgggaggcagaggttgcagtgagccaagatcatgccattgtattccagcctgggcaacaagagtgaaactctatctcaaaaaaaaaaaacaaacaaaaaaacatgtttggaggatccaaatgtattttagaatcctttgattttaaaggcactctgtctgacagcatggactagtggcctcaaggaatgactctgtatataatttttttaatgttaggtccttaatttagatttcatagtaatgggtaatttaaagctttaaaattttttgctatttgaaaacttaaaaccaaatttcttgtttttccgttgaatggattactaaaagaaaattactgtttcaaagggtacaatcttttgatacagcacaatctcttgctcttccttttatttttgctacttttgcaggtaaaaattgttacctttcagctatgaataacatacatttgagcaataaggaaattgaacactttttcatgtttattagtcattgaggtttttttcttatggagaaatatctattcatgccctttgttcatgtttcttttggtaacataatattatttgtgtctttatttaaatggtctgtcacatttcttgcaaaatccctaaggcttttttgagaaataaatgctacagttacatgaaagtgttttgtataaactgtaaggtactacaagcatgttactattattgaaacattgactttgttcactaaggtatgtcagaatcatatttataacaaagagattcttccaaatgcagaaatagcatggctagggtgtgagctcagatttttatctttgttcactgctgtatccccagcacctagaaccgtgcctggcacggagtaggtgatcaataaatgcatgtaaaatgaatgagtgtatgataaacccattgaatggtagggattttctacattcttccaccaagatgacttttttttttcttcctgtcttaagccagaagtgaaaagggttgtgtatagttcgtgggctagagctatggaattgtggtcttaagattctggacataggaaacccatttattagaacctaactttctttatggtaatattttaagcctagttagtatattattctccctcatttaagagagaaaccagagacaagaagagtttaatgatccaagaatgattttcaacaatgataaaagactaagttgtagttttgtttttaatatagcagtgtttccaattcctaaaatatggcaaacgttgttttcttctcctctcatgcctcatttgttgtttttctgttacctatgagaataaattgtatgcatggcctaaaagaaaacatgacaacttgccttcaatggattcattttttggttgcctatttttgggtaaaggttttgtatagaagtttctgctaatgagtataatctcctatgtagacctaaattccactactcacaggtacatggtaccgtccttttttctaatgttttcctgttctgtttttatccctaatcatcctacctcctgttatgttttccttttaaagtactttagtatttctggaagaagaggggttaaaattttatataaatgtgcatttagctctagacttgtgttctggatggatcacttatagtgagagacactatacagtggttaagcacttactatttgagtcatatacactgtgaggtgagttacctggcttctctgagcctctattgctccatttataagtatgaaaaaactctgcttccatagggttaaataaaataatgaggattgaataaaataatgtatgaaaaacttctcacatagggtttagtagcatgcagtaaatggaagctccaatggaatacttttccttattagcatcgtattcataatagatggccttggccatggcttccaaccactgaagtgctattagtaaatgtaagaaaaatgaagtgaaaatgtcaagggtgaatgcttttggaagcaaaacgatcaggaaactattccagaagtaacccagccaggatatattagtcagggttcaatcagaaaagtagatccacttggatgtctgtgtgtgtgtatgtgtgtgtgtgtgtttatacatatgcatatgtgtgcatatatacgtgcatagatatacacatacacatccatatgtatgacttgaccttccacactcatagggactggactctctgcaaggctactgccttcatgtctgatgctggagtctgcaggccagagggcaagtggtcaggaagggaagatggaggtgaagtgggaagagcaaggaccaggtcgaaccccaaccatgagctggagccccacagggaaagatgaagacctgagcccgttcttgtttgcctttgccctgggtatgtggtgtgggtggctgcttttggtcatgaggccaaactcacacacctggcccaggagttggagcaggtgaaggaggatccgggggaaggtggagcattgcaaacctgaccacattctcacactacgagatgagtcagcaggtatcatgtgtgcaaaatggctgctgcgtcacttccaccctccaccagagctctaggtatagatgccatcatcagtgcaggtaaccattttaaggagaaaacaacagaggttcagagaggttaaatcatttgtcccggttcacacatctggaaaggacagagttgggattcagagcaggcctggttgactgcagtatctagacttttaaccactgcagagcttacagcctcttagaagggcaggcaaggaggggccatttacagcacaggggttcatacttggtctctggagcctgactgcccaggtttgtaatctgtccctccacttactgacggtgtaacccagggggagttacttcactttggtttgcttcaattcccttgtctgtcaaaggggaatgattataatacctatatcaaaggctgagagttgatatatgtgaattctttgcaacagtgcccagagttttaagcaccccatgaacttggctgagcaagtcagcagatcccggagcatctggctgtggcgggcagctcatcatgccctcctgggcgctgctcccctccaccccctccagcatggatgtcctcaggcgtgctccctggtgaagctgagtcagtttcgaggtctgcagttctgcagcttttcagcatcaccgccttggactcagccttgtgcctgctccaggcagacagaggtgatgttacagtgactacattagcgccagctgattgtgcttcctagaagcagacaccttttagattggccaaagctcaaaccatacaacttagttgctaattgggaccctgaggctgagcttctagctctgacagagcctccaagatgctttatttcaggagtgtcaatgaaatgttagcatgcaccaccactggaagagatgattagctgtcaccaagttctcacccagatggaaagtagataattactattaaaattccagtgtaggtaattgtttgaatgagtgaagagtatagtgctttcatcctttgagcagggggtgaacactgatggctggagtactggggcaggagaatagagtggggtcagcgtcaacctgctaagtttgatttctggccctgctgactcaggacaagttactcaagctctctaagtctctgttttctcatctgttaaatggaaatacaaaggtggattgttgagagattcaatgaggcaatgtacctgaaagtactcggaatacagagatgcttcatggatagtggccacacccgacactgtggggacagtcattcgtgtccctctgccactgcaacttttagtggtcacttttttttccccatcccttttgttctcgctccttttaggtccttgcctgtcgtttttttttcttatttgtggctctctcacaccaagttttaggtcttccaattactcttcagagccttgtgttgttattgttgctttttgtttgtttgtttgtttgtttttgccactagagatattcagagcaggggaagagcaaactttttgtaaagagccacatagtactttctttttggctttgtgggccatatggactctgttgctagtactcaactctgctgttgtagtgcaaaagcagcaacaaataatatgtaaatgaatgtgactgtgtttcaataaaactttatttacaatgcaggctatgggccagatttggcctgcgggccatggtttgccaacctctggtttagaaatttgaggtcagactcctgtcattgaatatccaaggtcatctcttcagatggacatcctgatctccagttcacaccaaggagcctttgatgcctggaaggctttttgccttatttttccacggcacagtcttcagacagtgaagcatgaagttactttgttattcacaactgttactttgtttactcatttaagtttagaagattctaaacaaattccacttaaacacttagatcataagtggcttcatcaattcaaaaccaactgatggttttgagcagtgagcattaggtaaaacttcctagccttggcagaaatatataagcttagtactagtacagtgagcattgcatggttactgactgattgtctcaggtcacttccaaaacagcttacagaccctgcgttgaggttcaaatgagctgggaaccctttttactacatagatctgagttcaagatctagtttttccatgtgccaactgtgtcttaggcaatctcattcagccttagtgttctcatccataaaatagggataataataataataatagtattgatatcataggttcattgtgaggattaaagataaggctttaatgcctagctcagagcaaagaggccataaatatttgttatgcctattataagaacatgtttgtggtggctttggagtttctgagtgccccttcagctgtgacttgggaacagaatcaaaggcacttatgtttctgtttgccttgttaccttctcaggaaagctggaggccaggtcttgattcttaggattgcagaacttgaagttctctctgacttttaaaggagtgcttcagcccatttttgtggatttcacacaattctttagcattctggatttcatggttgtctggcttgactgtagactttccttctctcttttactaacatacctcactccctggttgtcagaaagttattttccagtgtcaaactacatttcctctgtcagcatttatgcttactcactcttttcatttccctcagtagggatggagggaaaataggtcatcttcttcctttcaaaaaaaagagttaagtttagaagtcccccagacatttctgttatccagcttctcttttccaacccttaaattgagagccctccttcctgtcttcccttcacagtctagccattctgttactggcggcagagatccttgctcccagagctcccaagatggtggcaggctgcttccaagatggtggcaggctgcttccaagatggtggcaagcctcgtgttctctgacctggggttcttggcctcacggattccaaggaatggaatcttgggccatgcagtgagtgttttagctctattagaagccatgggtcatggaagggaaccatggaacccagtgactagtgttcagcttgattagggtgaacccgggcactcagctgtgcaggaatacccgatcaggagcagcaatgggagccttgctggatcaggagtacagtggacaccctgccagatctggagagatggaagtcagcagtaggtctgtgagggtggcaaacagcagtggtggacggcaacaaacacggaccagaagagagtgcagttgcaagatttaatagagtgaaaacagagctcccatacaaagagaggggaaccaaagagggtagccattgccggcttgaatgcttgggtttatatcccgatcattgtccctcacgctgtgctctcaggcgatagatgattggctatttctttacctcctttatgcctaattagcattttagtgagctctctttactacctgattggtcgggtgtgagctaagttgtaagccccatgtttaaaggtggatgtgatcaccttcccagctaggcttagggattcttagttggcctaggaaatccagctagtcctgtctcttaattcctttttcttcctaaaatatggagctagaactgaacataccaataagtccctggcctattgtgtactttcgggaaggatgttgtgtgagttttacccagtgtatttctatataggaaactgacatcttttcctgctcaagttgtcctcatagtctgtcaagcaatgtcagcttgccaaagacaacacagcttcctgggaaggatgacaataaaattataagaccaagtccacacatcaccccagaaagttatttctaactctcaccagtattcaggctaatagcctagctttccaaaagctaataatcgtaccttacctataagtacttatctgtttaatattcataagacatacatcctagtatcatgctagcttggctgattcacattcagttcctgttccttaaagacactaaattatttttagtttcccactttctaaaaactaccgtatagaacaaggaatatttatgctaagtggaaatccagaaatttgctaataacttatttgcagataaacaaatacatatataaaatacctctgtttgctcagtactgtgtgaggcataggaggtgaaggacatggtacctacatacaaggtcagcttgctcatgtctaaatccaatttatctcaccatgacctacatcaccatccatgacctatattacatacctccaaggacaaaatagcagagtgaactttattcctttaagtcaatgcttggggagcatttttataaacctgcattaagtattttgtcatctactgagcaccggtagagttccaagttattgtccaatttagatttaataacgtggctgaagcaattcccattttctcttctgcaggaggcgggtgtagaagtctcaatagagggtggaagattgatgggtgcagtgagtggcaactttgcttaataatgacaatgtacttgaagcagcaccatttagcatttccagagatgtggctgctttgctccccatttatataacttgtcacatctaagaaactgacagaagaggtagtttgaaatagacagaacacacacttagaaaaagtcttctatggtgattacatcaagaatgactggtcaattttggcttaaggaattcttaatagcatcctaaatcctttactgctaaacagaaaacagaccaagaaacatcatggagtatgaaacaagctgcttcctatttattttctggtggattaagaatgttttcatcaaccgcgtgctttccaggtagcttcccataaagctttcgaggggcagtattgtctagtggttaagagcacaacctctgaagcgaaaggcccaggcttatctcatatgtcatatttatatctcagctacatgaacttactagctgtgtaaactggggtgagtgttattaatctttctgtgcctcatcatccttatctagcccatgggaataataataataataataataataataataataataatacctacctcataggaagatgtcatgattattattgtttcacactgaatacataaggcatcacacaacacaatgtagagagatgaggtatatttttaaagatgccactaataatcctgacatgattctattaactttttttgtttctcatggcaacctggtaagaatctatctgttccaaggccaaagtgcctgagtgggagagaatataacagaatacctaaaacaagtcatttatctggggttggggagacccacattactctaggaaattctcttcctctccacaatgctccttctgaatgcatatgggtggtgttgctatctcctgcaggctctgcttcagtgattttctcatctgtaagagcacgcggctctttgacagaaagctatttgcaaagggacagaatgtttttctgcagctgtgatgtgagtggtatcaaagttattggctaagttggaaaatagcttaatgttttcagggcttctgcttccatatctgcttctgccttggagatgtgtataattgggactcagtaagacaaccttgacacccctctgcagcaagatgtgcctctttcatacaggcttaaagtgagcttgacaaagagtagcttttgccttggggcagagtgaccatggagaacatcatttctgtgaatctgctaatgagtcagcggccaggaactcagcctcactccctagatggtcaggcttccatcattctgtatccttcctgttgctgccagagcaggccaaaatcctagctgtccaatcagtcattagagagaatgtatttctcacaattgccactctcttgagctgctttgcgtttggtaaatttgaaaactatttagtaatgaatcttgaagctctttgcttttgcctacaaatgtagtgataacatctccccacatctgcatctgttctgcaggaagatttagttgaaaagatcttcttggttctttttgagtctcaggccttttgaactctgcctcagaaacatccatgggctcttcattaagggaattattctccagaggacaaggtgtctatcagtcagggactttggttgcaaaccctggtaactaacctgtgctcacttcagtaaaaacacactctgtgggaaggccatggggagctcacagatggaaggcacagtccctgctccagcttggaatgttggagcccagggtgaccccaggcagcttgcagcaggaattggtctgagctcagggatgtaccctccaaccacttttaattatttttgtcaccatgcaaaatattctaaattcctgggaaagagaatgcaattgcccatctcttggttagggaaaagcagacaaccatgcctaagggtcttgtcagattatctccaaagcaggaaagtagtttctttctttttttttttttttttttttttttttgagacggagtcttgctgtctcccaggctggagtgcagtggtgcgatctcggctcactgcaagctccgcctcccaggttcacgccattctcctgcctcagcctcccaagtacctgggactacaggtgcccgccaccacacctggctaattttttgtatttttagtagagacggggtttcaccatgttagccaggatggtctcaatctcctgatctcgtgatccacccacctcggcctcccaaagtgctgggattacaggcgtgagcaaccgcacgcagctgcaggaaagtagtttcttaaagaaaaactggggtgctgacaccagaagatgggagaatggatgtcaaggggccaaaccacagttcttgttctcctgcatgtctcaggatgggatagtgtgtggggcccacttaaaagcttaaatatgctgcaaaagatacatgatgcctgctccaaatatctcagtgtcacagcaccctatgacaatagcgtattagtccattggctgaatatcttagagcctggatgtgggttttcttggtttttttttgttgttgttttttttttttttttttttgagatggagtctcactctgttgcccaggctggagttcagtggtaccatcttggctcactgcaacctccaccccccaggttcaactgattctcctgcttcagcctcctgagtagctgggattacagctatgtaccaccatgccctgctaacttttgtatttttagtagagacagggtttcaccatgttggccaggctggtctcgaactcctgacctcaagtgatctgcccgcctcagcttcccaaagtgctgggattacaggcgtgagccaccatgcctggcctgttttcttgctttcttccaagattatctcccagccttcaaagcatggcctgctcatcagatgacatgaggcccatcagctctgcaggggaggttatgtgagtctgactttggccttcacacctgcacctcagctgcttcaggagaagccactttgggcaagttacaagaacctgggggatgtttcattacagtgaaataaaggcatagggtgagttttgaaaggatgggtctgttcccatgtgctatatgacaatggccctagatgggtgttaagatactgtgctaaacactcacctctctccagggcctctcttagggacaatgcctggagggcagttgggttcagccttcacattcaagaaaggcctcaaatttgtgtttttcaaattatcacaaaagcagatttttctaaaagttccatagatacattgcaagaattgaaagaaaaagctgtgtcaggcagggttcttagctgcaatcaagagaaattcactctaaatagttaaacaaaaagggaatgtatcaaaggatactgggtggctcatagactctccaggagggctagaggagcaagctgagaggctgagcagccaggactgatgccccaggcatcccacagggcatcggagagctctgctcctgctcctaggcacagatactgcagatcacctcactgcagtggagctcagatcctgctgctagaatctctgtcacagctggccctaaacccaggattgacccatctctaccctccacatggattcctgtggtagctgcttcctgtgtcaccaacttgccaggcaaagtctggtactagggcatcattttgaaggagcccaggtcacatgcctgggccctagctgcaaagaagtctgggaagacatgtttttggcttctgccatggggagaattccccagaggaagtgtgttcaaaggaatgacagatgtccttacaaagatgtgtgactctgaacttgcgtttgttccaataatggaccacatctcccaaagtgcacaacaaatgcatagattttaaacactgtttggtagtgatctgataaatcacgtgatgatattgcattgtatttttatgtttaaaactgtctataattaaatattgaaaatgtaccacaatttttaaaactttctgatggcagggttacaaatataacagtattctcaaaagttggaagtggtttctgcctctcacaagttcattcaatattaaactatgtgaaccttgggcaagttgtgaaacggcactatttcagcattatcatcttggaaatggagtaataatactgagctgtgtgcttattacagttggtaatattaaaattgccaagtatttataggtattagtgaacaagtatttcatataagctaagatgccactaagaatgatagttataacaattttacttatttattcattactaatcaacctgtacagcatgctagaaatgttgggtacccaacagaaatgggctggatgtttacctctcatttacttcagtgttctgttcccaaaacacagtcatgtcccagaagacagtggaggcaggaatttaaaccaacctgactaaacaggaggacaatcatgcaatcttttaatttgatcatcacataaatgtttataaagcacctagcatgtgctgaagctaaaccaacctagtctctgtcttaaagtgtgtaccaagtaggaaaagagagccttgtcaagagatcaatgtgataccttcagataatgctaaacgatggaggaaaatgttcagtttcaccccatgtcgtcagggtcagcttctagggaccagggttcttgggtggagttttagggcagggagaagggcagaagtgaggagggcctttagggaaaagacaacttcatgtgcaaggattcagaagtgtgaaagctcctaagattggagaattacagcttcagctggaaggaaaaagttgggtgacaaatgacaccctgtcagacaccttccaatgtgaaagtggaagcacattccttttgctgctggtgatagtgcctcaaatttacattttgtgttaatatgacttcatttacataatgacttaatataaagaatctcttagatgttgtctaattgtcctctttctcttgctaaccccaagtctgagaaagtcaacataatgaccttttttttttttttttggtatgaggcaaagaaatctgatttgatattttgctgtgtcaacctcattttaagatcacaacttacatcaaggaaacagtataacaagaacactgaagatacctggaatctgccatcttccttttcttagccacaaaaaaagctactttgtatattccctcttgtatttgcccacatgcatatatatttttctggtagacataatgtacatactctctatcaccggtttttccattgatattacataattgtcagggtttttgcttcccagagtatttttaattctagtctttcataaatgcctaatattctataggatagactttggaaaatagttatgcttcagtttttaaatagtttaggcaacattgtaatgacaatatttgtgtataaagattatttcttctgttagatgttttccctaagagcttcagtaactcttaagaatttcttttttcctcccattcatgtacttcaaataaccatttcagcacaaatttttaattcattttactttcttcatatagcaaccttactaatgcatcagtccaaaaatcttctttatatagtatgctgtaatacaatcccaagagtccctcccatcaatataactgtgatgtgtaggaatgcagcagcccaggctatggaaatatttggcagattataatggccataaaaagtcttttcaccctgaaggtttgaagcccctctctattgtttcctagctttattttctttgagtttgtatctttcatcaccataattcatcataactcattctatacttagtattcctttaaataattttcttgtttcagtgatgttatttaccacttgattaatacccctccatccttcttaatgtttgaaattattgtgtatttgtacccgcctcctgcttcttggtgattctttgacatttctttatatcaataagttggttcctaaggtcactgaaagctctttttttttttgctgcagcatacacttaaaatatgacccagcaatttcactcctgggtatttacattagagaaatattcatgcaaaacaggtacctgaatgtttataacagttctattcatattcatcaaaaaactatttagaaacaacccaaatggccttcagtgggtgaatgtatagcactgcggtatgtccatacagtggaatactatgcagcaacaaaaaaggagctattgatacacaaaacaaattggatgaatctcaaaggattgatgtggaattagataagtcagtcatactctatgattctacttatatgacagtcttgaaaagagaaaactatagtgatgaagaatagatcagtggttgccaggtgttagggattgggggagggcgtgactacagagggatagtatgagtctagggtagtggtatcactgttctgtgtcttaattgttgtgatggtaacacaaatctatgtatgtgtaaacattcatagaaatgtgcaccagaaggtcatttttattgtaaatttaaaaaatataaaaagatccaagtttccaaccaggtgcagtgactcatgctcgtaatcccaacactttggaaagccaaggtgggtggattgcttgagccttggagtttgagaccatcctgggtgacatggctaaaccctgtctctaccaaaaacaatataaaaattagctgggtgtggtggcacgtgcctgtagtgccagctacttgggaggctgaggtgggaggatcgcttgaactgaggaggtagagattgcagtgagctatggtcacaccactgtacttccagcctaggcaacaagagcaaaaccctgtctcaaaaactaaaaattaaaattaaaaaaaatcttagtttcatcaaagtggtcatatgtcctttggcaagtgatataacctttctaaatctcaatttatttttcctataaaatgtggaaaatactctctaccttggagaggcattctaaagatgaaataagatgttataaacgatctccctgacatactagatgctcctctttctcttttccatggcagctatttctcactgagagcagattattttttattattatcatcaccatgcttttttacagctatttggctcttaggtaacagcctggagccactgagggtttcaagcaggaaagtgacatgatctgatcttcatttttaaaagacaatttgagcagctttgtggagagtggtaaggaatgcaggagggtaagaattgaaacaaagaagccagtaagaagtgttggggttgtccaggtgagagatgacggtatagactccagtgggagccatggagtggggagaggagaagcggggggtttattttgggagaaggtagaacaaagaagcttgatgctggttgaggggtgaggaaagatagatggtgatgtcatttactgagatgagaactcaagggaggagcaaacttgagtgggtgggttgtggtcagcattacaagtcaagaattctgtctgagcatgttgggattggaaaccaagtaagcagttagaccaaggaacaggccagtgttatcttgttcattactaggactgcagcacacagcagcgggggcttcctcatcagcccttccaaataaggctaggggaactttgagctgctcctccttagactcactcagccttgacgatttttaaaaaatttatctctttaatccattcctgagagggattgtagaaccttctaccagaatttagagtatgctattattctaagtgaagtaactcaggaatggaaaaccaaacattgtatgttctcactcataagtgggagcaaagctatgaggatgcaaaggcataagaatagcaccatggactttggggactcagcgggaaagggtgggaaggggtgagggataaaagactatacattgggttcagcgtacactgtttgggtgatgggtgcaccaaaatctcacaaatcaccactaaagaacttactcacgtaaccaaataccacctgttccccaaaagcctatggaaataaaacattttaaagaaaaaaaggactcagattatgctcatattagtcactgctgccagatttttttcttttccatttaatgagatttaaggaaaggaggcatgtagcattttcaaatacccagcctgaaagtcatcaatcgtattatgtaggattgaaaagtattaataaactactgagaatgatgacaaatgtatgacacagaatatgctaagagattatattccaacgtattttattatttctgttatcttcaaatttctagttttgctacagacaatgaaagaaattccatacatacttttccttgataactaccaagtccaatttgataactaccaaatagctatttcctttgggaaggcaggaacgggcatgggatttgggaaggggtattgaagaagcccccattgtatctataaaaagttaaaatttcatagagctggatatagggtcagtgtgttcatcagtcatctgcgtttaaaaatattttataatttaaaaatgaaaaaatgtgttgttaacatataaataaaaataattttaaaatctgaacataaaagacaatgccctccttccactcactccaccctcattaatcaccttaaagagtgatctcttgggtttttctctcagaaaaatgtaattactttgtaatgaaatgttaatgttatgttctattcttaaagttacttgttacagtgatgaagctatgacttaatagagttgctaagttttcttctaagtcattcttcttttaatattttatatttatcaagtgagctggtgatgatccagaacttttttgttgttttcacaaatataggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccgggtgagtgtgccacagtgggatactgccacaagtcggactgtctcctgcttctggatgtctggctggttattgttggtagtagtggtgttgacacatcacacttggtttaatgtattcctggggtgtcaggattgatatgagagattagagatgccagtttttagataaaggatcattattggatgcacgcatttccccttgcagactgataggtcagttcgggatttccagattgtggggtaatctggtgggggcttttggcaattgtgttagtcagggtcctccaagaggcagacaccaagatggataaaggtgtatgagttttattaggggaaacacctgtgaaagaaactaggaggtggctggaaaagattgggagagccctcagattgcaagttaagtctgaaaccagtaaagaaaagaaagagataaaatgggtaggagcatcctggaacaccctacagtctaggggaggctgaaaaaggccgtcagggagtccttgagccaagtctcagatctcccagctacaggccaggcccagtcattggctgagagccactgtgggaggtgtgacctctgtgtaaaagtgtaatgaagttcagaggtcagcagcagccccttgaaaaaatgtgctcccattagttgaagatctgcaaggtcagtttttatgaccaccagagcaatggtggagttttgggctggagaagacctaaattctctcttgccctcgccaccatttcctagctgtgttgccttgagcaagtttctcgatcctccttgggctcaattccctcatctggaaaatgacaacaatgtttccttcctaacaaattgtgacactcaaatgggtttttttttaaatgaaaggcatggcccaaagcagtagctcaccacacctgtaatcccagccctttgagaggcagaggtgggagaatcacttgaggccaggagtttgagaacagcctggacaacagagtgagaccccatctctacaaaaaatttaaaaataaaaaataattagccagccataccagtgcactccagcctgggcaacaggttggtaggaggtcaataaatgtcacttttgtctctttgctttccccttttgatgaccaaatctctatcaaagacccctgttattataaaagagatattggggctttcacacaagttttgtttagttcacacagagtttgaaatagttttaaaattttactacaccaaatacactaaaatatttgagaattttagatttaaaaaatctaaatttctggatatgggggccggggaggcaaccctgtgtcctcaatcccacatgggtccaatgggccagagctagatggcaggcccctagctaggaggtatttctggttttcacccagaaggcttcacacattacttgcctggccatgtagatggtagtgtttgccacccttggactagttctaaggcttctccctcttctttccatttttcaaatgtacctctccttttccagagctctctggctgtttttttgattcaattcatttggatcttgtagaggctttggtttctcctttaatgtcttatgaaaaatttttacttgtggattctcagagtccattatgcaagatttatccatttttaaacacttcctaaggctttgattaggtaaacaagttttctcacgtgctttaaattctcagaaaactgcagttctttatatgctgtatttatatgctcagtcaaaataggtggtttaaggttacagttaatatttctggggagttagtttataaatgttaacattaatgggtgacaagtaggtggtaactataagaatcctaggatcctcggtgtttctgaagatgtatgtgataaataacagcagcactaacatttagtgagtgcttactgaatgcaagacacactgctaaggtctctgtcactataataaccctgggagggagggaggtatttttttcacttaaaattagagaactggccaggtgtggtggttcacacctgtaatcctagcagtttgggaggctgaggcaaacagattgcctgagctcagtagttcaagaccagcctgggcaacatggcaaaaccccatctctactaaaaatgcaaaaaattagttgggcgtggcagcgcacccctgtagtcccagctacttaggaggctgaggcacgagaatagcttgaacctgggaggtggaggttgcagtgagccaagatcacaccactgcactccagcctgggcgacagagtgagactctgtcttaaaaaaaaaaaaaaaagttaaagagaactgaagcttcaagaaattaagaaatttgtccaagtcacacaagcaagtgtatggcagagccaggacataaaccctgcttatatgattccaaaaactttatccttaagtaataatagatgctgtaaattataaacattgagttaaatgaagtaatgaaggataagttactcagcgtttgttttgtaaagtctctcaaggaaaaaattaagttggaggcactgatggcagctgctgcattcatgagactgtagcagtaatctaggagatgaacatagagggtggatttaggatattataaagtagtaaaatcaatagaactggatgatagattatgtgacgcctgaagtggatccaaggtagggccaatcttggcatcagttccagttgcttccagaaggggcgctagactaacagggaaccctgatagaccatatttaaatgcttggctttgccttagtcttcttgtagagaaaacgttttgaggcagcagagatcatcaaatcactggtttcatcagttctcctttgcaaattgttttgtgatttttttggcagaattaatgccaactgaaatttttatgagttcactatcaattctgtgaattattttagtttcttagtatttttttctggtatcaaatttttaggcattttagtgcatcattgttttaaaaataccaataaatgatagttatcatgtgctgttttgagcactatctgccaagctctgtactaagtggtttatattcattattttacttaatccataaagcaagccaagtggtaggtattattgttcccattttacagaatagaaagctgagtctcagtaggattaagtaactttccctaggttaagcattaagtaaacctaagagccaggatttgtgataaggtctttttgattcccactgtaccactggacctctgtagagacaaaaaaaaaaaaataaaaggaagaaaatagtcatgaaacccaaatcatggagaaatgccttattcaaaaaatgttggtgtggaaaagatattaaataaaatggataaaatgaaatgaggtttgggaactgtctggagatggttccctatggcattaggcaaagacaacttacaggataaaaatatcacatgaaggttaagaaaaagaatcataaaaactctagatttttaaattcacatgaggttatcaaagtccttgctttggttttcatttcaaatattcagatttctttgtgagtggggataagagtttgagggcaagcaggaatagcaaatgctatttctttgcttatctgttgtccctaccaagaaaattaatcacttcctattctggactcccaaagcacagagtacagagtcacatcagcatttgtcagtccctgaactcagctggtctcctggctagagttagttccttcagagcagcatcttattcttttttgccagtacttggtacataggtggcatctggtaaatgaataaactgcacacagaaggagcaaaagctatagtttcagagatgcgtagaaggaaatttaactaaatttacccagcagattacccctgccttatttcaaatagtgggattatcttgtgagagcttgatttttatctatgattttattgcataataataaaatttgtcaacaccataccatgcagctattactgttactggatcttttgggaaatttcaaaggaaagagaagacgtttttatctgatttgacagctttggagaattgttaatttatgtattttaaaatgtagacagctgatcctaagggaaaatattgaatcagaagataagccatcaaactttatttgataaatataacataatagaatatatttcaacttcaacttcatataaaagttgtttaaggaaagaaaagcaaaagaaaagagggaggggaaaaatgtaagagcaacttggatgttcaagagaatcctgactgagcaaaactacatattattaattgtttacaaaaaatatatagctctttaagttaaaatggattacgtttcttgaatttttgtgtgtttagagtgttataagttccaacaaaatgtgaaagtacagacatttgttaagtcatctgtttttctctttttttttcagtaatagggaaccccaaccttttctggaaaatcaggatcacattgcattttatagagaaacaggaatagcttcatggagtgatgtatggtttcagaatactgctgccaaagcttttaaactgggttgtatctttgcaatgataagcataatttgccttgtagataagataaaattgagtggatggctgctttggtccttgagatgggtattctccatttctgaaataaccatttgtcaatgtctttctcaaggtggtagctcagagaaaataatttaagacatatcacttgccatataatcctaatttcttcaggttaatcactaccaatacaaggtaatacacatgctggagttggctcattttggctcacaagagacatatgtacgcatctgtgcccaactcttcattcagtggtgtcagtttggtagcttgaaaacagccagagaaggagtatttacaccacagaaataggcaggtgctttaagttagggctttaaggatggtgaggaaaaaggaaggtagagatagttgttaatatttaccaacacatcactacacacaggacactttctaagtactctttttcatgctttatctaatcaatcaacatccgttcagtaaatatttattgatcaccagttatgttccaagcacactttaattctttcaacaacccttggaggtaagtagtgatattcctatttcatatattaagaaatagaggctcagggagctcacatagttaccaagtggcagtgttgggactcaaacccaggtttgtctacctccaaagccaatccctttaacttgtatcactgcagtatcctaaccataaactttaatccctactcaaacaaatagccacccattcccccatccttatgatatcgctccctcagtctcccctctgcacagagggttcacttcctctcggactggcaaatttaccagaggagccagccctgaaatgagacagcccagctttgtagctcacagcattttgtttgtttgtttgtttatttatttatttattgcttcaaaatctttccctctcccactccagccaggatattttaaggattaaattgagatatttggtaaattgtaaacatcatcaaaatgccaatcttcattgttatagatcacctctgttgcacctagggctttctcatgtacaagtgattcacagagccctgggtagctcagttcaatgtgtgctgagtgccctctacattcaccaggccaggcgtggatttcattctcagggagtcactgttcatttggtctgcttgctgttgacccagcatctgctgtttggtatttggaagttctgttgtctttattgatattttagtatcttagcctccatgaacagcattcaatcattaatacctttgggattcttctctgttgatcttgctaatttcagaaaatctagcatccagccaggcgtggtggctcacacctgtaatcccagcactttgggatgctgaagcgggtggatcacctgaggtcaggagttcaagactagcctggccaacatggtgaaaccccctttctactaaaaatgcaaaaattagccgtgagtggtagtgcatgtctataatcccagtttcttgggaggctaaggcagaagaatcatttgaactcagaaggcggaggttgcagtgagctgagatcgtaccactgtactctagcctgagcagcagagtgaggctctgtctcaaaaaaataaataaataaataaaaagaaaaaaaaaaagaaaatctagcatcccagcacattccatcctcagcagtcaatatgattaaattttctttttcttttctttttttttttttaagagtctcactcagttgcccagactagagtgcagtgggatgatcttggctcactgcaacctccacctcctgggttcaagcaattctcctgcctcagcctcccaagtagctgggactacaggcgtaggccaccacacctggataatttttgtatttttagtagagacggggtttcaccatgttgaccaggctggtcttgaactcctgacctcaagtgatcagcctccctcagcctcccaaagtgcttggattataggtgtgagccaccatgcccagcccaatatgattaaatttactatcaacttatgtcttcctttttccttggtcatgtaaccaaaaggcatttctgcagttatgaaagtgtaatgataattggaattaatgtttatttatagaaccacaaattatataattttcatttctgtctctctattaatttgtcacaatgacaagtatcatcaaatactgagaactcaagttcaattctcatttaccaaagtaaaccaccgatgtcctgctaggtgaggtgccacctatgtcttttgtattacttattttttgtgcttgctgctataacagaatatctgaggctggttaatttataatgaacagacatttattggctgacatttcaggatgctatgaagtccaagaacgaggcgctggcatctagagagggccttcttgctgtgtcatcccatggaggaaggcatcacatggcagaagggcaaagagagaagaagggagagagccaaaggggccaaacttgtcattttataaggaatgcactcctaagataacagcattaatccattcataaaggcagagccctcatggcctaaccatctctcaaaagtctcacctcttaatactgttacaatggcaattaaattttaacatgagtttgagaggggacaaacattcaaaccacagcaacagcctctcatgtggttttaccctcaagccattttatttgattgtgataccatcaagatggaaagaattgctgtcaaggtgtgatcatctaatcttgaccagcatgtactggggggaaaaaataccataatcaaattagccttccaacagtgtgttctcaggacttgagtctcttgaagtattccttgagaaagttgtcaaataattttagatgatgttaccctcaggtgatacaattgcccaatatcataaaaagtttcaagaagtcctatagtcaagaaatctcccttcatttaataaatgtttgtagatcaccaggcaccattctagatgctgaggatataggcattaataagacagccagtctgatcacaaagagcttatattctacttgtttcaaactgtggttcatggtgcttaagttatagttgtgtttgagcaattttacacctctttgtgctgtagctaatgagcacaaaggagataaaggagtctggagatcaagagacatcaaagctggagataaaatttgggagccataacatatagatttaaaaccgtgagtcttaaggtcaccaaggaaactatattagagaagaaagggggcttaagatagagctctgggcccaccaaccttcagaggtggaggagaagagcaagcatcagtggagtctgagaaggctgaccagtgatgcaggaagaccatcaggagaacatggagtcccagaaggcgagaaaagaaacctgctgtctttgttcaatccagagtactctgtttcctcatcctggtttttctatgtgttttatgctgcataaatgtcctgtaagaattaggtatgcttttagccaggagaatagggatggagtctttattatcaccatattcatctgggatgccagagaaagaggctcactttattttgaccctgactgctagtgtcaactacatgcattaagcaatggctctgccatatgctggggtctgtgtcaggctgggcagttcctacttcggacagaggtttgccatcatcattagagagaaggaataagacaaggattgctaagagttggaggttaagtctacttagaaaacaaatgtgcagctgaacttctgaataacagcagtgatggtttcagattctgcagaaggagtgccatcacttttccattttgtcacagtgaacatctagtgatgtcctaaaacatgcccagagaacaatgccagaagtgacagacagcacaaagatgaagaaggcatgagtctagccatcatagagcttatgtaacccaattctaaggatgagcaaatattaaaaggttaaaagggctgagaggcttgagagtagaacttaagttgtctttgatttctgtcaacttatctatcaaaaggaaagactgtggagagtgagacagcacaggactcctgacaggaggctgcttgtttctgaggtggccgtgcacgcaggtgtggctcccatccatggccattctgagaggaaagcagacctggcccacccagagcctcagaggcaggcaagagagagagagggtgcaggttagacccagccagtcgggtcagagacatgtgatggtcagcgtgaccagggtgacaagccagacatggctggctccatgactgaacagccagaaagcagtttgtagacagccagccacagaaaaagtacagcccaggccaggctcagtggctcacgcctgtaatcccagcactttgggaaactgaggcaggtggatgacttgaggtcaggagttcaagaccagcctggccaagatggcgaaatcccgtctctactaaaaatacaaaaattagctggccatggtggtgtgtgcctgtaattccagctacttgggcggctgagatatgagaatcgtgtgcacataggaggtggagtttgcagtgagccaacattgtgccactgtgctccagcttgggtgatggagtgaaactctgtctcgaaaaaaaaaaaaagtacagcctggagaacagataaatgatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacccggggtaagcaagatagtggataggggacagagggccaaagcttcctagactgatgattagctgagctgagtgataaaagagaagtcagataattacacaaaaatgagagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaagttctgtggctgcaggagctgtgggccttgttctgtgttggatcctcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgcgtagtaaatggcaaatggagaattctaacttagatctgtctcacttcaaaggtcacactgttgatcactacaatgtattagtttgggtggtcaaaatgagacccacaataatttgttatttgtctgtgtgtatgtgtgtgtgtgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacacttgtgggactcagaagggcgtgaggatatggcagaggccccagtgagtgtccctgggcctctgtctgaggcagattaatacccacaaaaagtgggacaatccagattctcaaggttgccaggaatttctgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaagggactgtaggcaagaaaagtcttcctgcatgacagcatatgaaattagcatctctcctcataagggttgaagagatcaaggtcagaggcttcacagtgatccaagactcaaggacaattgagccaagggaagattgatcaaagcagaacatttagataagccttccagattgtagaaggccttgggcttgctagagagtcattctttaagatgttaggaaacattcaatacagccttggataatcaactatgagcaagttgcactaaggaggctgataacatacagagggaactacttaagacagggagtataatttcatggtcaaaatttacaaatgaattaggaccttatctggagaaatgaatcttcatattgtaaatacaacggtgttctaaaatttagaataaatgaaaaatgaataaaatgttgctttaggggatataatccttcagaaaaattctttgatagtatctgattatttcacagttagttttgggaataatattacagatacagtcatttttgcaaaagtatttgagcacttcatcagttttctctgtcttttgacatgcagatctttcttttctgaagtgcctcgtatcatcatccttgtcaattttctttcttcagttgtcttctggtcctgctctctcagatcctcatttaacagcggctttgctgtaattttagcatctccctaatatcacttccactgacttcatgaaatctacatgttttgccagttttgcaattttgctaggctcttaatttttttttaacgtgtgatatcttttcagacagttcaacacgtggccatctgcacaagacttaaccccagaggttgacctaatggacctggttagacatttgtgttaatgagaggcacagtttgacaacggtctggttttctacatattcaggcactgcaccttttcacattttgacaacctcttattccctgcataaatcctgttcctgcagggatttggataatgagggcttgaatggcaaagccctctgtgctacatgccatgttctttcattattgaatgttgtgtctttaacaggactatctagcccaaagtctcaacatttttgtcattttcagacgaccagaattattcttctaatctaggatgattttgttaaaaattcagggaaagattagcaagagaaaggaatgcgattcaatgctataacatgctattaatgacatttataggagcaggattagtgtttactttgattatagcatttcttgggggttaggtttgaattctgcatctctttgtgagggagaatgttacagtgagttcctttcattctcttcaaaggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttataccttattatctgatttatttgtatctccttctaactagtgggattgggattctaggaggttggttttcatttgagagcatgagtcctggccacgtctcttcagcaacttttggaaatctggtcttggaaaacccacctaatcaaattagatgctcaagtttaaaataagtccaaggcaaattatccaatcacaatgatgaattcgagatttgagggaattaaatggaatca

SEQ ID NO: 17069 - DNA, 35207 bp, Human
tgtggtcaaggtcaagtcattactatttactagtgatctggatcccttttcccagcccatttaatctactttgatgcagagaagagatcggatgctgtgaggggcgaatataagcatttacagtgcatctctgactacatacacagagaaactgtttctgtttcacctgttactctaagttattttttctccattagttaaggtcaagaattttacttaattcagaagtaacatttaactcaaaaagagacagaagaaatacaccctcttccaataaatcaataagcactttaaaaggacacttaatgaagatttccctcgatacttaaatagctatattaaaatttattttattttccatggctagaagacaatgtttatttttccagtaagttcacaagaacaaaggtatcatgcaaagtaaataaatgacacattacaatctcctggctctgagaagttcccaaacctgattgatgagaattacaaaacttccagtcctgagtaatttgaagaggtctaaaaatagaccccaaaaaagacctcttttgaatgtgtgttaataaacgagctatgaatttacaaacctctcaacatcattttcacctaccaacaatttatcaacttctcaagaatgttaacattaaaaggagaaaatacgttacgtcttaaatttggttttttcatcgtgagataattaaatgccaggatttcataagatattagaaatcggttgtccatattagatttattatgtttgaaagcaagccctgagaaaggcattccacaatgtaagttttccagtgttggttaccctcaagatgtttgcttttcgtttatgtgtttgttttatagaaataactctgtaacaagttgctacaaagccgcctttcatgtgtcaggctccctaggaggactgaatccctcctccccaaatcaaggataactagcccagtctctggcttactggaggagaggaaggactttattttcacctcttggacgattacaaaaaccagtcatcgaaaacgagaaaaggggcagggtataagaaaaactagcgaaatgaccagactgagtctcatatcctaagatcttttaaaactcatttccctaccgaagggtgtcattcgtaacgcggcgtggggctgggggtgtggatttacggagaaagaggtgatcacacttcactgggcttctgaaacattcagctctggaatctactgtggactcttgaaaagttcatcccgagatctaacctcaagcctcagttttcgccaagcaagcccttcccccttcggtcaggtgcaacaaacttcccactcacccctcctttgctaacaaagccgctccagcaggagagaaacgaactctctcccgccacacctcttttgcacccagtctgcactccttcacctcttacctacccgcctcaccttctccccagacgccggagcctgagatttaaccccttccggccctcgaagggaagagggaagactaaagacaacgcacctattgcgtctagcaattctgttccccgaggaaacgtgcgttttagaacaaaagtaccagcccgctctcgctaggactaagtgagcttctcccttcttgtttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgtgagccgagaggaggcgtaggagatggcgtcccagccgccacctccccccaaaccctgggagacccgccgaattccgggagccggaccgggaccaggaccgggccccactttccagtgagtgtgggattcttcaggctgtgagtttagtgggcccgagcggggacttggcaggaggcggttgtagcggttgttagtggaggtattcccttcccccctttaaccaatacccaaccttggggataggggccgaggtggagctggggcgcttaccagtggggactttagtgtctcacagctgtttctgacccggcagctctaatcagcaacgtttttttcgggagctcctgggcgtctctctgggtctctgtgcttgaaagaaaggggggcggcttcctacctaccgcttctgttttcactttgacagaatggcttctctatctttaaagcgtagactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttgtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactctcccattcttctttatagtggtgactattgtccttatttggtgtttcgcatacccagtaatgtttttatattttagtacttaggtttgtgctatttatatgcattttatatctaaaacttaacaatgtaacaataatatatattttatatctaattacatgttactatttatatattattttttgtatctgtttttgttttttctgttgcccaattttctattggctttatctttgcttaccaatttgtaagagtattgttaaactaatccttttttgttactacattttgctaatatttttcactgtgtggcttctcctctttatatttatgttcaattttttgtacagatgtttttgattttaatacagccaaaattgtcatattttattgtttatgctttttgtcttggttaagaaatcctgtctacctagatcaggacagtttttctgtatgttttcttttaaatcttccggttttttcatttgcatttaatccacatggaactgactttgtataaaaatctaatttttttttccatataggtaactaattgtcgcagcaccatttattgagtagtctattcttagtttttaatgccatctatgtcatatcaaggtttcctaaatatgtagttctgttttgggcattttctgactttctactagcaccacactatcttaattacagaattttataagtcttgatatgtagtatgtcaagagtttccacacattgctgttctttgtaattgcgctctttacacttagtcctttataaaaagacttactgggatttttattggaactgagctgaatttatggatcaagtaagtttttattccatgaatattgtataagctacaattggtgggaatttatctttttgccttaaatatcttataattatccactttgggagactgggcgggcagatcacgaggtcaggagatcgagaccatcctggctaactcggagaaaccccgtctctactaaaaatacaaaaaaacattagctgggtgcggtggcgggcacctgtagtcccagctaatcaggaggctgaggcaggagaatggcgtgaacccacgaggcggagcttgcagtgagccaagatcacgccactgcactgcagcctgggcaacagagggagactccatctcaaacaacaacaacaacaaaaaacttataattacctccatgaaatttttttccatattttattttttattcctagattatttttgctgtagtagttgcaaatgggctttcttttttccttttacattttccagttggttattaactggtatggcagaatgctattgattttttttaatgtaaatattatgtacagcataatctcaaactcttaattagttctgatggtttggttgaaattctctttagttttgtgtagccagttctgtcatttacagataagctagcatccttgtattggtcctgacttccactggagtgcttctgaagttttactgttaaatgtgaagtttgctttttgtttttgatagatatcttgtcaaaattctctctctctaccttgctcagatttattttattttatttttatttcatttttatttttgtttgagatggagtctcactgtgtctcccaggctggagtgcagagacgcaatcttggctcatggcaacctctacctcctgggttcaagtgattctcctgcctcagtctcccggacagttgagactacaggcgcgtgccactccgcccagctaatttttgtatttttaatagagatggggtttcactatgttggccaggctggtcttgaactcctgacctcaggtgatctgcccacctaggcctcccaaagtgctgagattacaggtgtgagtcactatgcccagcccttaccttgctcagatttttattgtgaagaaatattaaattttatgaatggcttttctgcatctgttgagaccattgtatgtattttcgctttagtatgaaaatgtgggaataggaacagctctggtctgcagctcccagcgtgattgacgcacaggacgggtgatttctgtgtttccaactgaggtacctggttcatctcactgggactggttgaacactggtcgcaccccatggagggtgagccaaatcgaggcggggcatcacctcacccaggaagcgcaagggattgggggatttccctttcctaaccaagggatgccgtgacagactatacctggaaaaatgggacacttctgcccaaatagtgggctttttccacagtcttagcaacaagcagaccaggagattctctcccatgcctggcttgacggatcctatacccatggagccttgctcagtgctagcacagcagtctgagatcaatctgcgaggcagcagcctggcagggggaggggaatccaccattgctgaggcttgagtaggtaaacagagcgcccaggaagcttgaactgggaggagcccactgcagctcagcaaggcctactgcctccatagacttcagctctgtgggcagggcatagctgagcaaaaggcagcagaaacttctgtggacttaaacgtccctgtctgatagctctgaagagagcagtggttctcccagcatggtgtttgagctctgagaacggacagacggcctcctcaagtgggtccctgacccccgtgtagcctgactgggaaacacctcccagtaggggctgacagacacctcaaacaggcaggtgtccctctgggacaaagcttccagaggaaggatcaggcagcaatatttgctgttctgtagcctctgctggtgatacccaggcaaacagggtctgcagtggacctccagcaaactccaacagacctgcagctgagggacgtgaccattagaaggaaaactagtagacagaaaggaatagcttcaacatcaacaaaaaggacatccacaccaaaaccccatttgtaggttaccaacatcaaagaccaaaggtagataaaaccacaaagatggggagaaaccagagcagaaaagctgaaaattctaaaaatcagagcacctcatctcctccaaaggatcgcagctccttgccagcaacggaacaaagctggacagagaatgactttgacgagttgacagaagtaggcttcagaaggtcggcaataacaaacttctccgagctaaaggagcatgttctaacccgtcgcaaagaagctaaaaaccttgaaaaaaggttagatgaatggcttactagaataaacagtgtagagaagaccttaaatgacctgatggagctgaaaaccatggcacaagaacttcgtgatgcacgcacaagcttcaatagctgattcaatcaagtggaaaaaaggatatcagtaattgaagatcaaattgatgaaataaagtgagaagacaagattagagaaaatgtttattgtatcaaccttctattgttgaaccatccttgcatttctcaatgaactttgattagtcttgatttttttctgatatgcaattccaaattctattctaaaccagttggagtggttcacatttgtaatcctagcattttggaaggccagggcaggaggattgcttgaggccagaagttcaagactagtctgagcaacataacaagactctgtctataaaaaattttaaaattggccaggtgtagtggtgtgtgcctgtagtcctagccactagggaggctgaggtgggaggatccctttgagtccaggagttcaaggctgcagtgagctgtcatcataccactgcactccagcctgggtgacatagcaagaccctgtctccaaaaagaaaaagaactctattctaatattgtgagactgttgcatacatgttcctaggtgaaattgaattttttttctttgtactattctggttttgtatcaaagttttatagctagataggtttttctgttgagtctaatttccttttttttttcagacagtgtctcactctgccacccgggctggagtgcagtggtgcagtcatggctcactgcagcttctacatcctgggattaagtggtcctcctgcctcagcctcctgagtagctgggactacaggtgcatgccaccatgcccaactaatttttatatttttagtagagatggagttttgccttgtttcccaggctggtctcgaactcctgggctcaagcaatcctctcacctcagcctcccaaaatgctgggattacaggcatgagccatctcacctggcctaattcatttctttataggcagactgccttctccttagtagccttgatacgtttggtcctctagctttattatattgtaaccaggtaggaatatacagacacacacacacacacacacacacacacatattttttttttcttcctgcttagtatccacagtattcagtctgaggattcatttctttttttaattcaggaaaatgctcatcaattatacctttaaatattattttaagttttgtttgaacactagtctttactgtctcttcttctgtcaagcattatatcgggactagtgtctgctataagtaacattatctgactcactgtgatttggactattaagacatttattgtttagttagcaagaagtctagagatctgccttctcaacattgtcatcaagggacctaagtttttcctgacttcttttttttttttttttgtcagctctcttgactttttggccatctctgtcttttgttttgtttgtttgtttgtttgtttgttttgaaataagtttcactctgtcaccaggctggagtgtggtgacgcaatcacacctcactgcagcttccatctcccagggctcaagcagtcctcccacctcagcctcccgagtggctgggaccacaggtaagtgccacaacgcccagctaatttttgtattttttgtagagatgggtttttaccatgttgccaaggccgatcttaaattcctgggctcaagtgatcttcccacctaggtctcccaaagtgctgggattacaggcatgagccaccactccctcaccatctctgtcttattctttgctcctttaaaaagaatcttaccccacccctgatctggttgctttcaatattttttctctgttttagttttcagcagtttgctttgttaggcctcagtgtggtcttctttgtattatcctgggtggaattcacagggatacttgaatctgactttgatgcctcttattaattccagaaaactttaagccattatttctttaaatatggtttctatctattgtcactttactcctttaactcaacttgcatatataccccatatgtcactatactccctgtatcttactctcttttctgtatttatccttctgtttcttatgcttcattctgggtattttcttcccatctctttcctagttcactgatatttttctttcactgtgtctaatctggtattaaaccagtcattgaggccgggtgcagtggctcatgcctgtaatcccagcactttgggaggccgaggcgcgtggatcacgaggtcaggagatcgagaccatcctggctaacatggtgaagccccgtctctactgaaaatacaaaaaattagctgggcgtggtggtgggcgcctgtagtcccagctactcaggaggctgaggccggagaatggtatgaacccaggaggctgagcttgcagtgagccgagatcacgccactgcagtccagcctgggcaacagagtgagactccatctaagaacaaaaacaaaaacaaaaaaaacagtcattgagttcataatttcaggtttggtttggtgttgtttttagttgtagaatcttcatttggtcctgctttatattatagttcctattttcttttggaaaatcccaatcttgccttttttatttgaatatattcaacacagttgtttaaagtttctgcctaataagtctataataactctattatctagatcccctttggagctctttgtattatctgaagtttctttttttgtttgtttgttttgtttttgagacagtctcactctgttgcccaggctggagtgcagtggcgtgatctcggctcattgcaacctctgccacccaggttcaagcaattctcctgcctgagcctcccccgtagctgggattacaggcacctgccactgcacccagctaattttttatagtttttaatagagacggggtttcaccatcttggccaggctggtcttgaactcctgacctcatgatccacccataattttgttatgtaagccctatcattattattattattatcattattattattattattaagacagagtcttgctctgttgcccaggctggagtgcagtggtacaatctcggctcactacaacccctgtcacccaggttcgagtgattcttgtgcttcagccacctgagtagctgggattacaggcattcgccaccacacctggctaatttttgtatttttagtagagacagggtttcgccatgctggacaggctggtctcaaactcttggattcaagtgacccacctgcctcagcctcccaaagtgctgggattataggagtgagccaccatgcccagccaagcccgtttattttttaatgagagctgcacattgtatatagacagtttaatgtgatttgaggcctaaggatatctttctctaaagacttttccttttgaccagaatgttaggccactaacaatctagaatcactttaatccaataaaggattgagctgatttaaaacttggttttcattcctgccaggtagtccatttcctgttaaccttttcaccctttctactagcatatttccctttttaaggtcccaatctgaagtgtgagggttccctatggctttcctctttagggttctgaactccagtttatggctccttagcccagggagtcttaaaatctctgcccagcttctcatcctgtcaaccatctcttctggaattggccctggtttctagagaaacgcctgaaaagatctggctctctgggttttttttttcctccttgattttgtctccagaattcttcggtgcctcgttctctaatgctttaaacagaattccttcctatttccttcccttctagttcattgggagggttaatctaattacctcgacaaccattacttaaaatagaattcccaagttctgtatttccattctgctccttagtgtacagcagctaattttcttcttgaccggtagttgaaaaacggttccagtggctgtggccaccttttcttttttcttttttttttttttttttgagacggagtctcactctgtcgcccaggccggagtgcagtggtgctatctcggctcacctcaacctctgtccgcttcccaggttcaagcaattctctgcctcagccacccgaggagctgagattacaggcgcccaccaccacgcgtggctaatttttgtatttttagtagagacagtatttcaccatcttggccaggctggtcttgaactcctgacattgtgatccacccacctcagcctcccaaagtgctgggattgcagacatgagccaccacgcctggcctgtggccaccttttctaagatttctaatggaatttttaaaatatttaaatgtttttatttaatttcaatttttatttcacagatattatttcatttctctctctgataatttttaacatatctaaaatcattcctgagctgttatataaaattagtttttttaaattgggttttatacttgctgatttttgttggctttgtttcttagtgtttttatttcttcatgtgtgtggcatttttgagatggtcattttgagtagtaattttggagttctgttttctctcctttccctcttccatgttcccctctctctatctaataggtgtcctgttgcctctccctgttccctctacctaccacttaggtaagaatcaggtgtaaaaacagtgggtcagactgggcatggtggctcacacctgtaatcttagctctttgggaggccaaggcaggaggattgcttgagcccaggagttggaaaccagcctctcaagatgtagcgagaacccatttctacaaaaaatatcaaaaagaaaaaaaaaaaaaaaggcaggcatggtggtgcacgcctgtagtcccagctacttgggaagctgaggtgggagggatcgcttgagcctaggagtttgaggttgcagtgagccgtgattgcaccactgaactccagcttgggtgacagagtgagactctgtctcaaaaaaaaaaaaaaacaaaacacacacacacacacaaaaacagcgagttagattaaggatatcacacatcaagtcggtcagttgtttcatttcctgggctggaggccttatcacagtcctctccctctcttagttctgtaactttctcaaaatattaaactgtcatcagcaaattttataatctctttgtaggagtcaaggtggcacatcctcattcccagcctcaagcattgaactggttccattttaatggagcacttttcgtttttgttacttcattgaagcctgcatcttggctgtcactgcctgattacagaaccagaattgagtaggcccgtagcttcagccctccttaccattttacatttctgtttagtttctcttccataagtctgtcttgtgttaaatctagataatgtctgtttgtttgtctctctgttttctctattattgcttatacttgggagcagaactgtttcattaaagcctgaatgcactgcactatctggccgttcactggctccttttaagttttgttccatttttaaatatcagatccaataaaagaaaaaaaaatagagttctagtagcttgtttataatattacgatacaagtctaaattaaaactttagcctggattagaaaattaccattttgcagttccacatctaatatttgtttcaggcaaggatgatgaatcgatgctaaactatcaaatgaacagttgctgaggaatagaatatttgtggtacaaaactgtcatcccatagattatatactaattacaaagggaaagatacattttaatggaaagatctaatagtcacctccttaaccaactaatcaaatttagcttcacaaatgcgcctcctaaagtaatactgtgtgaagtaaacaacatcacttatgaattattcttgccaaaaaatattgaacctgattgcaatcaaaccgttaaatgcaatcttaatttaataggaggcgaaataagagtacaagttaaacaacacttgggggaaacacaaatctgggggtaggacatttctttcttttctttttttttttttttgaaacagagtctcactgtgtcacccagactggagggcagtggcatgatctcagctcactgcaacagccgcctctggggttcaagcgattctccctcagcctcccgagtagctgggactacaggcacccaccaccacgtccggctaatttttgtatttttagtagagatggggtttcaccatgttggccaggctggtctcgaactcctaacctgaggggacccgcctgcctcagcctcccaaagtgctgggattacaggcatgagccaccatgcctgggctgggggtaggacatttctagaaaaaaactgggttgactctttagaaggtcagggatatttgaaaaaatgggattgttctcatttagaaaagaaaggaaacaaaacaaccaaatgcagtgtgtgagccttaattgaatttttgttcaaaaaaatttttaaagatatttttgactcatgtagcacaataatttaaaaagcagtgataaaaaggctaagccaagtacaatggctcatgcctgtaatcccagcactttgagaggtagaagtggaaggattgcttgaacccaggtatttgagaccagcctgggcaacaaagtgggaccctcatctctaccaaaaagttagccgggagtggtggtctcacctacataggaagctgaggcagaaggattacttgagctgtgtttgcgcttctgcactccaacctcaatgacagagggagaccctgtctccaaaaaaaaaaaaaaaaagagggcgaacttaaaagtgggcaaagtatctgaatacatatttttccaaataagattgtaaaacgaccaataagcacatgaaaatatgctcaacatcattagccgtcaagaaaatgcaaattaaaaccacagtgaaataccacctcacgcccactaggatagctataatgaaaaatataagagcagatgtggccaaggatgtggagaaattggaaatcctcatacattggcgagaatgtaaaatggtacagttgctttggaacacaatctggcagttcctcaaaaggctaaatatagagtttccatataacccagcaaacatgtccgtacaaaaacttgtacataaatggtcattgcagcattatttgtaatagccaagaagtaaaaacagccccaatatacataagctgatgtgtgaataaatataatttggcaataaaaattaatgaaatacagttggccttccacatctgatcaaccaactgtggatcaaaaatattcggaaaataggccagacgtgttggctaacacctgttatcctgacattttgggaggctgaggtgggaggatcacttgaggccaggagttggaggctgcggtgagctatgatcatgccacaacactctagcctggacaatagagtgagaccctgtctcttaaaaaaaaaaagtattcagaaaaaaaaaaactgcatctgtactgaacatgtacagactttattccttgtcattatttcctaaacactacagtataagtaattacatacatttacagtgtattagatactataagctagagatgattttaagtatacaggaggatgtgcataggttatatgcaaatgctatactattttatattaaggacttgagcattcatggattttggtatctgaaggagattttgaaaccactcccccacagataccaagggctgcctgtgctgatacatgctataaaatggataaaccctggaaacattatgctaagtgaaagaagccagtcacaaaatactacgtattgtatgagtccatttaccatagatcctcattatttgtggattctgtattttcaaattggtctgctcactaaaatttatttgtaatctgaaaatcaatattcctggcactatcacagtcatttgaggacaaacgtacatcaggtaaaaatctgagttgtccctcagctgacaactgagggacaactgagagacaaaaaagcaacactctggtttcttatttcagctctcatgctgtaaacagttgtctttatcaaagtctgtttagtgccaggttttttcacatttttttatggtgattttgctgtctaaaatggcccccaagcatagtgctgaagtgatctctagtgttcctaagcacaggaatgctgtagtgtgccttacagagaaaatacaggtgttagataagcttcattcaggcatgggctattgtgctgttggccatgagttgttaatgagttaacaatatacctggaataaagtgactttaaacagaaacatataaaataagtatatgtattgattggttgatgaaagaagcagtgatttggtatctgctggttcagagttcacagcaactttacaggatataactatcttaaataacaagaattaactatatatgaaatgtccagaatagacaaaccgagggacagaaggtagattcatggttgccaaagatgggtggaggggtgggcaggaaatggggaatagctgctaatgaatatggggtttcttttttgaggtgatgaaaatcttctgaattagacatggtgatagttacacacctctgtgagtgtactaaaacctattaaattttaaactttaaagtgatgcctgggcacagtggctcacacctgtaatcccagcactttaggaaaccaaggcagatggatcgtttgagcccaggagtttgagaccagcctgggaaacatggtgaaaccccatctctacaaaaaatataaaaaattagccaggtgtggtggcatgcacctgtagtcccaactgctcaggaggctgaggtgggaggatcacttgagcctgggaggttgaggctacagtgagcttttgattgtgctactacactccagcttgggcaacagagtgagaccctgtctctaaatcaattaatcagtcttcagtagaatttgtcatagcaccaggtatataggagatgtttaatacttactttgaattgaatttattgtatgcttaaataactgttttgaatcttttttggttttagatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacaggtaagagaactgtaagggaacaggttcagataccatataacaatctcaaatttcaagaatagatttgttagttttctttatattgatttgtatttactgtttccagttatattttcagttaagagcttcaaaactggcagaggaatatatagcaaaaataggcttgctgattagtttattgttcagtttaatagtgcacattacctgtttacaaggtactgaaattggtgctgtggaggatacaaagatacatagggcataattcctatctttctaaaatttattggaagggaggtggtttaagacacatatacaggtaatgaggcagaaagtgtgataagaaatataacaattggggagagacataaggtttcttgaaccttttttaatatgcaagacactgtgctaggtattttgtgtgttttatctcatttaattatttcaacaatccaaagagataggaattatcctcattttgcaagtgataaaactgagatccagagaactcacttacctagggtcacatctttaataaggcagaactataaacaaaaccaggactggttgaatgttaagctgtattctctcaactagtagagagtattagctcactttagaaaagagaagctaacattttttactgtggtatccaggaagaaatggcatctaagttagatttttgaaagctaggcaacctttcaaaagttagataaagaaacaaaaactatcaagctgatagaccagcttgaacaaaagtatataggcagaaaatatgagatttatttggtagttgtcctatagtattgcattggatagtaagaaataatgctgagaaattaggttgaaagctaatagtagaagctcttaattggcattatgagacttaatctttacataaggaatggatggttttttggtagtttatgtttgtttttgtttttaagcagactgtgacatacatgtaaacgaaaaagtcagtctgaagggtttaagataaatcagtagaagtcagcacgttgtaattaggtggtaaagttcataaaggatttgggttgtattcacctttgtattcctactgtctaacctgcttgacacatagaaggtacttaatagatatttattaatttgggggcatcagtaatgatacttttgcattagactgtttgagagataatgaagacccaaaatagagtgtgtgagaagcaggattcatataatagattcagaggatgtagttactgactaaatgaggtatataaaggcaaagtagaaatcaaaatgccctagacctttaaatttgggttattagaaggataatgttttattaactcaataaatatttgttgggtgccaactacataccaaagaattctcagagctagggatatagcaatgaataaaatatattctaaaaatctctgcctttgtggcagtctaatagggagaaacagtaaataaataagtaaaatatatagtaagccagaaggtactggtaagtgctataggggaaaaaacaaaactgggaagaattttgggagtgtcaggaggaggaacaggggttgcagtgctacatatagtcagggaacgcctccctgaaggagttaagggagtaagtcctacagctctttgaaggaagagtgttttcagtcatagggaacagcaaaaatgtagaggtatgtaagtggcatatcatgggaacgggaaggaggccagtgtgattggagcaaagtgttagtggcaggagatgaagggagtagatggtataagttgtagacatgtgtaagaacattggcctttattccaaaatgggaagccactggagatttgtgagcaaaggagtaatatgacctgacttaggtgttttttttgttttgttttttgttttgttttttttcttcgggagacagagtcttgctctgtcacccaggctggagtgcagtggcgcgatctcagcttactgcaacctccacctcctgggttaaagcaattctcctgcctcagctttctgagtagctgggactacaggtgtaggccaccacacccggttaattttttgtattttagtagagacggggtttcaccgtgttgcccagactggtctcaaactcctgagctcaggcagtctgcccacctcagcctcccaaagtgctaggattacaggcatgagccaccacacccagccgacttaggttttaaaaagaatacctttttgcgggcagtcgcttccaagatagccaaataggaacagctccggtctgcagctcccagcaagatcgacgcagaaggcgggtgatatctgcatctccaactgaggtacctagttcatctcactgggactggttggacagtgggtacagcccacagagggcgagctgaagcagggcagggcatcgcttcacccaggaagcacaaggggtcaggggatttccctttcctagccaagggaagccatgagtgactgtacctggaggaatggtacactcctgcccaaatacagcgcttttcctatggtcctcgcaactggcagaccaggagattccctcctgtgcctggctcggcaggtcccatgcccacggagccttgctcactactagtgcagcagtctgagatcaaccagcaacgctgcagcttgatggggcagggccagcatctgccattgctgaggcttgagtagctcacagtgtaaacaaagtagcccagaagctcgaactgggcggagcccaccacagctcagcaaggactattgcctctctagattccacctctgtgggcagggcatagctgaacaaaaggcagcagacagcttctgcaaacttaaacgtccctgtctgacagctctgaagagagcagtggttctctgagcacagtgtgcgagctccaagaatgcagactgcttcctcaagcaggtccctgacccctgtgtagcctgactgggagacacctcacagtaggggtcaacagacaccttcaacaggcgggtgcccttctgggacaaagcttgcagaggaaggatcaggcagcaatatttgctgttctacagcctctgctggtgatacccaggcaaacagggtctggagtggacctccagcaaactccaacagacctgcagctgaggggcctgactgttagaaggaaaactaacaacagaaaggaatagcatcaacatcaacaaaaaggacatccacaccaaaaccccatttgtaggttgccaacatcaaagaccaaaggtagataaaactacaaagatggggagaaaccagagcagaaaacctgaaaattccaaaaaccagagcgcctcttctccaaaggatcgcagctgctcgccagcaaggggacaaagctggatggagaatgagtttgacaagttgacagaagtaggcttccaaaggttggtaataacaaacgtctcggaactaaaggagcatgttctaacccatcgcaaggaagctaaaaaccttgaaaaaaggttagatgaatggctaactagaataaagagtgtacagaagaccttaaatgacctgatggagctaaaagccacagcacaagaacttcatgatgcacacacaagcttcaatagctgattcaatggccaggcatggtggcacacgcctgtaatcccagcactttgtgaggccaaggcgggcggatcacctgaggtcgagagttcgagaccagcctgaccaacatggagaaaccccatctctactaaaaatacaaaattagccgggcgtgttggcacatgcctgtaatcccagctactagggaggctgaggcaggagaattgcttgaacccaggaggcggaggttgcagggagccaagatcacaccattgcactccagcctgggcaacaagagcgaaactccatcttaaaaaaaaaaaaaaaagccgattcaatcaagtggaagaaaggatatcagtgattgaagatcaaattaatgaaataaaacaagaatacaagattagagaaaaaagagtgaaaagaaatgaacaaagcctccaagaaatacgggactatgtgaaaagaccaaatctacgtttgattgatgtaccggaaagtgatagggagaatgaaaccaagttagtaaaacactcctcaggatattatccaggagaacttccctaactagcaaggcaggccaacattcaaattcaggaaatacagagaacaccaggaagatactcctcgagaagagcaaccctaagacacataattgtcagattcaccaaggttgaaatgaaggaaaaaatgttaagagcagccagagagaaaggccggattacccacaaagggaagcccatcagactaacagcagctctcagcagaaaccctacaagccagaagacagtgggagccaatattcaacattcttaaaagaattttcaacccagaatctcatatccagccaaactaagcttcataagcgaaggagaaataaattcctttacagacaagcaaatgctgagagattttttcaccaccaggcctgccttacaaaagctcctgaaggaagcactaaacatggaaaggaacaactggtaccagccactgcaaaaacatgccaaattgtaaagaccatcaacgctatgaagaaactgcatcaattaacgggcaaaataaccagttaacatcataatgaatgacaggatcagattcacacataacaatgttaaccttaaatgtaaatgggctaaatgccccaattaaaagacacagactggcaaattggataaagagtcaagacccatgggtgtgctgtattcaggagacccatctcttgttcaaagacacacataggctcaaaataaagggatggaggaagatctaccaagcaaatggaaagcaaaaaaaaaagcaggagttgcaatcctagtctctgataaaacagactttaaacaaagatcaaaagagacaaggccattacataatggtaaagggatcaattcaacaagaagagctaactatcctaaatatatatgcatccaatacaggagcacccagattcataaagtaagaccttagagacttacaaagagacttagactcgcacacaatcataatgggagactttaacagcccactgtcaatattagatcaatgagacaaaaggttaacaaggatatccaggacttgaactcacctctggacccagcggacctaatagacgtctacagaactctacaccccaaatcaacagagtatacattcttctcagcaccacatcacacatattctaaaattgaccacacaattggaagtaaaacactcctcagcaaatgtaaaagaacagaaatcacaacaaactgtctctcagaccacagtgcaatcaaactagaactcaggattaataaacactcaaaaccacacaactacatagagactgaacaacctgttactgaatgactactgggtaaataacgaaatgaaggcagaaatatgttctttcaaaccaaggaaaacaaagacagaacataccagaatctctgggacacatttaaagcagtgtgtaaaggaaaatttatagcactaaatgcccacaagaagcaggaaagatctaaaatcaacaccctaacatcacaattaaaagaactagagaagcaagagcaaacaaattcaaaagctagcagaaggcaagacataactaagatcagagcaaaactgaaggagatagagacataaaaaacccttcaaaaaatcagtgaatccaggagctggttttttgaaaagatcaacaaaatagactgctagcaagactaataaagaaaagagagaagaatcaaatagatgtaataaaaaatgataaaaggggtatcaccacccatcccacagaaatacaaactaccatcagagaatactataaacacctctacataagtaaactagaaaatctagaagaaatgggtaaattcctggacacatacaccctcccaagactaaaccaagaagaagttgaatctctgaatagaccaataacaggttctgaaattgaagcagtaattaataacctaccaaccaaaaaaagtccaggaccagacagattcacagccaaattctgccagaggtagaaagaggagctggtatcattccttctgaaactattccaattaatagaaaaagagggaatcctccctaactcattttatgaggccagcatcatcctgataccagagcctggcagagaaacacacacacaaaagaattgtaggccagtatccctgatgaacatcaatgtaaaaatcctcaataaaatattggccaaccgaatccagcaacacatcaaaaagcttatccaccatgatcaagttggcttcatccttgagatgcaaggctggttcaacattcgcaaatcaataaatgtaatccatcacataaacagaaccaaagacaaaaaccaaatgattatctcaatagatgtagaaaaggccttcaacaaaattcatcagtccttcatgctaaaagctctcaataaactaggtattgatggaatgtatctcaaaataataaaaggtatttatgacaaatccacacctaatatcatactgaatgggcaaaaactggaagcattccctttgaaaaccagcacaagacaaggatgccctctgtcaccactcctattcaacatggtgttagaagttctggctagggcagtcaggcaagagaaagaaataaagggtattcaattaggaaaagaggaactcaaattgtctccgtttgcagatgacatggttgtatatttagaaaaccccattgtgtcagcccaaaatctccttaagctgataagcaacctcagcaaagtatcaggatacaaaatcagtgtgcaaaaatcacaagcattcctatacaccagtaatagccaaatcatgagtgaactcccattcacaattactacaaagagaataaaatacctaggaatccaacttacaagggatgtgaaggacctcttcaaggagaactacaaaccactgctcaatgaaataaaaaatgacacaaacaaatggaagaacattccatgcccatggataggaagaatcaatatcatgaaaatggcagtactgcccaaggtaatttatagatgcaatgctatccccatcaagctaccactgactttcttcacagaattggaaaaaactactttaaagttcatatggaaccaaaaaagagcccacataaccaagacaatcctaagcaaaaagaacaaagctggaggcatcacactacctgacttcaaactatactacaaggctacagtaaccaaaacagcatggtgcttgtaccaacacaaatatatagaccaatggaacagaacagaggcctcagaaataataccacatctacaaccatctgatctttgacaaacctgacaaaaacaagaaatagggaaaggattccctatttaataaatggtgctggaaaaactggctagccatatgtagaaagctgaaactggattccttccttacaccgtatacaaaaattaactcaagatggattaaaaacttaaatgtaagacttaacaccataaaaacccaagaagaaagcctaagcaacaccttcaggacataggcatgggcaaagacttcatgactaaaacaccaaaaacaatgacaacaaaagccggaatagacagatgggatctaattaaactaaagagcttctgcacagcaaaagaacctatcatcagagtgaacaggcaacctacagaatgggagaaaatgtttgcaatctacccatctgacaaagggctaatgtctagaatctacaaagaacttaaacaaatttacaagaaaaaaaacaaccccatcaaaaagtaggcaaaagatatgaacagatacttctcaaaagaagacatttatgcagccaacaaacatatgaaaaaatgctcatcatcactggtcatcagagaaatgcaaatcaaaaccacaatgagataccatctcatgccagttagaatgatcattaaaaagtcaggaaacaacagatgctggagaggatgtggagaaataggaatgcttttacactgttggtgggagtgtaaattagttcaaccattgtggaagacagtgtggcgattcctcaaggatctagaactagaaataccgtttgacccagtgatcccttactgggtatatatccaaaggattataaatcgtgctactataaagacacatgcacacgtatgtttattgtggcactgttcacaatagcaaagacttggaaccaacccacatgtccatcaatgatagactggattaagaaaatgtggcacatatacaccatgaaatactatgcagccataaaaaaagatgagttcatgtcctttgcagggacgtggatgaagctggaaaccatcattcccagcaaactatcataaggacagaaaaccaaacaccgcatgttctcactcataggtgggagttgaacaatgagaacacatggatacagggcagggagcatcacacactggggcctgtcagggggtggaggggcttggagatgggtagcattaggagaaatacctaatgtaaacgacgagttgatgggtgcagcaaaccaacatgacacatatatacctctgtaacaaaccggcacactgtgcacacgtaccctagaacttaaagtattaaatgtaaatatatatataggtatatacatatatatatatacctatatattaaagtatagtatatataagtatatatgtatatatataatatatgtgtatatatataaaaaagtatatatatgtgtatatatataaaaaaggtatatatatatacacctttttactaagaatggtttttaggtagagctagggcagaagagaccaatcaggagagtcaagcagccattaccttaattcaagtgagaagtgatggtggcttggctcagcatggcagtgacatgggtcctaagatagagtcagattgggattactcacccctgtaatcccaacactgggaggatgaggcctgcagatcgcttaagcctggcaaatcgcttgagcccagaagtttaaggccagcctgtgcggcatagggaaaacctgtctctacaacagttacaaaaagtatccgggtgtggtggtgcatgcctatagtcccagttacttgggaggctgagatgggagggtggtttgagccttggaggttgagcctgaagtgagctgagattgtaccactgtactccagtttgggtgacacagcaagaccccgtctcaaaataaataaatggaagaactaatataagtgaatgatactactatcatacatagaaagatagaaaagaagacagactaagatggaaatcaggaagaacagaagtagaaccatattattgctacattatggaggaagagtggaaggatgatgaatgatgtaaggttctacaataagatcaagaactgagaaaagattattagatctggcaactggaagtcatcaagctccagcaagtagttttggtaaagtggagaagacagaaactgtagcagaggataaagggtaaataaagtcagaagatgtggaaaaagaaaagattagcagtgaatggaaggagggaggaaaagaatggccaaattgagtgatcaagttgttgtgggagattgtcagttttttgttttgctttgtcttttcagaagtgaggagatctgagaatgtttttaggctaaaagaaaggagtcagtagagaaggagcagttataaataagggaaagataggagttaaatgatgaagaagctactataggaagtaagagagggtgtgatcttacggaacctggcaggtaaaaaggaaggacggttttttatctgagtcaaaaggagaggaaatcggtaatgatacaaagagatttttgaggagaagcaaaattgaggtcctattactttagctcttagagcaggggttggcaaaccgtggcttgtgggccaaatctggcctgctcctatttttgtacagctcacaagctaaaaatggtttttatacttttcagttgctgggaaattaaaagaatgttttaaaaattgaaataatctgtgatgtgaaaattatatagaattcaaatttcattaataaagttgtattggagcacagccacacttatttccatacatattgttatggctgcttttccactgtaacagtggaattgaatagtttgcacagagactatatgtgaaattccgatggcttcacttttgctctgcccactacaaatttcagtaacttagttataacttgatagcatgatgagtaatatatacattgttatactacagtgggttttttttgaaattatgaattcatatatgacacacaagaaaaaagtgtactttgagtgtcatattttcaaggcacagtatagtatgaattatttcgttattgaattagatagtaaaaaaaactgtatttattatacaatgacactatagctatgttaaatggctatactacatatcagcattaccagattgagcactcatcacagaaaatcaacagtcaaaaaaattagaaaatttaaaatggaattctcatcacagcagaatttccgcatcaaaataaaaataaaataaaatgaggctgcaaccaaaataagttcctgagaggttcatatgttacccaagcaaggaaacctgtttactcatggtcattgcaacagccaaaaaaaatatgtccagagaaagtaaacttgtttaagattattagcttctcagtgagaacagttccttgaagagttgatggcattttgaacaacatggccaacttaaaataagacaaatgatttgaatgtttttccttggctcatcatgacccaatggatattaatacttgctaaatctgttggctaaatgttgtcatcatgggagtgagttcattatctcgagagtgagtttgttatacaagctagtttggccctcttactctctcgcatgcactcttttgccatgtgatgcctcctgccatgttatgacacaacaagaaggcccttactaaatgccccttgatctcggatttcctagcccccagaactgtgagcaaataaacttccattgtttacaaattacccagtctgtagtattctgttaaagtagcataaaacaaagacaggctgggttcggtggctcatgcctgtaatcctggcactttggtaggccgaggcgggcggatcatgaggtcaggagatggagaccatcctggctaacgtggtgaaaccctgtctctactaaaaaaaaaaaaaaaaaaaacaaattttcaaaaaaaagacagtactgcttagttgtttatttgagaaatcaatggtgaattggaaatgactgaagaattagcctctatgaatagtcatggttcaactacagacaagaacattttcaaagaaggtgaaaacactgattccgtacaacctgaatctgctaagatgtgttgcacctgataatggtgaaaattctaggtggagcaggaaaaggcctagttggacaaaagttacaaaggttttgaaaatacagtttttttgtttatggttattcattgtattatcagcagccacattgcagaaaatatttgaatttatcatgtgttattgaactagtagtgtcaaggtaaagtttattcactcttgtgacataatcattgtcagttttgtgaatttttgtcagatacagaagctgaagatcccgacttgccctaccgcatggcaattcaatggcagaacaaggtttaagttttattttattttttttgagattgaggccaagaatgaaatttttctgaacagaactccttttcagctattgttattaaacccattcagctttggaaatcaccttttactgcagacttagttaaattctgagttctttttggagacagggtcttgctttgtcagccaggctggagtgcagtagcgtgatcatagctcactgcaacctcacactcttgggctcacatgattctcccacctcagcttcccaagtagctagtactagaagtacacaccaccacacctggccaatttatttatttattgtggagacgagattccactgtgttgctcaggctggtcttgaactcctggcctcaagcaatcctgccttagcgtcccaaagtgctgagtgagattacaggcatgaaccaccatgtccagcccagacttagttatattctttgttgttgttttctttttgagacagggcctcactcagttgcccaggctggagtgcgtagtgcagtctcggctcactgcaacctctgcctcccaggttcaagcgattcaagctgagactataggcgcgtgccaccacatctgcctaattttgtttatttttttgtagaaacaaggtttccctatgttgcccaggttggtcttgaactgctggactcatgcaatttcccctgtctcagcctctcaaagtactgggattataggcatgcgccaccatgcccggctaattttgtatttttagtagtaatggagtttctccatgttggtcaggctggtctcaaactcccgacctcaggagatccacccgcctcggcctcccaaagtgctgagattacaggtgtgaaccaccacgcctgacctatattcttaagtaattcaaacggaaaccacaaagcagaacagtgcttatatgcaaaacttatgctggagtaaagttttgacaacacctaatacagtttgactcacaagtaatgtcacactgctttatagacctctcagactgtcagaagttaacacaagcagtatctccattcccacgcaagttggcagcagatacattttccaagcttaagctattaatacaatgccagagcattttttggacctccatgcaagcacaaaggaaatttccatatttcaaaatccatttaactatgcaattgaggaacttccacttaatcttcatttggaagtgattaatctgcaatgtaataacatggtaaaaggcaaatatcaagagaagaatttaacagaattatattctggcctattactctcccaactaataaatatgctcaattaaaaccacatactcatagactcatattaggatttgacattacctatctgtgtgaaaaggcattttcaaaaatgcagtacctcaaattttattacaaattagaattagcaagtgaatatttataattgatttccaattaagtgaaatatccttcccccaaaatatttcattcttctaagtaacttccaaatagacctgtattaccaaaaagaaacatggttattatatttttaatcttgtcaataaatttatggaaattttgtttcctctttttataaaagtaattgcccaatatcctgttttgcctcttggctttcaaagtctaaaatattaactatctgacccttttcagaaaaaatttgccaacccctggctcacggtaagagagcgggaagttggagcttaaagaaaggaaaaagttcataataggtatctttagtggatctattgttgatttaacatagtattcattatagtttttacttgggaggggaggacttttctcttggcaaatttatgcagtttgcaagccatagccagtgaaatatctgcatttttcttttgtaaattttattaacctaattttaatttggcttatagacagcatcaactgggcaagtggtgaggatgaccatgtagttgccagagcagaatatgattttgctgccgtatctgaagaagaaatttctttccgggctggtgatatgctgaacttagctctcaaaggtaataaattatgaataagttggaattatctgtaaattttgatattcataaatgcagtattaaaaactacaacaaaggatcttgttcattgttagttaacttagagatagttactagaacttctttttcatgtcaatttagagcttccaaatctggaggagtcaggaagaaatgccccagcagagttattcgaatactatttcactgagataaggaaaggctttgtttatataggcttttctaaactcaaaatacttgaatttcaaactgttaatccccacacaaaaacgtgatgtcagtaactaaacataacaaatctaataaagcaaaggaattatgtaacatcatctaagcattgctgttagtccttgtggactggtgttgcttctttattacttcagcagtgtttacctcagaaatttcatcataagtattttaggaaatagtgtcatgaagtattatagaaccccagcaagagatttatacgcatctcgggtttatttttggaccaagtcactgatactttttaatgactctaggcaaaatgaccttttccttcacccttcctgagtaatgattatcaggatttttatggatttttttaaatatgtgtatttatggggattcaagtttattgcaaaaagtgatgttttgttgataaaggtactaataacaataacatgttatttattgagtacttactatgtacaaggtactgtattttacatatttcatttaagccttacaataatacggtgaagtggtactattattatcctgtcattgttttacccttgaagaaactgagactcagaataagtaaattgtccagtatcacaaagcaaaggtgcaatagaactggactatgaatctaggtttgtctaacttgagaccttgtgcttttaacaactctggctgttttttcatggaaggatctatttatggaaacttcaccctttttttggttttagtcattttttgcagggaagaaatactttcaatgttcaaatcattactatgtaaataattgaaaattttggatgagattactaaatctttgcctcatcccttttacaaaaaacctagacttaagcgaggtgcagtgtgtgcacctatagtcccacctactcaaggggctgaggcagaaggatcacttgaggccaggagtttgaggctgtagtacattgtaatcacacctgtggaacagcaccactgcactccagcctgggcaacgtagtgtaaccttgtctcaagaaaaaaaaaacaaacctctagacttttaggtattctatttgtatttttctttcttttttttttgttttgagacagagtctagctctgttgctcaggctcgagtgcagtggcacgatcttggctcactgcaacctccgcctcccgggttcaagtgattctcctgcctcagcctcctgagttgctgggactacaggcacatgccaccacgaccagctagtttttgtatttttagtagagacaggcgttcaccatgttggtcaggctggactcgaactcctgaccttgtgatccgcccgacttggcctcccaaggtgctggaattacagatgtgtaccaccacgctgggcctattcatatttttcttatagggaaaatagcaatttactattttggatttcaaacgaatgattttttaaagatttgttgttagagacaggaacaacacagataattttaattagaggtcatgtggtttctttcagttacataacacttcagaaaaattttatatttcattattcttcaatgaatagtgcctcttaacactagcttgcttcttggctttcctccattgctcaagaaaagtatgtttgggcctttggaacaaaatcggtcgtagacatggtaaatttgttttttcctgttattatagagcattaaacattaaaaagtcttatattgtgcctaaattataatgttgaactaaaattgtaacagttaagcagctttttaaagatatagataaaataggaaaatacaatagaaaattgagtacattaaataatctttctttaagcttagagtattgcctttatttatcatatggctagaaataacaaaggtcttcaattttttgcccatcttggattgaaattaatatttactgtcttcaggattgtttattacaatcacatgaaacgaattttatatttttgccaaaagtaggctaagaaagctgagtgcattaaaggtatatcttttctatacttattcctaacttacccagttgagaaggaataagatattcattttttagactccagtttaaaatatgaaagacattgatgttagttttcagttttgagagaactaaatctccctactctatgaatggaccaactgataataaactttatgttcttcaaggtggaaggaaatatttagtaagtataaaataaaaatagaagaatggaccctagaactgttaagcctactcagcatttgattttgaatatatatgcatgtactatttgttatctactatgtaagcataacagattttcctgaatgtgatattttaccattactattctgttggacctccaaagtatattgtaattacaagactgtcttttttttccatcagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctacattaattgacttggaatccttagaaatggagtggtgacatgtcagtatgagaacaggcaaaaggtaaatttttttttttttttacaaccttaagtaatctcaataataaaattttctgatctgtattatatccagtgttgggtttatattttcacccacaaacaactgacactgctatcttttactgtatttttaaaaatttaatttgaaaaggtcacccagaagcattctgaaggaaatggttctagaattatagagtatgtagccctaatagttttccctcctagcaaaaagtctgaaatttatctttcttacaaactgttccatttcttctaaggatcccttaattatttatctctttaagccaggcatggtggctcacgcctgtaatcccagcactttgggaggctgaggcgggcagatcacctgaggttgggagttcaagaccaccctgaccaacatggagaaaccccatctttacgaaaaatacaaaattagctaggtgtggtggcacatgcctgtaatcccagctactcgggaggctgaggcaggagaattgcttgaaccccaggaggcggaggttacgctgagccggagatctcgccattgcacttcagcctgggcaacaaaagcgaaactccatctcaaaaaataaaattatttatttctttaaaatatgactagttttcatactgggtgaatcagaagtatatgaaaggtatactttcttttcctacaacaaatacttgagttcttttgagtttgcacttaatgatataatcagttataatagtaatttttaatattttcatagattgtttgcttctaccttgtgtaattttttaaattccatatttaggatgctctgtaaatattgaaaatgtgtcacattggatacatttttcttttaggtttagtttttactactgagacttatttatagtcttagtgctctattgccatttagaatatgataatcctcatgcctttaatctcagcactttgggaggccaaggcgggcggatcacctgcggtcaggagtttgagaccagcctggccaacacggtgaaaccctgtctctactaaaaatacgaaaattagctgggtgcagtggcgtgcacctgtagtcccagctactcaggaggctgaggcaggagaatcacttgaacccgggaggcagaggttgcagggagctgagatcatgccactgcactccagcctaggggacagagcaagactctgtctcaaaacaaacaaacaaaaaataataatacgataatgctatttgacgtgttttttggtttataatgattttaaatgcagttaactttcagtacactgaatatttccccagaaaattggaaacttcatatacttggctacgaacatactacagagtaatactatcaggaatacaggtgtataagaatacatttatagatattgttgaaaactttgaactgtttgataaaaattgtgatttagtattttttcttttgtctttttttgaaacggagtctcactctgtcgcccaggctggagtccagtggcgcgatctcggctcactgcaagctccgcctcccgggttcacgccattctcctgcctcagcctcccgagtagctgggactacaggcgcctgccaccaggcccggctaattttttttgtatttttagtagagacggggtttcaccgtgttacccaggatggtctccatctcctgacctcgtgatgagcccgcttcggtctcccaaagtgttgggattacaggcgtgagccaccgcacccagcgattt

SEQ ID NO: 17070 - DNA, 60589 bp, Human
  misc_feature (1)...(60589): n = A,T,C or G
cgccaagacatcaccctccattgctctacgttaaacttggggtttttcttttcatattattatctcctcaaggccccttggtatcaaataatgatttagactcttgtcccaaggagtctcttctacttgttttatattccctttattagatttaatagtcaacaacagtgtccacatgtctcaaaaatgataattaattgatttgctgatgtttactcagtcaatagatggcggaacttggacagtttgtttaactcattcagtatttacagatgtctatgtgcctgacattgtgcttagtgtttggaaggctgaggcaggaggattgcttgaagcaaagagttcaagaccagcctggacaccaaaactagaccctgtgtattcaaaaaatttaaaaactagctaggcatggtagcaagagtctttagtcccagttacttaggaggctaaggtgggaggatcgcttgtgcccaggagtttgatgatgcagtgagctataatcatgccacttcactccagtctctggtctgggtaacagagctagactctgtctcaaaaacgtgtgtgtctgtgtgtgtgtgtgtgtgtgtgtgtgtgtgtgtgtggtttagagccacagctttcaaacttttttgattatgatccatagtaagaaatatagtttacctgatgaccctgtgcacacttacatattgataattaaagtcaaaatttcagaaaacaatactttttacatccgatgcacttggatatttgtctattctatttattacattaaaaacatcaggtcataatgcactgcattgactttacaagccagtaacaggggttgatcaaccattgcctaaaaagggtatataaagagggagtcatttaaaacaactaatttcagataacagagaaaattatgagagtactgttcaattccaaattcagagcttttcttacggattattcagtgccactttttttaaagcttggactcatgcctaccttttaggcatttacatttacagattaacttatcagcaccttgggccccgacaagataagacacaattcaggtaaattttggtaaatattccttgagtgataggaagcaggaaaagtttgaaggagaaggaaagacaagcctaggcaaggatggctatggtggggaggtacaaagaattacaaagcattagtcatccaagcaaagtataatcagaagaccactgacagaattaacagagttcagagataatatcattatactcaatccctactaagattttggtgtttggtctcctagatcacttttttagtaccttcacagacatatggattcataaagaatatatagtaattattcatatttgttttgatttatataaacagtaatcttgtctctcagctccagaaaaccttgcctggtgcttcctgaaggctcacaacatcccagcccggcctccatcacttacttataatgtgttttggggtcttgagggcagggagctttctctttcttctctgaattcctagcatccagctgagtgcctggcacttggtaagtattcacatacacattccttgaattccctagatttcagtttccttcactgtgaaacaaagtgggctaaacgatctccaggagcccttacagtcctaagaatctatgactttgaccgatctgaagtggtccaagacactttgcttcacaggaagctcacatcttccttgtgattggcctgagattaggagttcaaacaaccaatgacctgtgcacagtttagggcctaaccctgccctggccggttagcaagagagtgttgtgataagagcagatgaaagccttatgccacagtagtgcctgtagcagagaaaggattccctcctccacctcagggcccactgctgctgctctccagcctgcagtttcctctaaggctctggattggctggaagagcaacagagggctgggaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaaggtgagaaccaagttatttttgtttaagagatgcagatatggagaatctttactcaagggaggctgcccagtggtaacagaggtattgtagtttatggctaagctgaggtgaaacaggtgcttgactgtagattgggtattatctcttctctgtaaacaatatagagattttgaaagatccaagctaggagattaatacaatatagagtatttcatacatcatttaatatccagaacatcatttccttcaaggagatgcctattctataagtccttatttagagtaaaaactgtatggttaaggatatagattccaacattaaactgtctagattagaaccctggctctactacttactatttgtgtaagtactatttgggcaatttatttaacctctatgtagctcagtttccttatctgtaaaatggagataccgagagttctctacctcacaggctggttatgaggactgaatgaattaatatatatgaagcactcagaaccatgtctggcacctagtagactgtataaatgttaatttttattaatgtacagggactgggagagggaggcaagtttgcagtgaggaagaggaaatttcccattgttctttgttctctgacctcattagatagaagtaactggatggctagacagagaaaaagcccttgggacacaggggttatttattagctagcattctttttcagacaaatgcatcaaaatctttgaggctccctggttgtccgtaggctggacaatattctggagagaatcctaggtatctaggctaagcaaatagaagaacaaatatcttacttgttagaaaacttaacccaaccatcctctctgatggagagaagtagggatgtttctccttttattgagaatggatttgattaaattgggtttgatccctcgttatttaaagtaaataaagaagatccttgcacagatgttcagccctaaaggcattagcagtgtttgtctcggaagattttattgtttaaagggccatctatgacttctgtctcttacaagttcaggtcttctttttgatgccttccactctagaaataacctaaaaataatttttaaggagataacattgtagcatataattttttctcccaacaatactatctagtaactgaatatgaaacctccagggagacttactctctgaattatggcttccaaacttttttttattatgatccatagtaagaaatatagtttacctaatgaccttgtgcatacttacatattgataattaaataaaagcatagaatattattattgttttttaaatttacataaaagaaacttgtagctgttaagttgtagaagttagattgtaaataagggatcaatattgtctattgtaccaaccctggggaagaggataggttttaaaggtggatactatttattgctattagcctgttctttcctcttacctagtatatagaaagcctaagaaatagggaaagttttctgtgcctttccagaaacgcacagaaaacttgaatatgggacaatgtataattatttcctttgccatttttgcaactatgagaattgcaacttgactttaatggatgcttttagcatacttattgtttgaaattgtgtactcttatgtagtgaataaatcttattaattggcaaacaattgactttagaatgattgtaacatcagtttgccaagcattttgtgattctatgacacattgcttggcatttggtgagaaatcaataaaatttctgttgaaaatttgccatgttaattattttgctctatgttttctcataagtatgcataatattcactgagatatatggatggaacatttctttcaatgattcctattactgtattatatctgattcactagcaacattaatattggatcactttattttttgatgcacagtaaattcttatgcaccaggatataactaatgttcatgtagaatattgaagagtggtgagtggtaaaggagtgagcttattttccccataggttgactgagtcttttatttattgggatgtggtagaatacgcaattattgtgagctattacatattgtttcataatctgttctcatcgtaaatagggtcattgtaatttctaattaccatgctgcctgagaagaatgttttggagaaatggaattgtggagctgtgaagctgttagtacttacccatggaaagggtctaacactgtctattctaaggggaaaatgacacttgaataaatgcttccaaacctgccttccatggctctattatctgactcccaccttcctcccccacacaggctcctgtctttgcatttcttctctccaagccacaaaaggaacatggatatgcttcaatgcttagataaaaatatttaaaaattcatataaaataaattagggcaacaaatacacattatgaaaaatctgctttaaatgaaaagctctgctgaagagttcagttctgacttccatatggcattagaaatataattcactttacaaaagtctgaatagcatatcattatttatcagagtggaaagagtactagttaaggagtaaggtgcagactcaattttgtcattatctgaatttgtgtccctgagcaaattatttcacttccccaggactctatttgctaatttaataggtaaaagttggattcattgttctctaacatgttttcgagttctaacctaatgtaaacgaagtgaggtacacttagtctcaatgactactaagagatgtgattaaaggaaaattttcctatttttctataaaagtttgagagcaggtggggcatggtggctcatgcctataatcctcgcactttgggaggctaaggcaggaagatcccttgaggacaggagtttgaggctgcagtgagtcatattgcaccactgtaccccaacctgggtaacagagcaagagcctgtctctaaaaatcaattaattaattaatttaacataaaaataaagtttgggaggaatgaagaatcaaataatgaaaaataatcaaggacccagccctgtgctgaaaccactgggccatggcagaagcaacctgctcagtgattctaatgctgatttataagaaagcaattataagaataatttgcttcctgtaaggggaattgtttttgacagcaactctttattagcaaagaatataaaataaacttttttttaaacaacaaaaagagaagtttttttccataagattaaagggtggaatatatataatgggtaaggatatccaaaaatctgccgcataaagtaagaaaatttcaacaattaacaaagattaacttttccatgacatgtaaggagaaatctaatcctagaaaatattcctttctgaatgtccagggaagctttcagccaaagtcaactttgatatatttgtataaactattctttatttatttagatttttaagactattgcttattgaaattttaagtaggactcgcatacttttatatgtttaaagaggcaaataattcaaacatttgggcaatgaataaccataagcacagagtttctaccctctggcatattgaaacctgtactatatgggtgagaatcttatactgtcaatgaaaaagaaaagagtcgcgtcaatttaataccttatttttacccatgattttcaagtttgaattttaggcttcttttgaaaatttattttattttcagagtctgttgaatttctctaaacaagtttaaattttaaagtaaatattgctctttgggaaaagatgaatgtattatgaaacaaaaaatgttactattggccaggcacattactcctgcctgtaatcccagcactttgggaggccaaggtgggaggatcacttgaggccaggagtttaagggcagcctgggcaacacagggagaccctgtctctaaaaacaaacaaacaaacaacaacaaaaaataaataaataaaaacaccacaaatattagccaggcacagtggatagcacctgtagtgccagctattcaggagctgaggtgagaggactgcttgagcccaggagtctgaggctatagtgagctatgattgctactattgcactccagcctgggtgcagagtgagaccccatctctgaaaaaagaggattattttaaaaaactgataatactaataattgaactggttgctttatgttatgatgacaactttgatttttaggcttaaaactgtgtgcttatggttattcattgcccaaaagtttggattatttgtttctttaaatatataaaagtatatgaggcctccttaaaattttaatgagcaatagtctcaaaaatctaaatatcatcataatataaaggaaccagtgcagttattagtattttaaagagctacaagccctttgctactctgggtgactggcatagatctgatttctgtttcagactgagaagggctaagggtataatgtgtttaatccacagttcacacaggggcttttggccatctcaagggtgtgtcaatgctaggaatttcagaagccataggaagtaaatgggaaaggtaattttcaaacatttattatttttaaatttattttaaatttttgtttttaaaaattttgtttttaaaatgtattattattttacaaaacaatcatttttttccccatgttctctgatttatgtgggtcaagtgtggacaatttagaatagaaaggcagctaataagcaggactactaatgaactaatctgaggttgttaaacctttaaaagcactagagtgagtcaaggttcctgggttttcaggattaataaattcaaaggcataagcacatccttgggctaattgtagagaaaaggcaagcaccaagtgaattaaagactggcaattagcttgaacaactgatagctcaattggaatgaattgaggaccatcaaagaaacctgagagaggtcctagcagagcttctggttgggtttaggatcatgcttgctgagaataagtatgaatttcaagcttactatacctgatattctagagatgtcattgaaagcattgtagtgaaactttagaatgttaagaaagtgaatgaactatttaataaaatttggagggggatcactaagaaaaacatttattttgattcctactgatgaaacaatatcagtgatttctctagattgcctttcaaacctgtgtacttgccttaggcatatggatgaaagacccatgccctgctcccatggaaatttaagcccagttagggagataaataagaaaaaattaatgctcagtgttgcaatccactacgaaggaatatatccataaagtgccaagaagcacagaagttggggtggtaggcggggcccctagagcttttagtgggcagggaagaatttacaaggttatacggatgatgcttgaagaaagtctaagaggacagaggagttagccaggtctagacaggaagaggagagagaaggaaggccatctaggtgaaggggacaggcctgtgtgtgcagagacccagagatgggcgggcacagccaatttggctgatgttgtgacatctatgtacaacctgtattatctctcagaggccagcaaggagggaaaccgctgagtttctaaccacagttaacctcctgggcagcaagtcctgcatatggttctctgggaacttctccagtgctcatctgttcccaactctgaggatggaagagatttattcaggggaaagatagtcctccccttcacctaaatgattttattactaaaaggatagactgtatttggtatagtagacaccaaataaacattttgttgaaggaatacatgaatgaatttacagcaaatagagacaagagcacttctaggacagcttggtattttctctgctttccttgggtattggggagaccaagaacagtatcagtgttgacattttaggccacaatcggaaaaagagtgtgtgttgctaaataaagagaggtgcctgctatgggagaaggggagtggggattaggagaaaaagaaaagtgaaggagactgtctgcatttctataatgaggaaagccttgttaaagaggtgagtcttcttttggctgcaatgatggtatcccttaggtgagctctaggaagttgtactgcctgggctgttcctcatgcagttactgttgaagcttctttagtgaattgcattctgtattccagctagttgcccctttctattctttctttcatttagtctgggttatgctgaatcaccagatatcaattcataacacttttagatcccagaatcttacattttgaaacatcccagaaaggttatctaatttgtttctccttctctagcaaggactacacaatattacgggatagatgatatctagggagagagtttatttatgtctctggagccattgttaatggtttttgtctgtactgctggccagagagaaaaggggctaaattttaattaattcagtcaggatcagtcattagtaacaggaaccagaatatggctggaggccagaagataacagtttcctatctctttcctcccttaaagttctaatcagttctcagataacattgcatctgcactactttgaaggctgagtcacccagaggataaagacagtgaaagcctgattgtttctaacgatcgaggaagttactcttaagattacaggattcaggaataggaaagaaaatgttcacagtaaggaaggatgtgagctcacagtctctcccctgcctcaagaccagcgcttgaattgcagtgtggcggggtagaaagaacagtgctcataacttcctctatttcttccttactgtgtgaactttgggaagtcaccaaacctctctgaacttcattttctcaggaagtgctaaaagaaataaatgaaatattatatttaaggtgactagtttttagtagaaggacccctattaaacaattattttccttttatctctcttttcccctttgtaggcagtgaaggaaacataatttaagtcagtcaattatgtgctaaggcctttgataaaacttactcctttttatccttcctcatcataacctcatcttttaaaaaaaaataaagataaattttaaaaatggtacagtatttaaaaaatactttatccataattttttcaatatatatatattttaaattattattgttacttttgtttcagtagtttttggggtacagttgatgtttggttacatgaataagttctttagtggtgatttctgaaatttcagggcacccttcacccaagcactgcaccctgtagcctataggcagtcttttatccctcatccccctttcacccttgccccctgattccccacagtccattatatcactcttattcctttgcatcctcatagcttagctcccacttataagtgagaacatgcaatatgtggttttccattcctgagttacttcacttagaatgatagcctccagctccatccaagttgctgcaaacgacattattccattcttatatacaacatggtatatgtataccacattgtctttatccactcactcactggtcgatgggcacgtaggttagttctatatctttgcaactgcaaatggtgctgctataaacataagtgtgcatatgtcttcatataatgacttcttttcctttgggcagacactggattgggattgctggatcaaatggtagttctacttttagttctttaaggaatccctatactgttttccatagaggttgtactaatttatattcccaccagcagtataaaagtgttccctttttaccacatccatgccaacatctattgttttttgactttttaattatcaacgtatatttcttcttacaaaacatatcaagtctttacaaaatgataaagctcattaaaaaccatgatcatacttaaaagttaacaataattctataattcattgaatatccggtaagaatcgaaatattttcaatgctcttttctcaattggattgtttgtattaggatccaaaaatgttcacacattgagatttcttaatcttatatctctctcagtcaataggcttcctgtttattctttctttgcaatttatttgaaaaacacagtctttttagacacaagtataagaggctatataacatgtgggaaaggtactagatagggaatacaggcacctgagctgtaacactggcttctactacctagtggaggataagtcatgtgccagttcccctctccaagtatcactattacatttgtaataggacgtgatcaattatatggtctgttatactccttccagctccaacactttcttattctgaattgggacaccatgtattttgagaaaatattccatttttattataatttcttatctcatctaagtcatataggaaggcctgggaaacaaactcctgaatgtagcttaaaagatgcaatcaattacatatgtgcaattttcttcccataatgtttaaaaatctcagtggactcaattaagaaccccatatttctttaaaagacttgtgataagttcagaatatactcccagtttgtgaaaagtatatattaatatgcagtggaaagtgattctgttttattttggtgaattctatgaagaaaaagggtggtctcggtttcttgtacaatttgaggatgaattagaatctgaatctaacagtgtatgatgcttgcactttatttacagttaacttcattttttcctcttcaagtgtataatgtcactgagggcaagataaaaaagtaaacacagacgcatgtgactttgggggtgtggcaccactgactacatttatactacactacattttctccagtgggaaagggtggcccactcctgcccttctgaatgttgcttagaggtaaacttgtcatttgccttaacagtggaaaagttttcatccttgaggatgggatgagaagggtatgtcagggtttccaggtctttacataattaaccaattttcatctgccatctgggtagatcatggagtactgacaattcttggaagtgctatgaagactgctgactgcataaatccatgtcaggcgtgtatatgctcagcaactgcaaattccaaccagattaggaacatatagtttgcctccagactaggcattagaaattgggtctttcctggaaaatctgtaggtgtgatcaacctaattataggatgcatgcattatcaacacagctaatccatgtgcgtttttaggcttatttaccctgaccatagagctcctgaaaagtccaaacagagtatttatttgcaaggcattccattcagttgccatgcctaggtagaataacttaacctgaatttttgttctccttcaaaaagaaaatatttcagtgtttaaaggaattggccaagcagcttttgaatactttggacagtagatacttgatgaccatgttggtttcatgaatagtaaatgaggctaagacctttattctatattctccatgttttccttcctaactgtttccccaggcgctgctcaaaacagcacctagcccatctggacagatcatttagagacttaaaactctacattctagaaagacattggaactatcatattagagtcagaagaagaaaagcaacacgaaataaagtacttgtaaaaatgtgaagtgctctcctttgcaagtgtttgttattattagcgaagtatgtggagctgttttggtcaagcttccactttttgatattttcttgtgccgaacatctgtttcttgatgaggcacttgtctatgggattcaggaagtttagaaagaatcaagatgttccattaaaaaatagcttcctgtattttggcaagttattttaagtgatagtttatgagagatatccagtgaatgggagtgtgagaccacataacctgtgtacttgggacaaggtcaacagtgcaggtcacactgaagactttcccagaggatctggtggtctgatgcttgctggatgacagactttcagagtcttaaatcttgcttctgaatcaccgaagtgcaaaacaagatgtcatttgaacacacacatgcatgtgcaggcatacacacttacacacatataccctcaatattgtttatgacttggataaaagatggattgtttgttgaaatcagagatttgtgcacacaaactgaaagtgtacctgggcctggtaggaagaaacatttttctttcacaaagatgaacgtagattgatgggaattttttccactttaaggcgaataggtcttttctatctccatagtttggattttatactaagtgggaaaaacaaactttttctctctcctcacacaacacttcacttctgacacccaatgtgtgggatttccccaccaagaaattctccaacattttgtaggcaccaagggtgtgttctacaattcaattcaactctgacactatctacttggagttaacgtcatatcccataggttaagggctcagccccacaagactgccccccacttcagatgccagttgtaagttcagctataaattggggtttcctgtaatcccttctttagcttcaataatttatataatgtctcataagacacgggaaaacatttttacttttactgatttatcgtaaaggctattgcaaaagatacagttgcaaaggatacagttgaacaaccaaatgaggaagtacatagagcaaggtatatgggaaggggcacagagcctctgtgacttcttcgggcacaccaccctcctagccccttgatgcatttttgttcaccaacccagaagctctctgaaccctgcattttagagatttttatgggggcttcattacttagtatatttgattattaactcaagcttcagcccctcttctctccccagaggaagctttgttgaaagctccaagcttctcatcatagtttggtttttctagtgaccaacccttatccaggaggccaccaagagttgcctcattagagcaaaacgtggtcctcttacccaggaatttccaagggatttaggagctctgtgtaaagaaccagggtcagaaaccaagtattagaataaaaggtgctcctagcaccattatcactcaggaaattagaagagttttagcaactttgtgccaagagtttatggccagagaccatgggttagactatggcataataagaaacgcactcatgaaggcagtaagccagcccttcacaccttcactgctcccattttagacaaccaatgtttcagttacttgtttcacttctccattaaactgttactctgaagaggatatctatctgctcattgttggacattacaggctatactgtgtgttccttggtctgaataaatgatggctggctacccaaattgctgcactatctttttttttttatagcattttgagcatttgcatctgacacttcataagcaaaacgcactctagggtcagtggctattcctgtcaagacccatttgtagccctccaaggctactggcgtcagtctcacttgccagctatgttcctgcccttcccacccaagaatctgccacatagccatcggcagtctctgtctcttttgctgacaaacaggacagttcttactggcattttgtttttcagagtgtgcaagaagagtatgtccagatttagtccatctctgccttgctgtagtactcccatgtccactcatttcatggacccaggtggccgtcacaggagagcacacagggaatatatatatatgtattgatccaatcacctttcaaacctgaaagggacttctgatggccatcagcatgtcctactttaatgaaccccttgaattcccatagtcatttccataaagctgtgccccatgtgggtatccctttaatgggctaggcttccactgaccatatagccaggcaattggccactgcccatgagtcagtaaaaactgaaacacaggggctttcatcattgttaaattcttccgtcattgctaggaaaacaacatgcaattcagcccactgggctcacctgtttttatcttctttgataggagtgacagccttccaacaggatgctgtccatacaccgtggaactactgtccacaaaccaagtaactgttagtcagtcgagcactgtttatagggtattgtctaaatgatgatagagtttggcagctcctcacgcagttccatagccagtcctaagggaaaaggggctccctgctggtatcttctccttgcattctccaggtagtatgatcttgtgtaagaatcctgttcattttactatgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaatctataaaatgaaggaactccttcacactatatgccctggtttcagcagttcctgggttgtgccctctccctgttgactatcttttgggtgaccagaggactcacaggtagttctgttgttctgcgtaatttttccttttgtgggtgcctttcaggatagtggctaaagctcagacaaacttatgcctgaacttggtccaacactgaggtctaacccagcactttgaatttagctattaaagataacaatgaccgtgggattgtatgtttagcatgcctcatcttagtttgtatttccttacatatccaatgaactagctcctcaggagtcagatctaccatcatttctaaactccattgataactctggcttttagtaactgagtgcagtgcagctgcagtttcatactatgtcggaaaaactctcctcaagccgtattttccgtctgctctcacaccaccacaacaatcatcaagaagacttctgcgacttctggaaaaactcccacacaccaagcagtggacaccagctgagagtcctccagttcaattccggcactatctatgcagagataacatcaaatcccacaggttgagggctcagtcccacaagaccactccccctaccagtggtaagtttgcacctccggaacttctgacaaactggcttcaagttaaggttcccaggacccctctttgggttcagttaatttgcgggagtggctcacagaactcaggggaaacacttaacatttactggtttattataaaggatattggaaaggatacagaggaagagacactagggtgaggcatgggggagggggtgcggagttcctatgccctacctggtacaccatcctctgggaacctccaggtgtccagctatccggaagctccctgaacccacttctcttgggtttttatggaagcgtttcttctgccagcgtatgaggcgggacctgtcaggggagtgtcttaagacccacaatcacaaaggtgggagaagattagagtcctgcctgtgataggtgaaaggaaggctggaaagagattctgtttcctgaggcctaacacacccattatcacaaaagactgtaacaaaggctgagggagttatgaaccaggaactgtggacgaaaaccaatgtatatcataacaccacacatactataggtgactagggggccatagccattctcatttagctggcaagattgagaaaaatgcaaataaggttttctcaaattctaatctgagggttaaaataacttttattttattttttaaaatttccctctaatctgttatcttctggacccactaagtatagctcagcttttatctcccttcctggtccagattgggccctgatgtttgtaattatgctgaaatgtgagtgcagatggctggagtgcagctgagggaaagggatacataactgccattagctacttatggaaaacattttattaaatggatactggctcgagagcatgaaaaagaaaagaataacaaagccagttgacaattatgacagactaggatgagtgcctagcacaattttgatcacacagaggcatgtaataaaagtctattgaattcaattgatagattctgctccacatacgggatgtgatttttttcccctttctctaatatgaccagcttagaatcacagactgagaattgattcagggtaacggaccaattccttcttgtatagatgagaaaagaggtccaaattgttttggggacttgtctaaggtcacatagctgtgagtttgagcttatgcaaggcctctggatttacatttcatcttcattttattttatcagatgaacttttacttaagaattttggtcatatattcataattttgtctgtctttgctttttttcttttctttttctttttttttttttttttttgagacagagtctcgctctgtcgcccaggctggagtgcagtggtgtgatctcggctcactgcaagctctgcctcccaggttcacgccattctcctgcctcagcctcccgcgtagctaggaccctgtctttgcttttaagatatttattcttccattagcacatctttcacacagttttggttactacactgcaatctttaaaaagaaatggggctgggcgcagtggctcatgcctgtaataccagcactttgggaggccgaggtgggcagatcacgaggtaaggagttcaagaccagcctgaccaacatggtgaaaccccgtctctactaaaaatacaaaaattagccaggcgtggtggtgggcacctgtaatcccagctactcaggaggctgaggcagggaaattgcttgaacctggaggtagaggttgcaatgagccaagattgcaccactgcactccagcctgggtgacagagcaagactctatgtcaaaaaaaaaaaaagaccttttttttctctatttctatttgccagatgcatataactgccagttagaataactgagcaactgagagaggtgatattgcatgataataattaaaagcccatatgctgacatgagaccaggttgaattatacctttatcattaccttgttttaaccccatcaatgtttgctttattacttggtgaatttgagcaaattatctaagttctctgtgaggtcacggggtcacagtaatacctgtctcataggattattgtgagcactaaataagtttatgcattgcannnnnnnnnnnnnnnnnnnntatagttgttagttattaatttgatttaaaaaagcagccatgactcccatatgcaagactccagggaataattcataggtaacatagccataaaaatgaagcccactcacacccctctgcgtgtgtgtgtgtgtgtaaataaagactataggaccctgtcttgcctggtttgagcttttgggtttaggagagaaggagcaatattggaacaaatagctggttcaggagaggaagattagataaggctgagaaacagataattcaaaagaggttaaaagaattaggattatctattaactgaaaatagaatggtagaatgaggatcacagaacagtctgactggttttaagtctattttctatagttaactaagtttaaaaaacaaaagctaagtgaggtgtattagtttcgtatttgctgctataacagttgccacaagcttagtcacttaaagcaacatgaatccattctcatacagttctggaagtcagaaatcaaaaatggatccctagggctgcattcctcctggaggttctgggggaaattgatttatttgccttttctaacatctagaggccacctgcattccttgactcatgttacagccagcagtatagcattttttaatctttctgtctgatttcattgtcatattgccttcagacttgaccctcctgccttcttcttacaaggattcttgtaattatattgggccaacttagataatccaggataaattcccacttcaagatccttaacttatcacttctgcaaagtcccttctgccaccatggagggcgatttggggatataactttggccatctgacttgttcccctttctccttttatttctgtgtctatgccttgctaactcttcttctgtcacctagatactttttcatttaacagacattgttcttcccttttttttttttttttggagggatggggtggtcaggaaagcttcctaacactctctgtggcttctccaagttctcaggtctttttgtttcccttggtggtgtgttttataactgatggtctcctgtcacctgtgacttgcatttgaagtacataaaattacatttctatttgtttaaaatggttcatgtctacagtctagaaaagtgtactcagcctaaagacaccctgttgtcttgtggcaacagggtgaccttttgcttggttcctagactttgttgctccattaagcccagatctctgacttagagactcctattccagtaaccacacaatttaagggagtttctattctttagtcctcaacgtgcaagaaccacagggcagactgcattgctcattgggaggaaaaggaaggaatcatctaagaatgctgaggagaagttttcaggaatgtgatttgcatgtacctcgaaaacttatgtgaaatttttagaaaacttattagggaaatgtgaacttccatattaaacattggaaggaatcactggagagacgggagaaagacagaaagagggcgcctgctttgggatccaagccaataccatttccttctctggcatgcaaggtcccagcaagatctccctcagggagaagctatcccttcgttctataaactctcacagaacttttcaattattcttgtagtttatatcacttttactcaattttcctcaacttgtctgtgtatttgatattatctaatttaattcttagcataatcttccaaggtagatattatcaacattattattttaccagcgaataagttaaacatctggcccaaggacagaaaatgcactccataatcctgagtttaccttcaggtgtgctaattcaaaaccaagggctctttctgccatatcacagctgcatctcaataaaagcatctatacatgtctcctttgtaaaatgaaagcaatttcaggtcaggaataattgcttattaattttgtaaaacaaccccatagcatccagtaaagtgcctgacaaatggtggttgctctattaaaatctgacaagtaaatgaatacataaatgaattgaatgcatgaatcagtagattgttcctgaaaatagaaatcttgggaataataagtggctgttaaattttggggggagaaagaagaaatggtttgagatctaattctatgcttcagaaacagtcctcttattcctcattgttatgttattttcctcagcaaactcttttaaaaagctggcaaagataaatattgactaagtattgttgtttgtagtaatgaatttgtatcttttgtgtaaatgtattatgagaggacacattaaagttctgggaactgtagttttattaagtgatgtaatacatgttaatgtttattaagatctcaattaattttacatttctcctctttccctccctccttctccaataccttttactacccctttaaaatttccccatttatatttttgtggtatataaaatgagttactagtgccatgtacaataagaaactttcagtctataaagtcccgcagtataattcaaagcaggaggacatggagacactcaaagactttgaatgactgcagtgttcagaggagctctcgtgggaatcccttctgacccctccacctttggaactcaaaataaaccataaatgcctgtcttccttgacctgaggacaattttcccactattcattatctggcttccaaaatgaattgccaaaagtccagccatcctgccaacaacatttggaataagatgggagaatttaaggtcaaagagaaataaactgtttctgtcttgttggtcttgtccttccactgtctccttccttacccccagtaacctactctgagggatagcatgtcagagacagcccagaaaagcatgggaaatatctcaatttccacgggaatccttgagtagggagtggccagtacttgggaaaaacaatactcttttaaaaactaaagtaaaatgacagcaccagggaggtgataatacaatgtaattgagctgaactaggcagcagtggaggtctccacacttgctttctttgtcactccataggagttcccaatgaagaggccagcagtgtatcttctctttgctatcagaattggttgcattattatgaggtggaaatcttctgaaaggagtttaccttgaatgctagtcaaatagatctttcttgagcctatcctatcctatcctatccatttatccattcaattaacatattattaatcaacacatacatgcaagatacggtgatagggataggacaaatatgatagtgacaataataataataggtaacatttactgagtatttataatactatacaccaagttccatgctaaacctattaatgcattaacttatttagcatcgcaacatatctatgagttagaaattctattatcaccatttttacatagaaaaatgaagggtcggaatttaaattaagggttggaatttaatttgtccaatgtcactctgctggtaagtaagagttggaatataaacccaagcagtgcggagctgtggtcttatcatctatgtcatcctaagagttaaagcaactttacggtacttagttatttttaaggttatttaaaataaccttccttggtcttccttggggagaccaaggaagtaagacaaggcacccatcctcaaggagcttgctatctaactgggagtacatacatatgggactcttaggtatacatttacaaaaagctagagtcattccgtgaaaacgtgctatccataacttgagaagaagaaatgtgttctgttctttgctctgtaacttactggccacgagaacttggaaacatcttttaatttctgtgaatctcagtttttccacttttaaaatggggggatgcaaattaaaagctccctgaggccccttaaatatgcctctgttttgtaattttatagtagataagagagaaagcagtctgggatggagtagttacagaggtttcaagaaaagagtgagacttgttctgatcctggagtattaaactggcatagaggtggagggagaaaaagatggtgtgcttgggagatactgaggagggcaacaggagtaggtgtacatgtggttgtggagaataatgggaaataaggttagcagctgaggatgttagaaggcagaaagtgatgtttgaagtagatatggtagatcagtggttctcaaagtgtggtcctgaaccagagatgtgaatcctcaaaccccacctcagacctcctgaatgaagaaaagccagaggcaaaggttgcataccatatgatcttatgtatatgagaaaaaacaaaactataaggatggagaacagatcagcggttgctagggataagaacaggggggcgggcgcggtggctcacgcctgtaataccagcactttgggaggcggaggcgggaggatcacgaggtcgggatatcgagaccatcctcgctaacgcggtgtaaccccgtctctactaaaaatacaaaaaattagccgggcgtagtgacgggcacctgtagtcccagctactcgggaggctgaggcaggagaatggcgtgaacccgggaggcgcagcttgcagtgagacgagattacaccactgcactccagcctgggcaacagagcgagactccgtctcaaaaaaaaaaaaaaaaaaaaaaaaaacagggtaagggctttattacaaaggggcagcatgagggaatttctggggtgacagaattgttctgtatttacctaactgtagcaataatctgtgtgttaaaactcgcacaattgtacacccaaaaaacgtgggaataaagaaactttggggtggagcccagctctctgtgttttaaccaggcctccaagtgatttgggtgtacactgaagtttgagaactactgtggttaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaaggacacatttaacaggatttccttgtctgggcgcagcggttcacacctgtaattccagcacttgaggaggccgaggcgggtggatcatctgagctcaggcatttgagaccagactgggcaacatggcaaaatgccatctctacaaaaaatattaatacaaaagttagaagaattggttgagcccaggaggtggaggctgcagtgagccaatatcatgccactgcactccaatctgggtgacagagtgagaccctgtctcaaaaaataaaaataaaaggattttctgggaagacagaaaaacacttgtgacagattagctattggcaatgaagaagaaagtctaaataatgtagattggagcatttataaattatgagagtaaggagaatattacagttacataaaaatgggatattgggaagaagggttgagtaaaaaggaatacatggtgccattcacaaggcattgaacacctcaggtccttgattgctctcatttatatagtaaatatattgaatgtgatcctcttgaaatcttaattttttatagctggaggagctattagaggttttctcactaaacttatttcctttctccctttctctttttctaccttttcttttttggcagaaaacaggagagctcaaataacatattcaagatcacccataaaagtactgactaagttgataataggatttagtcaagggcaaatcttttcctgttgtactgttttgttctgtttttctctatttccaattgttatgctctatgttacgttctatgttgacagctgtcatttttttctgttaataatctggacagtttccttcattggcacaggactttctgtaagtaataataataataaaccttgccacttatggagtaccatagtacatgtgctgggcactaatattagtgtttcacatatagtaactcacttaatcacaagaggcttatgaaatagataccattattatcttcattttacagatgagaaaactaaggcaaggtaaggtttaaaaacttgccaaaagtcacacatgtagtaagatgaatcggggcagtttgcctccaatatccaggccctttaccactatgtcattctgtctcttgctttaagaaaacaagagtttagttttggtattaattggattttctaagagttcaatgttccacttgactttctctctaggaacagtctttttaacgtgtatcgtatttgctttacaagcttccagttacataatctgagacaggatttttgccacagttgggagttggacattgtctctctcaaatgtggggaagatttaacacaattcaacacgttacttttgactgtagtaatagaatagagatctggaaagtatcttatgatattgcttggacagatccaggtggtcatatgacttagttatccaaaacagctggttgctagtcttttcttgatgacttttcttctgtaatggaaacttcaccacatttattgttcacgatttccatggtttcatcaccattttatggtaagttctcctgaacacttcctgtttaagtttaagcaatctttgtgtgtgtgtatgtgtgtgtgctggggtaggggcctttcatgcttatagatggctgggttttgaaaatttataaatgcatcattatttatcagtttcttgttcgaagcttcataatctcttgaagctagagccccttgtgtgggtttaggtatcgtcttggttaagggtaggaaccctggtgcttttaggatcaagtctcattaggcgtactacattgttgtacccttctgtgctcctaccacctccctggactcctgaaaatgcataagtggctagagaagatgaggatttgattagttatagaaccctaaatccctgtcctctgacattttctcagggattctctcttttccctatttttctgcttcttttatttatttatttttaaatttttaattttttaaaaattcttttgagacagagtctcccttttgttttctaggcccaagtgcagtggcaccatctcagttcactgcaacctccatctcccaagttcaagctattcttgtgcctcagcttccctagtagctgggactacaggcacgtaccaccacgcctggctaatttttttgtatttttagaagagacggcggggagtgttcaccatgttgtctaggctggtcttgaattcctgacctcaggtgatccacccgccttggcctcctaaagtgctgggatcacaggcatgagccaccatgctcaggctttctgtttctttctttgccactcatcaaacacagtagtctttcactccttctctctgggaacaagctggcgtatctcagtgattttggggttttggaaaacaaataccaaaatgggatactcttgtcaattatcatttgcttttgacgtcacaacacaactccctcagaggcaagaaagcatgaaatgcctggcaacagtctttaaagaggaaaaattacatgtggaggaatatatgcattaacacccgatacattaatatgtatttaagctattattattatctttaagagttgctacagatcacttgttttctgcgtgtttgccgtggagaggggtgactgcgtgatcatgggtggagtccttgcacctagattaaggaattgtatgattaaatgaaagtctggtgacctcatgtggtcctccacacttggatatatcagggatctgggagataaagtgtgtttctcccccaggtgactgaagaagaggatgcccaacaagtagggccaggtttatgaaagcaagaccaccctatgcataatgaaatccaactgtgccatactttttggacaaatacttattaacaagctcatgtaaaatgtttgtatgacttattctataatctcaataaagtcctagttctttctgccctgactacaccttgtatgaagggtttgctcagatacaataatattctaagctgggattctaatatcttttagttgatatcaggcaacaagaaatcttagcatcaatgtctggatagaggactttgtgggaatcaagccacaggtgccatctctaagggttaagagtgaattacattttcaaaacctttctatggaatgggtgggggtttccacaatagtgtcacaagtccaaataacttgaatattattgtgactggagagcccattatctaatgaacaagcctacgtgtaaacactcacttctagcacgcgtcctgctagttggcaaagcatctgatttcgatctctatagggatagctgaggcagctacagcagccacctttggagcatggtctttctaaagagtttgctgaccactgttgagatgtgaatgcttgattaggtcaagtagctgaattaactatgacatacatcatgtcatattgtagtgattacaaccagctaaaattttttatttcattgtttttcatttcttgttttgtatctgtcttgcccaatttaaacataaactcaatgagaggaccttatcttttttatttcgttgaaaatatcaaaacatattatagcgtacatcatgtggtaggcattcagtaaacatacttttaatttgttgaataaataagtgaacaaaaggagaggctgcacagggttttctttttctttttttcttttcttttttttttttgagactgagtttcactcttgttgcccagactggagtgcaatggcgtgatctcagctcaccacaacctccacctcctgggttcaagggattctcctgcctcagcctctggagtagctgggattgcaggcatgcaccaccactcatggctaattttgtatttttagtagagacggggtttcaccatgttggtcaggctggtgtcgaactcccaacctcaggtgatctgcccgccttgccctcccaaagtgatgggattacaggcgtgggccactgcacccggcctgcacaggcttttctctgtccaccatggtcctaagaaattaagtcagcttatttaaacaagaaccctgggagacttcctagtctgttactgcaggttacttgtgatggtcccttactgaaaatgagctaacctggggtagctgaggtaacagcttgaacataaaaatgaaaagagttgttattaagacaatctgctgaagggaaacgttagaacatatcaagagttgaaagggtataatagataaacgtgctttctgtgaatatatttgacacaaatgacattgtcagttccatcttttcagccatcttatagtttgaaggggcttattatgtaattaatcactaatatgagtgaaagcctaaaacactgctagggaatgattcacttgtgtttagaaacagagctttcatttctgaagtcatatcataacacattaatactactactactatatattccttagcattttcttcacctttttatcatttggagcacccgaggagtatttcatattaactaaccatagagtcattttccatcatgtatcatatattaattatataaatcaagtaagaaaataaatacatgttttaacatgatatcacactattactaaacttctctttcatatgctgttaaagcacaagcaatgagtgaattttctgtagttcaaactgaagtaggtaaattcagaaatagggtagatggtagatgccaaaatgatagattctttccaccgcaatcacccggcactgcctttctctgcagttaagagtccatcttgattttaggggccatgctgaggatcctggcaagttgaggatttcagccccagaactgagccgactttccactagcatattcttatactcccgctaagggttttcaagatcatccattaccctgtctcggagccacctacaaggagcaaactccactgatatgaagttttaaatgagcagccaggaagaaagctgttccagctttcagcaaaatgcattctccctcttgataggcccgcgcagggaccctctgggccctcttccctctgtcagtctctgctgggttctacctctcagattagttctcagctgcacggaactcagaggagctcctctctcctctagtctctaatccggcaaatgtcttactctcggctgtggacattgacggctagcgagtgttttagaagcttgtgtttctctttcctgggtatctattccagacatgttctttttagtccgtggaaagaaacctcgtagtgtttcttcagaaggaagcagcctggaaccaatctgctctttgctcagttctttgctaatgctcacgccttcccacagccagcagggggcatctgcgacacggatttaaattgcattgaatttaaattggattatccgatgttaggacacctcttttggaaatgtgttgtaaaaatcttgccttatgcttctcaactctcctccctctcttcttccttctcgctgttcctgacatatgtctggcgtctacagcgaaacctgtttgtgattgccgaaagcctttcaaccacaggaatagcctatgccccagggctacttctgtttcttttaaatcctgaaaaattatggtcttataattgattcttttcagattgctagtgattgcaattatcctccctgcctcttctcatcagcatatgtcctatataatatgaggaactaaatgccccacttgaccattctcaatctctttcaaggacagaaattgaattcacttactttatagtgcttatagtcatttaatggtgttacctctgtccagttagcaaattagagacatcttagtcctccgtgactcattctaagctgcactccaatatttcacctactccaccccaaaatgcagctttactataacctagcaattcagttcattcattcatttgctcattcatcaatttacatggcaaatctttattgaatgctattaaatgccaggccctgtgctaagtgctgaagctgtaattgtgaactaaacaaatgttcactctgctcttggggacctgacactttaatgggagagatagacaatattcgcatatacatatacatatggagatataaatgccaattgaaaaatgccatgaatggaaaattcagagggctctgaggatatattaggagcagtttttaggtatataatatctcccattgcacattgggaagttagggctccttgaggttacagtctatgtttgtttgtttgtttatttatttatttagagatggagtcttgctctgttgtccaggctggagtgcagcggcatgatcttggcttactgcaacctccacctcctgggttcaagcaattctctgcctcagcctcccgagtagttgggattacaggtgcctgccaccacgcttggctaattttttttgtattttcagtagagatggggtttcaccatcttggccaggctggtcttgaatgcgtgacctcatgatccacccacctcggcctcctaaagtgctgggattacaggcatgagccactgtgccaggcctacgttcttttgtttttatactccacctaccttcatcagtgattggaaaaatatctgctatacagtttacatatatgtgttttatattcaattgttccaagtgtctctgaagcgagaaacaactctgtaacccttgaaacacctagtataagattttatatataattggttcttcacacattctggtggaatataattgtatttctcaaaatttaaccatgtttctgtttttagtgattgcttgtgctggttttccacacttatgcatcttaaggtgataacccattaaattcacgcactagcaggaaggactgaggtggtccgtggccttttgagttttgacttcccagccagccagcatacccacacagggagcagatttaaaactgcaaagccccagaattattcaaaccgttttcagtttggaatcactaatgtgagtcatctagacaaagaattatcttcctctgagcctttaattaaactttaactcaagcattttcaattgattttatttcaaaacaagtttttctttgtaaaacaaaagaataacaagaggaggaagagagatgacaggagataaaaatagtttcttgttaatgagcattaatgtaatgtggccaggaaaaaatgtctagtgtgcagtcaaatagagcccgagaccaagcaggaaattgtaaacaaattagaaaattatcttctctggatggtgttgtttttgatgccaaattaatgtcagatacattcaagtttatctataaagggaaaatagtttggtaagctggagctattgttttgtttgaatttttcatttggtttgttttattttcatatgtctgtgaggctatggtagggaggaaagggaaacgggggatgaaataatattccagggattcttgaggagtaaaacaaatctaacattatttagtcttgtgaaaagagtgcaatgtttaaagtgatttgaacttcagcatttctcagctcctcggcctttaaactttactgttgtatgagcagaaatgcaataacattagtcattccctgaataatgaactcctaattaaatttaatagacttcacaacttaaatactcttaactttataatgctctatacttgagcctataccaagccagaaactgaagccatagaaagaagtgttttccaaagcactgaatatcttttctcccttacatttccagggcaaatatgaggaaaagagtaacctgatgttctggtatgttagtctgctctgaagaaatggaatacgattttctcttggcaatgttataaatgatagttgatttctagatcattccacaaaaaactctatttaagcagtgatatagataaaatagtagtagggtactgattcatcctggttttaaaaggattttgtggtatgtcttgagcattcaactaccatttataaatggtgttttcacagaaaatgcattctgaaatagtaaaagaaaatgtgagatacattgtgttcatatgataggatgccacgtctttaaatacagacagtttttgaaaggcgcttttcaatagttttatctcttgtttgttttcataccaactttgctgcaagctaggtactgtatagaggtccctccaacatccatccctctatctggaagggaagcagagtaacttctttgaatgggctttctgctgtctcacatttcaccctcttgcagtacaaactacttttacatcccttaaaataacacgcacccacccttccctctggaacgctcattcttttctagcccaactgactgactgctgctcattctctagttccacatttgcctcctctgagaagttccccctgatctaccgttgtggacactggtgctcctctgtgagagttctgctgctttctggacagtctgtctttaagcacccgtttgtgattgtttccacatctaagacctctccgggctaaaagcaccttgaaagcaaggagcaaacctaatggtgtttgtatatttactgcatactgcctgacacagtaaacatgaccaatgagttaatcagtaaggaataaatgaattaagtcactaataattcttttacatacattcgatttctttgttctaattatcccttaatctccaactattattcttgcatcaggaaatcaaacacaaatatttttctgccttttacaaaagcaaaaggctcaaatggagcaagaaatagaaaaaaaaggaactaaatttgagaggggggataaagttaaaaccaaaacaaccaaccaaacagaaacctaaacatgagagactttcattacatcattgttatctaaatattggtgagtggactattgtgtcaaggttgaaactgaaaacagttgcagcatggattccacagatgggtgcacaggaagggagggacctatggagccaggaggatatggattatggatgaaggttttcacggactgggtgggatactgtgtcctagtgcaccttgcatctctgactgtaatactgcacattagtcagcagagggtagccacaaatattgcatgcatttctcctccccacttaatgttttcttcatttttcagataaatataaaattggcaattcttgtccccagaggtagaatatagaaggttgtgggtgtagtaattccttagtaacttgcggggaattttttgtatgtttcaatgtaatgttcgaagctagggaacatgggcggtgggttggaaaaatgattgtgtagttagaactaactttaaagaagccgtgttctatgccaaatgctgtgctaagtgactcacatgcattagtatatttaatcatctcaaaaagtcttaggatatactattttatcagtccaaatttctaggcaaaagaactaaacattagataatttaagtaacttgcaacacttggaattaaagcgacacttattctaattcacaatgttatataagctccctcggcagaacagtcccagtttttaccctaatgccgtgctgagcttgatctgaggtactatgggacctgagttggctttagtcaatgagagggtcttagggaaagagtgaaagcagaacaaaatgaaaaggaaatgacactgtagagatgactgttcctaaaacatagttttcaaaaccatatttactagcctaaaggaaaatatgttataattaggcatttatggagtttttataagttaccacaggtttccttacattttttttccctaatatccgtaactgcaaatcttaggcatttacttaaattgcctcatcacagcctccctgtgaacaaatgaggaaagtatgtgtacaatagtaaaatcctatttggctgccatgtgaacttcaccacatctctttaaaactttggttatgattagcattgactgggaggtaaatgttagcagatttgtaaagaacaaaaacaagatatttttagttcactttggcaaatatttttaaatgtttactatattgccaagcattgtgctaggcacaggggttaaaaagtatttaagactaaattcctaccatcaaaaagttctcatatccaagtagaaaaacagaaacataagtcaatgaccataatgcaatatgataaaccctgtcttaaaagcatgggtaaagtgctaaggtgactgggaaagggtagctttttgggtctcccaatattcaacaacttgtcctatggattaatatttaagatttgcctggtgcttttctagtatagaattgtgataaagtgatggatagattagaaggttagttttaaaactgagcgtgaaaatagttgcatcccgtgatggaggagtacccagaattctgaccatatctactcactaaaatactgaagatacaaagaagcagtaaattctgctgtagtttgttgtttggcaattagtactcatttatcaaggcttactgcacataagatagtctgacagccatagagaacaatggataaggagttggaaacaaaaattttatagagaaataaataatcaagtggaatgatttaattttatagctggaaatagctcaaaaaacatctaaaatgatggataacgtcatcattttacagatgagggaactgaggtctggcagtaaaaagtggtcattttacttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcataggtgggaattgaacaatgagaacacatggacacaggaagaggaacatcacacaccagggactgttgtggggtagggggaggggggagggatagcattgggagatatacctaatgctaaatgacgagttgatgggtgcagcacaccaacatggtacatgtatacatatgtaacaaacctgcatgttgtgcacaggtaccctaaaacttaaagtataataataataaaaaaaagtgatcattttttccaaatgtcatatatctaacaatagtgaagaccagagccctcagaagactagtaggcaatgcatgcagagttctacctgggaactctagcatcagacagcttgggctcacatctgtctccaccaaatactggctggtttatcttaagttatttaaactcctgtcattccgtgacctcatctgcaaaatggaaatagtactatagtgtctgcagatataaaatgagagaacacatataaaacaataatgaggattaaaatgtagtgcaaattaatgaaggacatactaagagcttgataaatgctatttattagaacttatatatcctaatttctgcattagtattctttctgccacaagaaaaataaaagtgaaatgggattttgttcatttttgtttctctgacacaggaagaaatctcttcttaaaatctgtatgcacatgtggtgtcctcatttccccttgtgtctcttctttcagggccaaggagattaagatcaagttgggaattctcctccagaagccagactcagttggtgaccttgtcattccgtacaatgagaagccagagaaaccagccaagacccagaagtgagtcatgaatatggattccactcatttcctccagaggatggctattttccaagtgtttagcaccattcctcatctgtagaactacccccttcaattactcattaaggatcataagagccctcagagagttggtttgcaaagaagctctttttttttttctcaactatctcatgtctggagcatcttattgaatacaggcagaatacataaaaaataaaagataagactctgccttatttttgagagacagacatacttataaaatagacagaccatacttataaaatgataccagccactacagcagtgtggtaaaaatacctgctcatttactgccttggtaaccactcctgatccagttaattatgagccctggatgcttacctgctgatgaactatctaaagctgcttcctcagcagggtgatgtgagaacatttccctcagaaagatactaaggacaaggcagacaatttcagcctaatcgttccttctccaagatagtgcccctcaagttccaacagaggaacaaagtctgttacttaagtgaagaacgaatactggactagctatttctatttaatgtacaccaggtatttttcccaattcataaattaatattcttgattggatttctgcaatcctccctcatccccattctcctctccctacacattcctcctgtcaatttaggcatcctagggaactattacttctaaagagtcatgatgttatggcagtgaatccaggtctcacagtgtgcattggccccgctttaactcaggaacacgactcccagcattcccatcgttcatcatcatccctgctagctgcagagactgtcactacctagacagatacactccatcttcccattaaaacagagatatccatgaaaaatcaagaaaggaaaatgggaagaagaaaaggccaaggcattcaaattccttcgctctgctatcttagagctttgaggatatcacagaagtgtggtaaaaatataggagtccctttaacctccatttctctttttaaatggaatatttgtgtaaattggccagcctgtcctttgtccaaatgacctcaacttaccatagctggattgattgggagataaagagatgagttattctttctctttttttaatctttttccattagcctaagtgaatatttccattcctccttttttttattacttcaaagtgattctaaacaggaagtgaggcataattgcgttttctgcatttgaaaaggagaagctaattcagtgtggagcagcaggcaccaagcggtagtggagaataagaaccacatttcatagcagcaacagatcaaaacatctattttgaagtaaacaatgtgacaatttattgatccgttggtattaactttaaaaaaatagagttctacatttcctgctttaaatctctgctttaacattcacatagacccttaaactgttgagattaaaagggattcagagagaagctgttctggaagaaaccctggtgctgaccatttattggattatttacttctcttgtcttccatcccctttcttcctccagaagcctaaattgttttggaaaattccttcatatccctagagaataattctgtatctattgcattttcaacagtgaccaataaaaaagtttcccactctcttctgaatccacagaccccatcccacctcctcatgtttggcaactttctatgccatttatctgacaggaaatactgtgttctgcataagctccatctctctctctcttctctcactttaaaatttctctgtatttttaactcatgttcttctttcagaggggaaaataattcttctcttgattggaggtatttttaacccttctcatattctttgggttactgacatcagtagaatccgtttttttaaaagtattttctatttttttaacatgtatttttgagttctcacttttaaaaacaaaaatggaccattgagaaaaacagaaataagtgcttatattcctaccccctaaagacagctctgttcccctttttgcacttttagtagtcctttttccctgtggaccctcttccccaggagcaaacaggtacccatgttccatgctgaaaaattctcttcccgcctttctctccttctgcttctatgcctttctcttacttttactgactaactgtagaaacagaagtctgtactcatggctttcagtcttttctgtatctccttcttaaccagcttcaaccttactacctcacccgaactgttgtttctaaggccccatctgtgacttgtctgcagcgtttgacagttcaccagttgacctactgttttttttgtttttttttttgagatggaatttcgctcttttgcccaggctggagtgcaatggcatgatctcagctcaccgcaacctccacctcccgggttcaagcgattctcctgcctcagcctcctgagtagctgggattacaggcatgtgccaccacgcccggctaattttgtattttttagtagagacagggtttctccatgttggtcaggctggtctcgaacacctgacctcaggtgatctgcccacctcggcctcccaaagtgctgggattacaggcgtgagccaccacgcccagcccagttgacctactcttaaaactctcttccttaacttctagtcccgcattccccacctgccttctctttctctaagtgctcccactgttgctcaccctctggatgtgagcattccttaaggctctgctgtaggtcctcctgagaaacaatagacaacattagccaaccacataggtttagtttgtgataactgttatcatggcttacaaaatcatcaattgtaaaatgttaggagctgatatagatattcatatagcttattttatattataaatgtctccctttcccctgcctatgtcagcaatttttaacccctttttctggtttgttgttgtagtgatcattttatactaaagaatgacctccacacataaatagtacctagcctgtgctagtggaaaacagttacagaaagttgtcctgcatacgctcacctggttaggatgagcctggttgtgagtactaaagatctatgtacaatttcaggcccgcatatggatgtcaaaaaatgacatgttttgcttgttcttaagtctgtatgcccaaccgtgatgcccaggtcaccactggttatcaggtaagggctcaataaatgctcataaacttgagcctggtcatgagcagactgtactgttgggcaggaagggagaggggactaggcacatctaattgacagtaaataacttgaattttcttttccttgttaagagcaccaatgtgtaagaacatttttaagacatttaagtatgtgccaggcactgcgcagattaaaaaccaaatcaaaccaaaacaatacaaaaaacaaaaacaaacaaaaaacccaaccacaggcacttgaggttatagctagtaagtgccagcattgccaatagcagtaataatggttcatgggactggtcattaaaatctgagtttggggttatttgtggctttcatcagccaggctaactcaaggcaaaaccatcattcatttacttattaatctgacacacatttattgcaaggtggatggatgctgtaagggtacaccacaggatagggtgaaatgggaaaagttctctgtgcatgacaacctatacccttcggcagtgagtgcctcattgtcatgtgagagattcagtgagtaaaagtggtaagagtagagtaaaaagagagacagcgcttccagcagagatggccacttcctgggccaggtggcatttatactaggcattataaaacatgtggttaatcatctctataaatgtttattttgagtttcatttgaaatagctttctctctctcccccacactcccacgcacagaaactccatacccatcctctgtggtcagctatgaccttgcaaaccagaacatttattggtcatttagatctgcatctatcttgtttccaatgaagtcagacctaatgaggactggcaaattctgagaataaggacaggatgaacctctgttaactcctaggctggtaatcaaaatgctgggcttcatgctgtgggggatgtgtcctacttgactgtgcccttaaatcaatttggaccaatttcacccccaagcgggctctgcacatttccttttcaggaatttaatcttggctgtgatgtgctgctgttattgaccattagcctggttccaacaaggccatttgggaaaaatcagattggataacatgcttaagtttggtatacctgctcatgtcatttcttcttcctttgctcctctatactaaccagaggaaaagtggggcaggaaagtgatttcatttaatgagaatatttataaaatcaggagatcctgtgagtaaatcagccttcctcttgctctgagctactttcttttgtctaataatttaatgtcctgctgcttctgtcaacaatgaatagggacttggtgggtgtctattgtgtgcaaaatattgaacctactatagtgaagaaggtaagatgtgtaagaccttgtgctaaacatgtaggcatgaaataatatgtacataaaacagttctccacttgcagtaatataaaagagccaagaggagttattgacctctagtagataggtccttttctggttagaaataaaatgaacaagaatgctatagagacataattataatcaccccgttcatgccattttttttttctttgtgtgctcctttatactagccagaggaaatgggaagagggatgggtagctcacgtgttagaaataaatttctgaggcatcagtatgttttccatctatgatgcctgtgtttctagccagcaaaacagaaatcacccaagattatttcacaaggtttgttaccctcaatttggcaagtttaacttgcaaagagtgaacacatgaaagtttatgaaaaatcatataatcaggactcacaaccgatgcatgttctgcaatgaggaatagagaagtaaagggattattcacaatactttagcccaaaacatactgccgtcttggactccttacataaataaagtgaggctgattctgcgcctgggacagcaaaatgaaaagtagaacaagcagctgtcatatcaaccaaagctgcaaatctgaataattaaccaccccccccgaaatatcattgtataaaaactagaagcaggaattttttttgattgcctggacagttgataaacaaattaagagctaaggaaattccagtttaggaaaaactggccttaatattctagtaaatgctttgtcagtctgttttgatttggcaacgaagaactcacatcataatgcaagagttcgagctgggtgagccaaagagtgtgcagtcagccatttttcccggacaatatcagctccacttgacacatcctgctgtgagagaaaaattggtggttgagatgaaatagcttcagggtttctgcatatataaatgttaaaatagaaacagcctaaggagaaattatatgttggctataaccttctccttttgagtcagcatctcaagcatttgtgtataacattccatatattaaccactctttttttttttaaattagaaagagtaaatctttaaaaaaaagtctgatcctgttataagtgggtaggaaaaatgcgcctacgtttttaacatgtaaatttgctatgatcacaatcccaacataaggaaagcattatacactcacatcttccactatccttaattagacagctttgggatgtggatgtggaaccccaatgccctctgctgattcagttaggtggttaacatgcagtattggtgaggcagagaacaggagttcaatctctgtaatgggacaactggatttcatgaagttatatttggaaaaaagaccacagttggaacaactttcatgggatacataagactatcaagacacagcttaatgtcaaacgaactctacttttaaaaagggaaagacctaaccaaaatgttcaaaaaagatgaagatatgcaataaagatgtatgaaagcaaacccagctcatcaaacccaattgttagagagaaaataacttaaacttccttgtcctgaggatagaccagcagtcatatcatttccatctaagagaaacaggaagtagttattgctggtacatgtggttcaatgcctacttacgccataccccttttctctccttattattgatgtagaacctcgctggacgaggccctgcagtggcgtgattccctggacaaactcctgcagaacaactgtaagtttccattgtttgtttttttaaataaaggtcaggttagagacagaaacaaaaaacatctttgtattacctgtgttcttcttccccaatgttgacatttcttcaatttttgaaggtgatatcaataagggaagggggctgcaggtatgtgattatccagttcacaagaaaaggagggtctgtggcactatgagggaatgtgaacataaggtgttctgaagactcatgattgcagttgtgttcccatctgtcctgcttacttgcatgagccagaacaagtggcttgacctcctcaacattctcatcagtaaaatagagaaattacatttcctgacttagcctcataataaattgataaagatcagatatagcagcataaagatcgctaacaagtcatgagtagtacatcctggttcaaactattatactgtcaactgctcttgtgacctgacatgggttgttatctcccccagcctccgtttcctcttctggcaccatgccttttacatcttaattcaagaaatgacaaaggtgctgatcagtgcagactcttttccaagctaataccagtgcatcaataagcactaggtgcatttccccaatccaaaatccttactgattcccatggcttacagtaccaagttcaaatttctgatgttcaagatcaccataactatatggccggtctgcaggcaaattgaacagttctctgttccatataggatttctacatataatccccttggctggaatatcttttactcatatctctctctcttgaaattctccctctcctataatagataattcaaataagaaatgcctagtgttccttgaccatccagaacaatttatccaccctctgaaattccaaagtcatttgtctgcacatcttttattctacttaatacttgctgccttatgttctgttcatagttggctcacttctatgataggttataaactcacaaacgggcaagaattagtctttttcatgtagataatttcaaaacaggaagtatatagtatcgggaaaacaaatatttgttgaataattcactctaaaagtatgagtcaatttaaaataccctacctatatttctccatctttataacaagaatggaatatgaaactttgtcacatgctttgcaaagataaggatttacaaaatatttctcacaagaccattatgattaatgggcacagagtagatgacaaagaatatatgttgaattgtatatgaacattccttatgtcttgcttttggtgtcataagcttctgcttacctgcaatagaattaatcttttatttttggagacagaaccccacagtctctaatttggaactttctctagcttattcatttctgattctctctctttttttcttgtgctaaacaaagtaccctgccctgacacatgtaagatgtttggtgaatagttatgtagtgaatgagtgaatgaactaaattcattttgcttcttggacctagaaattccacaaggtcaactagtagaataatatttatgtttattaatggacttattgtcttgccttagtggtttctgggccaatagcagattgacagatgacctattgataaattatgaatactagtactctgagcacaggtatttattgctattgtcaaaaaacctgagagttagcagaactattttcatgttttcaaaacctttaaggagaagaataaatatttatgtgcccatatataatccttttcagtcacactaaatccttagggctacatgtctatatatttcaggcttttaggagacagagagctactagaataagaaagctagggttagatagagttaaagagagttaagctagaggcagttagtgtttgaaggactgaagattttcagcttgcaaacagatgattaccatcgtgttgagattgaggcccaagagcctcacagtaatattttctacttctcagaggggaaaatatacatgcacttgtgtgtgttcatgtatgtatgtgtgtatacacatgtatgtatgtgtatatatataatattcacaatatttcatttaacttatatatgcattttgaaattatatatgtgtatatatgtgtatgtagtatgtatgtgtatgtattcctgtgtgtgtttgcctgtgtgtttatatataagttccacataattatcttcttaagtaattaatatttttaagacctgggcaattaatttccctaaagcaacaaataagaaagcatttataactattctagtcaatgctttccttgaaagggacactaatccattcgaagtagcccaactaaaaaagaagggttatggtatggagacctcacagaaacaaaggcaagccatgccctctgggaggcaaagccatcagtaagtgagacagtctctcccctctgttgcgggaagtcagggaccccgaatggagggatcgactgaagccatggcagaagaatgtaaattgtgatgatttcatggacatttattagttccccaaattaatacttttataatttcttacgcctgtctttactgcaatctttgaacataaattgtgaagatttcatggacacttatcacttccccaatcaataccctttcttcctatgcctgtctttactttaatctcttaatcccgtaatcttcataaactgaggaggatgtatgtcacctcgggaccctgtgatgattgcattaactgcacaaattgtttgtagagcatgtgtgtttgaacactatgaaatctgggtaccttgaaaaaagaacagaataacagcaatgttcagggaacaagggagacaaccttaaactctgactgccggtgagccgggtggaacagagacatatttctcttctttcaaaagcaaatgggagaaatatcgctgaattctttttctcagctaggaacatccctgagaaagagaatgtgtccctgaggggaggcctctgaaatggccgctttggggacggctgtcttttatgatcgtagttgagggatgcaataagccccagtctcccgtagcgctcccaggcttattaggatgaggaaattcctgcctaataaattttggtcggaccagttgtctgctctcaaaccctgtctcctgataagatgttatcaatgacaatgcgtgcccgaaacttcattagcaattttaatttcaccccggtcctgtggtcctgtggtcctgtgatcttgccctgcctccatttgcctcgtgatattttattgctttgtgaagcatgtgatctctgtgacccacaccctattcatacactccttccccttttgaaaatcactaataaaaacttgctggttttacagctcaggggcattacggaacctgctgacaagtgatgtctcccctggacaccaagctttaagatttctctcttttgtactctgtccctttatttctcagaccagctgacacttagggaaaatagaaaagaagctacgtgaaatatcgggggtgaattttgcccgatacccctctctaattctctactcttaccatcactctattgctctcttcttctttatctgtctctgcttctccccatgacttgtctttctctgtgtctctcttgccactctgtctttgccctttgcttctctctgtctggctgttcctagagaagaaccagtggaatgccaggcttgcccagataattctactccaacatcactgacctgaagagacaatatttgacctattttcccagacatcagctatagaataccatgaataactgtaagccaaactgacaaatcagttcttatgagaagttcttatttgaatccacaaaaactaatagtctataatcagaaattacccaacattagctgtggctgatgcaaaacaggtaatgaagaaagatacatttgggacatatatacatctaaaacttcacaactggggccaagtgtggtggctcatatctgtaatcccagcactttggaaggctgcagcaggaggatcgcttgaggccaggagttcaagaccagtctgggcaacataaaaagaccccatctctgaaaaacagaaaaaaggaagaaagaaaattagccaggtgtgaggcaggacgatggcttgagcccagcatagtaccactgctctctagcctgggccacagagagagaccctgttgctataaaaacaaatcaagacaaaccacttcaccatctctttttgcatgtttgatttgataaatttaaaccatttaaccttgaggagtagcatctttgtcaatttataagggaaatttggcattgttatgttaatgtaggatattgactttcacagttgatgtgttaaatagttccccaagaattccttacattcatatctttaatttttattgagtggcaatgaagttaattggtaccaagcttctaaaaaatataagacagttaagttgctactcagtctcttctaacaaggttcttctcactttccttcacttttaaaataatttttaatcatccagtatatgtgactgtgttctgaaagtatatcaacttcctacatgttttgccttcaattctttaggtggcaccatctgttttcatttcataggcacgttgggcgtataaacagtgtgttgttcttcaaacacaaaaatagaattcacatgggagtttaaataagagtgacatttaatagttccccacaaccatttttaagagcagagaagaatgaaacaagccagaagcagcaaagtttttatgtggatctcccttccctaggagtttcagaaggccagagcatctccttgagacacccttgtgatttagatttgtccatgggaaatgaaggagcctgaatccagacacatctttttgtttctatctttgcactccccttttgcttctttctctttggttttcttccttctcttttctggctcatttttgtcatcatcttcctcacaggcaaccataatttccttgaaaataattattataataataaaagcaatagctaacacttattactcatcatgtgccaagcactgttctaagcactttgcatatgttaatttaatgattgcaataattttaggacttgagtgccatcacaatccctagttttcagaaaatgaaattgagattaaggggaattaggtaacttgcccatgaaataaaatgctataacagcagcaaaatccataattaatttttttaaagttagtgttctttgattctgtcacttggaaggaaatgcttccctgaatgtgtcttatttctgcgggaacctctattaaatgttaggcgcacagatttagactgggaggtgggatgcaaaagagaggcaaacaggtgaaacatactcaaagaattaacagcctaatggaaaagatatagaagcaaacaatcccaacaaaagaacagaaagtgactgcttctctcataatgataaaaatcttcaagagcaagtcgatggtagtaagtaaaggctacctcacagatgaggcaacattggagttgggctttgaattaattaaaagattaattttaaatttgtaatgaataacaataatgaacaccaacatgtattgagctacataataataattatgtcaggtaccatgtaagaattttatatgaattatttatttcttagcacaaccccatcagataagttccattagtatctccattgaacagatgatgcaacagtctcagagagatttgatgacttgctcaagttattgcagtaatataatttttaaccaataagctagaaatggtgcttatcaactatcagtgacttcatttttatcccccctggttgaagagatttgcactaatctagtttttaataatttttcctttgtagcaaactgacttggatttgtctaatgctcctttaattttcaaagtgattttataggtgttttcatcttgttcttaggtagggctggctgctagtttacatggatgtcaaaagtgacaccattcattagggcgaactctggaattgtaatgtagattacaacctggagtgtttccataagaccagataatcaggtgggtttcattggctttctagagagtggatgcctggcgaggtgggttgagaggtactccgacgctctgtgcaggctcagcagggaagaatgtggtgatttgtcagggaggtgtgctgaggctctactggagtgggtagaggaatggttgtagggcaaagaagaaatgtgtgttctttgcagaatagagacatttggcctggattgtgtttgactctgacccaataggttgtccgcaggggtgataggaactaaacagagatagtggctgaggaaggaactgacagacaaccagaggctaaagaggagaagcagtctcaggggtcactttagagggaccctctagagagtgcccaaaagccaggtgcacagatttagagaaggaatagcttcacacatcttgcagacgaatacaatataaagctattttatgagttatacatgaacaaaaaggttaaaagaatattgtggaattcaatgaaagttacaaaattagtatccaggaaatggacttgctgcacagaaaagttattttgcaagcttattccctggaaagtcagtaaatgtgaatatttctgtggaatcccggcatacatccccgtgtcataaataagaatgtttgggaggactgagattttgtccctatgctttccaaagatgcagaatgggtgattcagagataggttgtggggatatggggctaattagaataaatttgtcacagacttattctgtggaattatttttgcctccagccgtcttagaccttattgtgtgggagctcataagacttcatttcctggaagccaaaacatgcctgagaatgttttcattttgacagagactatctgacaccttttgtttaagaaacaatggacatatacatagttttatatacatatacatatatacatatatagttttataattttagtcttatagttttagtttacaattaaaaactatatctatatataataggctatatctatatctatatagactaaaatatctatatattatatatagatataatttttaaattataaactaaattggttaaaatggacgttttaaccatgacacagagagaaataagttttatatttttcttttagcacttatgctaactctcgtgtcactaagttaagacaaatagtgctggaaatatagtaggaaatattagaagagagagaaaatacacctgattttatccagttacaggttatcaaatggttttaaagtaattcttctggccaagtttctagaaaaaattggtttttttttccttgttttccttttcccttcttttcacaagtgttgaaaattgtttattatacctaccattgctcctagatatatttttattgttaatcaattaaaaatgtatttagggtaagtacaggaagaagggatcaaattacaaagtgtctttcttggatcctgaaattgatggtgaccctaatacaagttaacgatcatcctagccattctttttctttaaaattgggtatagtttcagggtactgtgaagggtatgagaagagtaaaaatatacaggaggtaaattgaaaatggataactatatatagcgtctttgtttttatcattgcatacgttttatgcttgtgtgaaatcaacgtattggcaatgactaataaataaaactttagagcctataaaaagaataggtaaaaggaataaatgaaaattaggccaaaggaaatgaattcagaacgtaaatatgatccctaagcagaactaatgtattgcagaagtgtttccaggtgggggcaaattagagaaaactggaccctaaagtactggtgacaataatccttccttctgccctggggggcaaagtgacattcgaaacatgttactgagggtaggtctgtgattttgacacagcttctggaaaattagagtttttctctctcctcctgtttgaaatctttatttttcttagataataaatgaacatgaattctctccctatagccatacattgtttagaattttggtttatatatatatatatgtgtgtaatatatgttgaataatacatatatattcagcattaaggagaaggaaaatattggatcaggcccaagaatccttacatatacatagttttataattttagtcttatagttttagtttacaattaaagactatatctatatataataggctatatctatatctatatagactaaaatatctacatattatatatagatataatttttaaattataaactgaagtttatcctacatgagcaattgtacactggaaacagaatcataatagctataatcatattgcatttaacatgttaaagaaacctgatgtataattgatggacatggtaagtacgctacatggggtaacttcatctggccctttcccactcatcctttgggtctcaaattgaatgttacttccttgccttcccttagcctaaaatgaagtcaggactctcctatgactctgttactacctttcatacagttttcctttcatcgtgtaaatgtttcttctgtttcttcattttctttctactttttccagaatctataagctccattaggacaggaaccatgtctattttacttatcgtggtgacttaaatcatagtgcttgggacataatagttaaacaaaaatcatctgtacaaagagaaaataaagaattgtgagtagttcatagtgatacttaacattaacattacttgcatagacaagccaagttttaaatgtattattttctccttggtagtttaagtgtccagaatggcattagtgttaatagtgttccttgatacgtaaataggtaaacgtttgtcacttaaatagacattgcatttgattgtttggaaagacaatgtggtaaatctctctgtctagttctagagttccatacggctctgcatgatgagcagggcttgagctctgtgttctctgctgtctatcttccatctctgtctcattccttctgcatttgaatgaaggagtaaaggaagctagacatgaatgagctaaaactttgtgcatagaagagtattgctaagccctttccctttctctcatggatacaatatttgttaagtaaattaataaatttctccaggtgactgtttttttctttccagatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggttggtctctgggtaggtgggtcagttaagggcagctcattagctctcaggaaggatttacatctgagacacagacctcccgttgggagccaaaggctattcctatttgtgagtcgaccaccttattaagcacctattgagtacaaaggcagagcaacatggtcaagtatatatgaacaatcctgttcagaccgctttctagttttatgggtctcacctccactaacctccagtggagatcataccaatgtgaaatcttgcatgaattgttgagtctctgtgaacctcatttcttcctttgtgaaaataagaataatggagactactttatggagatgttgtgaggattaaattaaatagtgggtgtaaaaacttatacaggttgaacatctctgatctgaaaattcaaaattcagaatgcctcaaagtctgaaactttttcagcaccatgatgccacaagtggaaaattccactgacctcttgtgataggtctcagtcaaaatacagccaaaacttttttcatgcccaaaattattaaaaatattacataaaattaccttcatgttatatgtataggtatatatgacacataaatgaactttgtgtttagacttgggtctcatattaagatatcttatctcattatgtatatgtaaatatttcaaaatctcaaaaaattcaagatctgaaacatttctggtcccaagcattccagataagtgatgttcaaccagtgtattattcctttctctcactgctatgaagaaataccaaagacttggtaatttataaaggaaagaggtttaattgactcacagttccgcatggatggggagacctcaggaaacttacaatccagacagaaggcacctcttcacagggtggcaggagagagaataaaagtggagtgaagggggaagccccttataaaaccatcagatctcgtgagaactcactatcacaagaacagtataagggaaactgcccccatgattcaattattgccacctggtcctgcccttgacatgtgggaattattatgatttaaggtgagatttgggtggggacacagagccaaactatatcaaccagtatctcagtgtccgaactgattaatgcctaatgagtatttctataacttttctttgtttttctttccattcccatttctagtctttcctttaaacacctctctttttttgtcctttctactcttctttatcctttatttccccacttggacttttccatttacactgtacttgggacaatggtatatttactcatgaaaatcaaaatattacaagaaaacagtgttagagatgttgaaagccaatataccactgattgactattaaagcccagatttttgttgatttcaaagaaactttggggaagttgatctgcttttttctttgttatttataaaaccacattgaaagcctattgtggaattcaggatggccacagcaagccctgttcatcatggtatggtcaggttactctaatttcacttgtttcttttaatccagtctggaaagtaaatgtttcatcaaggtttggagtcaagcacggaggtgatctgggcaagccttgttgagtaggcagaaatctacttaagatgtttgagagagaaaaactcccaaatatcccttctctaccacagatgctctagactcctggagttccaccattagatatgtatttctttagttatgagttaccctaaatgtgtttgagtggatggacaaattatgtaccttgatactagtagatgtgcttcctccatgacacagggttggaggttaggagtatgagaatgtacagtactgtgggtcaaagccacgaaaatgaaaaggtgctagaaagaatctagatttaagtttgatgtggatattaatcttgaaattctctccagatcaccccttcttctcctcaacctccaccctaagcacatatgttagctctaccctacttctgttaccatttgtgctgggccatcctttcttctgtcagcatgttatttctctgtatatattgacaagaagattaatttaacattaaattggacatgtatttccccatttcaaaggattctccgacttaccttcctatcaacttgacttcctcttcacagaattctaagatttgctgaaatacctacaaatagtagaaacccactcagataattgttagttactctgagctctgggaaaacattattggttattatgaaaatatgagacattaacctaaaatataattttaaaataaacaataccatggctagctgagttatagggacaaataaattgtggtcactagttgaaagactgtaattaaaatagccttgcccttcattctaaatgatctatgcttatgcaagagtacaatagtatacattagacccaaatacaggcatcccaggattatgtagaataatgatcctgagctgggtattagagagaatgtgaatcctactcctagcacataaaaagctttcaagaaatatttttgagatgaaagcatgaaaatatccaacttcagacattcttagatgtgggactttgggcaagtctctagctaaagctctctaatcctcagttcttttaactgtaaccatcttgtgtatatgtatgtgcacctgaagtatgttaagtcatagcttttattacttaaaaaattctccaacttttgtattttgatgtaaatatttactatttaattttgatgaaattgacctatataagacctagattacccaggcaaatagtaatctgaattttgttgctctgaatactcacctcaactctttaatacaagaaactgactgagagatacaatggtaaaaattggaattaaatttaaacaagagaaatggccatgtggaagtcaataagtagataatttatacattgcaaattatcatttgaccatatttgaaattaatgaaatgatattgtttctggataactaaacagataaatatgtatcagaatgacttattaaagaaggcttaagcacataaaaataccaagagaaatagctgctatttgctggtggatactatgtcctagagggttttaaatacatcactcctttaaaaaataagattaggagctacttttataatttttagaaactcaatcatttggaataagcctgtctaccaagctcagtacagatatatacttaatataagagaaggaagaagcattgctttcagtgtggcgggaagaataatagactgagaatggagaaatctatgttatagtctcacctctaatccacactagctgtttgtgggcatgtaacctgacctctttgaggtcttcacatttaaaggcagacattggacttcatcaactctgacgctgatcccaattctgacaatctgatcttccaacaggcctgcataaagtacattgacccctttcacctctggaaaatcttaatgtagctcaacgcccttcatcctagactttgaagcacagctcagtcctgctgtctgttctgacctggctccccagggaatcatgcattttgtctccaactctaactaatagctgcttcataattctctgagcccaaagagctctattcagtaccaaaaacctctaacagcccaggagagacccaaaacctttatcagtgtttcaattcacaaccataggctgatttggattctatttctgtcttgtttacactcaaaatccttaaaaaccattaaatcgtacaacatggagtataaagattcctttaaactcatagtcagccaagttcaaataggctgtaccttgtacaactccagaggaaccattcacgtagaccctagtatggttgcaatgtagtggccctgcactcaggacatgtaagccacagtgcatcccagtgctggagtctactggttaaaaggctgggctctggagccacatcactggatttctgaatcttctctctaccattaatgaactttgagtaaatcatgtaacatttctgtgcatctgtttcctcaactgtaaaatgtagacaacagcatctattatacctcatagagttataagattaaatgagttcatccgtgcaaagtgcctggcaccgaccgagcactcaataaatgttaattgctgttagctgttttcattattattctgtcagaatgactgtttcctggtttgtttttggaaagaacaagttttcttgttcttctggagccatgcaaaaggtcctggatccccagacagaatttacttctctctgttcaattcctccaatagacgtgaaaccaaatgttgtgttagaattttaaaattaggcaccagggccggacgcggtggctcacacctgtaatcccagcactttgggaggccgaggcaggcagatcacctgaggtcaggagttcgagaccagcctcaccaatgtggcaaaaccccgtctctatcaaaagtacaaaaattagcccggcgtggtggcacatgcctgtaacccagctagttgggaggctcgggcagaagaatcacttgaacccggaaggcagaggttgcagtgaaccaaatggcgccactgcactccagcctgcctgagtgacagaactagactctatccaacaaaaaaaaaaaaaaaaaaaaaagaaaaaaaagaaaaagaaaaaagcaccaggacacctggattcaaattctgattctctagattcaaatacacttatcagttctgtgatcttggggaagccacttaaccttctgcatatacatatttttttctataaaaggaaagaatcattcttaggattgttgtcaaggattaaataagtaatgtgtgtgttagcttctatgggaggtctgacacctggtgggtgtctaataccggttggatgcatctgttggaacatcagctgccttatcccatcgcctataaagtgagaagtgacatgtctcagtttttaatgactttcctcccctcttatgttttattgatgagaaattccacctccctcttcaaccctcatcaaattctataacttaggcttatgtagtgaccctgtttcctggcccacaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttttgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatag

SEQ ID NO: 17071 - DNA, 9369 bp, Human
  misc_feature (1)...(9369): n = A,T,C or G
tggtgaaatgagagtgttaggctagattgcctttgaagtcccattttgtctttaaagtcccatctattgcagtgatttatatttaactcatgacaaatcaggcttctcttattctaagtgcaagacataaaacttttattgtggaatttcaggcatcagtaaatctttttgggtactcacttatgttcctgaaatcaatctatttgagtgatcactcttttaggtgcccaggtaaacaaagaaggccatggtctttctttgagtgaccttctttcccttttaattagtctgacctctttaatgtcagttctgactgattcatttccctggtccatcttccttggtctgagggccttcctagtttcatattgcacttcagttccttccacaccaccatcaaggatggctgtcaacattcatttgttctatgttataattcaaggaaaagttgcccagtagctaatccaataaatgccctcttatgggcggctagagactttttcctataatttaaatgcatcttctgtagattatggtccctccaccactttacatttgtctgctgtctccttgctctgctagtcatggaacgtgttggtagtgggggcagtgtgggatgttcaagggcacgtattgggtagggccacatatgggcattgctttgtgccattctttctatatttttggtattttgcatctcactggaacccaactatttttcatctcttccacctaaactatttgatgcctctgtttcttatatataaagtatagctcactgtagcctatgatcaggaacctatctgctttctaaatgaaagctgttttggtcagatctagcaattaattcccttcttccacttatagctttcctctgtaactctggtgtaggtatttggtatatggctataagatgtgaaacacctgaatgattctgtccatgcaggcatttcagttcatgatattgtatgtaaaagatactgattgtctaggtgttcagaaacacctatagggcttaatattcttacaatcagtttgaaggctggtgatacgcaaagcaaactacatatttttctgcctgctctctctctttctctctacatctctctttctttatcttttgaaatatcagtttggagacttagaattacataagacataaacccatttgatataagaattgctgtgtatatttgctcatctactccctcctttggtcctcgagctgccggtttagactttttacaggacgcaggcatgtgaaggagaaactgtcagtgctaggctgaattctgttgttaccaagatttctagaaaagtattcctcagtcaggttgattacagatatagcaaatctatttttcctagggtagtttctgtatgctgccgggcttataactgtctgtcatccagctatttctctccaccttcttgtttgcataacaaccaaggcaacttccgcaaatcactgcgtggagacgatgatcctgccagctcccttttggaaatcgtgaggatcagatcttggaccatgtataatatgatgcttctaatccaaaagaggaaaggcattgggagtcagctcctaagtaagctccagaattcctgctggtacttttccttccaggaagcaacttccttgatattttttttttacaggcatatgaataaaaactatattttgcagcattgtacactttttttccttttctagaaattctaaacctctgacattggtggagacattgagtacattttttcccatatccctacttttcagaaggattttctctgctcgttcacttaacattgctgatgcgtcagtcttttcttcctcatctctttcaggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggaggtaagattgctttcagccattaaccatattaaacttttggctagactttctcagttatttacatgttgtacttactaacctagttctgtgcaattagaaacagtgtggtcaggagagcacgactttctaactttcctccaagactagctagatattgtgacttaagacatgtgctccccaaatttcagcccttatgtgttgttttgtgtgacctcagttttgagaactgttctattctttaagccaggtctaagaaagctagttttaattaagaagcgagatgaggtttgaggctatgtacagtgatctgtaatatctccatctgtgattactactgctatttgagcatccctggagtacatagaagcctggctctgggctttctgattgtatgctacaacttgtttcaggaaaggtaccccagaatgaggtttggctccatcatcagaaaggcactatgctttccgtgtggtggtgcagtaactttcactctctatgttcttataagcaaatgttacaatgagatatgagttttaaagccagatcttccttatctctctgccccatctctagttcttgaagtgtctcatatgagtttggttgagaaatattgatcattacaaatcagttaatagttttgtagaagatctcatcttaaagacattgttttgttaatatactcccttgatttttttaaaagaccttacagacatacagctattcatttgtttttggtttgttcaaaaaaggtataaagaaatgcattcagagaaagatcatatattagccagttgaaaattaaacacaaaatgagtgcatattacattacttaatcttgcagtcaaaggtaaaaagtcaacctaaaggtatactacctgctttcttatcgcactgcaaatagaaattaccacaaattttattttggaaataatctcagaaaacataattttttatgtactattaaaacatttactttccaaatattctgtcattcaggagtatggaagtatcgatggcttctttaaaatgaagcaggagggtctggcagagagtatctatgaaataagttcctctgaccttcacgcttaattttctgaatggagtggagcaaattacttcaagcttcacttaacttgcatatgaaatgaaccgtacaaaaatacaagagtgtcaggagaaagttatgctctggtaaatattttgcaaaacagataaaagataatactagagctctgtcctcaaagagttaagcagctaatctaaggaggtaaactctatgtcagcaggatgaactgctcttccctttcctcctcaataaattgcaaatcatctagtccaacatctttaccaccagtgcctgaggctccagaggagccattgccttctcaaggtcacataggtggtgggtgagttaggaccaaatctagaattcctgactccagtaacttctgaagtcattttgttttttatttttatggttttattataagaatacttgctaagcacacttaccccctgcattgattaataactctaggatctcaggtggatccagcacatagaaatatgaattcgtttctatttggacttcatgatatatttacattatcaccttggaatcaccctaacattcaggattgtatcttgttataatcaaaaaggatgttgcatcccctgaacagtcatcagtcagggaagcagaggagggaaagtaatcttgcgaggaagagaaaatactatttaagggacagtcagagaacataatggaattcaaactttctgggaaaacctacatacataaatgtattagtggccatcctaaatgtctttatatctttgaggctttattttccctactccaaatagacacatttagttattcatttcttttaaaatggtatttctctttttaaactatttcttgacttttttaataaaaagagatgcaagcaagaggatatttaataaaaagtaagagagttgagcttaaggcttattaaaagaccccctttttctagttagtcaggagctctaatgtgccctggctacctattaaatggtggcaataaactggaagctcagtgatgactctagcctgcttctcctaatagctgttaagcctcaaatgccctttagagtgtgtatgtcctttaaagtagctattaagaaggaaagcagcagcagcagatattgtctagaaagaagccccaagaagctgaggtttcagcttgggcatttgttttcgccatcccatgctccatttccctctgctgggaactgtgcacctcagtggtattctccctctatacctcacagcaggaactgcttgccccccccacccnnnnnnnnnnnnnnnnnnnncatgtgttcttgagtattaagactcgaggatctgcgctttttaagattgtgttcgtgacgtggcggtcgtggccacccggtatgatgacagttcggtttctctctcctctacccctcttactatatgccgcttcgatagaggaacccccccccccccccaacatacatggctggaactgaatagacttttactttcccgaggtgcttctacagttccctctgccagcaggggaacagatggaaatagcaatcacctgccagaaggtggcgtgcagcaaggatgtgcatcttttgccgctactgctttctgattcctaaaaattactcagagatcactcatgtgttcagtgattcaggttctgttgaagataccaaagatattcggttggtcaaaatgacgggcatataaaggcttctcaggtttctgaggtaaactgaagggtcagaattccagttgtggatgaaggaaatggtgttatgactgcctcaaggttttgtagcaagtcatagggaaccaaaagaggaatcttgttttcctcagaggtcatgccaactccaactcccgttccctaaactgtctctgagccatagactagtaatggactcttcaagctctaccattaggtatcttttaaagaaagctggttattactatttattcatttttttctcttctgtgcagtgcaaaagatatgaaacatcggctaggtttcctgctgcaaaaatctgattcctgtgaacacaattcttcccacaacaagaaggacaaagtggttatttgccagaggtaagagaaaaggccttggtgaagatgtacttagtattaactatctgatgatggggatgttctgtgagaaggaacttgtgctcctagttaagccagatttggatcaagatagcctccattttcatggagatcataactacatttgaaatttctatacatttagtgaaaaactgccctcatcaataacatattttgtcataacgatggaaaataaaatctttgccttcattcaggatcttagatttcttgccccaatttttttaccatggcattccaattattctgtttctctctattttttctagagtgagccaagaggaagtcaagaaatgggctgaatcactggaaaacctgattagtcatgaatgtaagtctgacagcaacctgggatgaggtactctggataagacaagttatattatgctggtctaatagaaactgcagcaaggcctggcttctttctgatgttcagactcaggagactctttaggtcttaaattcagtctgtttaaaattttaatatgccctagagctttgtgatatacaatgaaaagtttatgcaggaaccatgtggaaaaccatctctctcatcacaaggaaaaacggaagagagaaaaaaaatgataaatatcaataccttcttgcaaaatcaatctcagtttctctttcccaaattgaccttggtaattgatagctgcataggcatttcagaagcaaaatacttccttgaaagaggcttccaacttgagtaagaatcattaggtagaactgggaaccactggatatcaaacacagattggggttacctgactccaggtgacttgaaaaaagcaggggaaaaagggattgcttgaatccatgctttatcccccaagtacctcagctttatgtgaaatagcatatccaagaggccaaccagtgtgatgacaactgtggtcctttctcctgtatcataggtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtaggttttttatggatacataaaaattgtacgtatttatggagtatgtgtgatattttgatacatgcatacaatgtgataacaatcaaatcagggcaattgctatatacatatctcaaacatttattatttctacgtgttgagaacattccaaatctcctcttctagctatcttaaaatatacaataaactattgataactatatcaccctaatgtgctatcaaacactagaacctattccctctacccaactttctatctattccttctacccattagccaacctgaccaaaaaggtaagcttttatggcagagaactctctggatcttagtgaaggttcctagaatagtggagctgactatcataatcttgacaaccccaaataaatcagttttttaaaaaatctcttttatccatgtggcttaccataacctccctgcatgaatttttctgatgaatctccccaatttgttagacagaacagaagatcttgccctgctctctctaaagcagaaaggttcattctgaacctttcatactctctcacatgtgccaaggaggaccccaatgtcacttttgttttttgcttctgaaatacagagggtgcactgccacttacaagtcactacaaagcatacaggcttgcatcctcaacagggatataggtctaatgaagccttggcctttgcccctcaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttg

SEQ ID NO: 17072 - DNA, 23497 bp, Human
taaagttataaagatttcagactttatagaatctgggatttgccaaatgtaacccctttctctacattaaacccatgttggaacaaatacatttattattcattcatcaaatgttgctgagtcctggctatgaaccagacactgtgaaagcctttgggatattttgcccatgcttgggcaagcttatatagtttgcttcataaaactctatttcagttcttcataactaatacttcatgactattgcttttcaggtattccttcataacaaatactttggctttcatatatttgagtaaagtcccccttgaggaagagtagaagaactgcactttgtaaatactatcctggaatccaaacggatagacaaggatggtgctacctctttctggagagtacgtgagcaaggcctgttttgttaacatgttccttaggagacaaaacttaggagagacacgcatagcagaaaatggacaaaaactaacaaatgaatgggaattgtacttgattagcattgaagaccttgtttatactatgataaatgtttgtatttgctggaagtgctactgacggtaaaccctttttgtttaaatgtgtgccctagtagcttgcagtatgatctattttttaagtactgtacttagcttatttaaaaattttatgtttaaaattgcatactgctctttcattgaagaagttttgagagagagatagaattaaattcacttatcttaccatctagagaaacccaatgttaaaactttgttgtccattatttctgtcttttattcaacattttttttagagggtgggaggaatacagaggaggtacaatgatacacaaatgagagcactctccatgtattgttttgtcctgtttttcagttaacaatatattatgagcatatttccatttcattaaatattcttccacaaagttattttgatggctgtatatcaccctactttatgaatgtaccatattaatttatttcctggtgtgggttatttgattttataatcttacctttagaataatgaaacacctgtgaagctttagaaaatactggtgcctgggtctcaactccacagattctgatttaactggtctgggttacagactaggcattgggaattcaaaaagttcccccagtgattctaatgtgtagccaagatcgggaacccttgtagacagggatgataggaggtgagccactcttagcatccatcatttagtattaacatcatcatcttgagttgctaagtgaatgatgcacctgacccactttataaagacacatgtgcaaataaaattattataggacttggtttattagggcttgtgctctaagttttctatgttaagccatacatcgcatactaaatactttaaaatgtaccttattgacatacatattaagtgaaaagtgtttctgagctaaacaatgacagcataattatcaagcaatgataatttgaaatgaatttattattctgcaacttagggacaagtcatctctctgaattttttgtactttgagagtatttgttatatttgcaagatgaagagtctgaattggtcagacaatgtcttgtgtgcctggcatatgataggcatttaatagttttaaagaattaatgtatttagatgaattgcataccaaatctgctgtcttttctttatggcttcattaacttaatttgagagaaattaattattctgcaacttagggacaagtcatctctttgaatattctgtagtttgaggagaatatttgttatatttgcaaaataaaataagtttgcaagttttttttttctgccccaaagagctctgtgtccttgaacataaaatacaaataaccgctatgctgttaattattggcaaatgtcccattttcaacctaaggaaataccataaagtaacagatataccaacaaaaggttactagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaataggtgagatattttgtgtttttcttgtcttttctctatatcaaaattttttaaattataaaatttgcattaatttgtcttgatttattattcatatttattattccacatggagaaaaaatatttaactgatggatatatttaaatgaaagaaaaacttgtaactttacaagaggtttacaaagttatagcagtgtttaatggatgaatggtttgtatgtttcatgttgaattaatttttacacttcaatggtatgcatattaactttgaaaaattatatatatacacatatatgtacatatatatgaatataaataaaattttatatgtgaagaagccagaattatgctccttcacataactccctcagactagtaaaatagataaaatctttgtttttaatacagaaaaatgggtcattatttgatggtctgaagaagaaatattgtgactgggatatgaatggcaaaccgtagtacaactatgttcaaaagaatgcctgaaatatatttttaaccatttgactttcaggacagttacagcactacagtacagggaaaaaccaaacaactggaagacaaaatctggattttagtgataggtctactataaattatgcttgttaacttcattccttagtttcctagttttcttttcctcaagtataaaattaagatgcttaggttatccctaatgttcttttaattctgaaactgtacagttctaactgaaacacaaacattcatatgtaacaatgattactttcttggttgcagttgaaaacacgtttcatgaagtttattttgctttccagcttccatattggattcttaccaatgtactgcagagataagtttagctgacctgtaagttttgcttatataaatgtactttaaatgtgtaaagcaaggataagtaaatacttaaataaaattgggtacccctgtgagctcttaaaagcacaaaagcaatttggacaatttcaagaaaagttactcatactgaatatcaacttgatgttgaagaggttaaactgttgactaatgtcttcgacattgaccttttgattccttgaaatctcatgagtcaaaccaaatcagattttagaaactgaagattagtgtctgatcagtgacagccatatactaattcaggaatttttctcatcagtaccaacagggtgatattataatgttttcttttctgtatactatttaaatcttagcagcaaaccataggtgataaaatattctatttgctgttatttgtggagagtatgttagtctcttggatgtctttccattccacattttaaaaatttctaacaaagaatttaaagtagtgtgttgctgttactccttgcacatccaaacctgcataaggattgctttgagtcaatccatgagcactgtagtcttgggttttagaccttgatcatactgggaatagacactgttagaggtctgtctaattaccaatttttttttgcttaaatttaaaagtaaccataaagaatatagataccctcaattatgggtacattacagtagatggatggtcacagaaggagaaaccactcttatgggaaatccacttattttagcctttaacatctatatgtatatttatggcaaaagaaaacaagaaaaagactaaagtttcttctcagatgacctggaagctaattttacataattttacaaatcaaatgtctaaacagattacaacataaatagaaaacaaaacaaacaaatgaaaaactatacttgagaaaaataagcttgctgcaggtctgttccttaaggattcacacgtatttttgtttcagggctaccatattttttgcccagtttgttcaagaagccacttacaaggaagtaagcaaaatggtgaaagatgcattgactgcaattgagaaacccactggagatgaacagtcttcagggtgtttagaaaaccaggtgagtgaataattttaaaaaagcattgtgatatttgacaaaaatttagcatgctgaagagaagatacaaaaatagcagtgaaaaatgcatttaaatatttgaagagctattgtatgaaagagggattagattcattctgaattgctaaagagggcagaagagaacaataggtagttattataaagagaccatataaatatgatgactgagagctaaggttctgaaataagattatcttgatgactatgggcatattaacttttttgagcttcagttttcttatctgtaaaataagggatgataatagctcccatttcatagttagcatggaaattgatataacagcaatagtagctaacttttattatacacacaatgtgactggcattattctagggagcataatgtgtatattgataataaaaatattttatgacataggggatagatagcactgatgaatcagaatggttgtccagtgagtcaagagatgctggctcgggcttctgggcaggatatcagctttgcttacctatatttatttattaaacatttaaaataatccttgaagatagatgctaatcttccaactgaggaagctgaggctcagagaatttaagtaactttcttatgggaaccaccaaatggcagagccaggatttgaactagaccatctggcttaaaattgacagtcttagtagcttcattacactataactatagtgaatgtaagatgcatagcacatcgttagggttgccaggtttagcaaacaacaacaaaacataatacccagttcaatctgaattttagataaacactaaatacttttcttagtataaggatatttcattgtagaagctcaacaaataatatttattatttattttatctcaacatagaaacaaacttgataatgattagaactctccaattataaaacaacatgcccagagaatactctgttatggtggggttaattaggtggctgaaagacaatgtacctggaatatcatagaagagatgctcctttaaggatatagtttaagttctttccaactttgaaatttatgaattgacaaaaatttctgttttgcatctctatttttgtcttgttctgataatcttttcaaaatgtgtataaaaaaacaagaatacattatctattgcaactttacaaccaattagaggttcaaggtaatgttacagatcgctgatttattcttgtaaattcaaaggtatgtcttttaaatgaggattgggaattagaaatcttacgtaagccttccaggattctctaaatattactgtagcagctataaaagctacataaaagttccctcagatacatgaaacacatgtattcctcagatgctttctgtggaatattgatgctgtcatctgagtttggtaagggtaagtcacagaggaggaaacacatacattttaaaacattttagctaaatatgtaattgtggccaagaaaagtgtttttttaaaaaataattatttcatttcaaaatcatttttatttataattgaaaataatatgcagttttttattgtcttgtaaggatggcatgtaaaatgagcatttatgtctgaaatgtggtatgtctgtgtgtgtgtgtgtatatgtatatatgtatgtatataccataatatatacatatgtatttgcaattccaaaagttacatctttaatgagaatcatgaaaatattattttgctcagtttctttttttatttaaatttaaatttaaagttctggtgtacacgggcaggatgagcaggtctgttacataggtaaacacgtggcatggtggtttgctgcacctaccaacctgttgcctgggtattaagcccagcgtgcattacctatttttcctaatgctctccctccctgcactccactccctgacaggccccagtgtgtgctgtttccctccctgtgtccatgaaacatggtttatatatttataaaagtttatatatcctagtccaaatttttgataacacaaaaaggaaaaataaaataattcaaaattgggaaagagaaacaaaagattgcatggcttttttccttttattgtttggacattaaagtctcattttccataaggcagcaaagaaatctatttcatcaggctgaaacaaaatacattagaatttgtatggaaaatttttcagaatctatagttctgattttagacattagaaaatgtttcatgtgtcttatagatttttaaagcaaagttagttgtctttctccaaacataaaatatttcttatagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaagtaaggatccagtttaaaggtagatgcaaacctcagaaacacagcaatggcaagcctaatttagtatttttgcaatgtactcatgtactcccagtaagaggtataatgtttctttggtgttgtgtctgctgaggtcccaggcaaggtaattaggagagcaacattcaatgtaacttggtttccatagcacgctagatgtagtacaaaccacaggacaaacctaccagaggttccattagtcccttgagagatatacaccttttttttttctttttacccattctactctcaattttaccttgttcaagaatatattagtattgcaccaaattgatgctttccagagccatatattggtgttttgtgttcacctaattgcctagaaataaaagttagagatccaagcatggtcaagcatggtcaagatacacagacatggcaaaggtttactgaacacttaggatgttgtggggccgggcgcggtggctcacgcttgtaatcccagcactttgggaggccgaggcgggcggatcacgaggtcaggagatcgagaccatcctggctaacatggtgaaaccccgtctctactaaaaatacaaaaaaaattagccgggcgtgatggtgggcgcctgtagtcccagctactcgggaggctgaggcaggagaatggcgtgaaccctggaggcggagcttgcagtgagccgagattgcgccactgcactcccgcctgggccacagagcgagactccgtctcaaaaaaaaaaaaaaaaaaaaaggatgttgtggaaacatgtctgcttgcacagaggatcagattaacactcacaaacaaactttgaagcctccttctcctcttcctcttcattcttcttctttcccccattttgttgataggaaattgaaggttggaaggctaaaacaactggctaagggcacacagctagtacatttgaccccaggttctctgttggagaagcctgtacgtaactcttcatcacttctgccttccatgttacttcctaaaccagataaatagagagattgcccttagaacatctctgctatggcgactatccaggtgcataaccccattctgcactgacaagggataaaatgtccatctttctgttgcacttagcagaagtctggctttgctgatccctgaaacatatctgagtaggcttattgaaaaagaccttttaataagaatcatggttagcatgtctgcctattttcttctcataatagaatctggtaccatctgtcagatatttttccccccaggatctttagtgaggaaaattttgacaacatgtggaaaaaatatgatgattttccccttaggaacacagtaaagacaaagtcaaatgcattttgttgttgttgtttttgaatctttaaataaatcccagtgtccagttccaagcagtagtagtcctatttttaggtgtttataaatcttctagctctattttatttcacagattcatttatgagatagcaagaaggcatcccttcctgtatgcacctacaattcttctttgggctgctcgctatgacaaaataattccatcttgctgcaaagctgaaaatgcagttgaatgcttccaaacaaaggtatcatatttgcgtggatatctgaaccagtactgtagtctatgactcattaaaacaaaacaaagttaaaaatgaaaacgtgcttaattgtggagagtatcgtttttggaatagagaaatagttcagcagtctgatattcttcgagtgaacaaaactggatttgctggtttttattatctattcattaagtcaacaataattttattattaaggaagtgagtttgatgggataaagaaggaaagacagacagacagaaagagagaaagagagggtgctataaatgggaaggagtaagtgaaagaaaacggagaaaaggaggagcagaggagagagaaaaaatgaagaactatgataaatgctttatacttactgtttttttaaaccttagaacaaatttgaggtgtaagtatttttgtcctttaacaaactaggaaagaggtttagagaagaaaattttttttaggtttagagaggtagaataatatccaccattaactacttgctaccagcagtcctataacaaaaatttcctgagaactgactactctcagtgtcaagccgtgatacaatcgtattttttgtaactgagaagacacttaagaaattagcaggcttcaatttgtctttaagctgtttaaaggtacagttgttcatttatgatccccagtataaaagttatgtttttgtttcaaggtactttgagtaaatttgtctggcacagatgcatataaactaacccaaaagaataaatgagtcaataatattctgcgataatgtatgacatttataatttttagtaaaaaacatattttatggaatttcattttacctatacttgttgtttttctaaatattagagcttgtaaagaaaatgttagtatatgctttcatgacattttgtttcctctacatctaggcagcaacagttacaaaagaattaagagaaagcagcttgttaaatcaacatgcatgtgcagtaatgaaaaattttgggacccgaactttccaagccatgtaagttcaagttctatctagggaagagggtgagagctacagaactaccattttgcaatttgggttcgtttttttaattgttgctgttttagagaatgaagacccctttgtgacccctttgatgagggctaatgggattagaaccatgaactcttaggatcagaaggaagctaacggataagtcagtttaacacttactaaagcctagctgagataatacatagaaaagacttttaaagtttatgttatttacctgttctttaagacacttaagttctggcctgccatcaaattatacctcatcactagagcatatttttctagctcttctacaaaataagtcagccttcactgagtgtcatttaaaacttttgccttaacaagaaattctttatattaattgtgtttcttaatcttctataaggctctttatagcatttattgcttcccataaaaatattcctttgaggcaataatattagaatctagtgtcaggagaaaagaacattttaaattatataacttctttaaagtactcatcaactcttttatgataaaacatttctagtatatgaaaatatctgagctgctaatcgaatagtagtaagtatatatattcagagtttatttgattgctgtttggttaaataacacgttaaagcatattgtagacaatggaaatctagaatgaagtttttagtaatagaattagttctaaagactgaaatttcttcttgtaagaagtcagatttatgccttaactaccctccaactcaattagaaattgaaagattaatttatgacctactttaaaaaaatttatcttagtaataaaatagaaattgagatagtattataatacccttatcatttgctatccataagtgaaagctaagtggtctaaatttatagagaagatccatctttatcagaagcaggagtaacactattttctctaggagcaatggttttacaaagacaactcttaaaatttaatgaaatatgcagaggaaaccagaatttttatttcttacttcttttttggccacattactctcttggcacactggtatgcctgaaatgtttaatctgctccactttcttgtcccatttcattgatttgcacatacgcctcctttcctggattctcagaagtattttttaccccagtaaaaaatggttctcattttcatggaattttccatttcttaattgtttatccttttaaagttttatgtccactcaatacaaatgctcagcataagggttgaatggcaaaaataatttaccttaattcttaagacatgttttaggaaaagataaattatttctaaaccatttgtggggccagctcacagtttacagagctaccaccttgaaagatatggctggaatcaagccttaaaacatgtttccttttctttttaaacaacaagggaatttcagtcatttctctttgaaacttctactgtagtaatactctataaattctattttattttgacagataaccaagaaattaatttctaatttcttttttttccctagaactgttactaaactgagtcagaagtttaccaaagttaattttactgaaatccagaaactagtcctggatgtggcccatgtacatgagcactgttgcagaggagatgtgctggattgtctgcaggatggggtgaagagtcttgcttcttaaaatagaagattttcactcccttttctttctttttgtctcattctaaaagggagaaggttgtttgacttgaattggttacagagtatgtaaactaggtgactccttaaatttgcagaattctcggtagtaaaacttaaaccatcttttgttgatcctggctttcactttagctatacccctttttgtgaaaccaaggctcatctatttcttacttctaaaaaaaccgtgggaacttctcagaaggcttctccatagttacttggaggacgggaggaaactaaggtttaatgtatttattttttcattcatttattctttcatttgacaaataaatatatattaaatactttctatctgctagccactatgacagacacttgttttaaaagcacaggctgacctcaaggaattcacagtctgataggagagataagacagtgacctccttggagttagggactgccttggtttactgttatctccatagcacaatgcctggcacatggaaggcattctataatagtttgttaaatgaacgaatgcaataaaaattgcacaagtaactgtcctaccaggtaaaaagctagccttgccaaagacaagtgtgaataaagtggtctcggagaattagaaaacaaaatttaaaaaacccagcaacagtttcttgagtgtgctctagtcagtggtggtttaagcagtgtggcattggcttattttggctaaccctagacttcctagattttacaagagaggactgttgaccctcagattactctgtctctgtgggctccatgacacaccaaagagattaaaatccaaggagcttaaaaattactgctcttaggtactcaaatggcttgataaccagcactggactatggtttccagaaggctgaaagtgaagataaaatgctcatttcagcccatccgatggcaattcagtgagatgcttgaagtaagcaagaagccgaggctgcagaggaggcctgagagtgacagtccctgaggagctggggaagaagtgggaggaggcagcctggcaggcgactgtactactttacttgtttttcttctagaaatatggcatactaggaaaaccaacaagaagtattttgtttttctttgagctcagttttcccattttgaacggacaattttactgtttctcgttgtcatttttaaaaagttaattttttcaatttttggagctcataaccacccttttcctttaaagtggaaacattaatttcagcatgatatgtaagttggattttgatagctgaataatgggttctaattatctttgctgagaatgtacagaattttcagtcccatgacaggtatatatgtaagctctgcctctctctggccacttaggtgcattgccattttattatctatagactgccctctgaaggtcatagtcagtcactgcagtatgttctgataaagatgattatcattcttacggaatttctcgtggagcagaaagtttgctctccatgttatgataccagttgcaagtgttgtttaggggcaaatttgaatgctaatagaaatacatatagcaacatgcatcctattttatttgagcacatttccctcttatttgtaaaggttttcaattgaaataacataggatttagcttacaactatggaaagaagaattgaacaaacaggtaagtggaaaggaatgagaaaaggcaaaagtggggagaaagcactaaaacgggagacaagttaaaatttctttttaattgataggtcacgttctcactctatttgcctttaagggaagaaagcaatcaagttaatatgttttccttcattgtatagtatgtaactacggacactattagaggagggatttgtgtagcacttaggacattatacttgataatttccaagggtctttctagatttaaaagtctgattctaacgtagtaataaaaataaaggcccaattttctctttaatattgcctgaagatattactctattattgcattaaaattaaacattcacacattgtttgcactgctaaataaaattatgtaatttcttcttctttccttcctccttcccccatccctctctatttccctttccccttccttctttcctggccttttttccttctttctttgttcccttctccctccctcccctttcttcctttttctaaagctggctttgagatcctttattaaagaataaatctttaaaacttatactttattttccctgttgcaggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaaggtaacacactctgtaaatgcatgttcatgcaagtaaaaatgattatgtggctgacagatttgcgttgttgaaatggagagtgatgattatggtttttgagttcaatatgtgaggatatttggctagaatgttctgagccaaaatagatttcagtagataaccagggaataagtaatgggatttggtgtttaacggtgaagcgttcaccactgtgactcattaactgctttgcttatgaagctgaattttatttcacatcaatttctctggaatcagaagcattgtcatcctgtaaagattactcatatcaaggccaccattgaactctcaaataggatatggatatttttgtaataagaagagttcatgattaagaatgaactcttgctacgcatgttaaaaaaaaaacttttctccaaaagataacacaagagataatgctaggtagaagaacttttataggaacagcttattggctatgtattaaatacatgttttgtattttttaagaaaatcaaaacatgtttagagacatttgcagtacagtagtttgttttaatacaactgataggtcacgttctcactctatttgcctttaagggaagaaagcaatcaagttaatacgttttccttcattgtatagtatgtaactatggacactattagaggagggatttgtgtagcacttaggacattatacttgataatttccaagggtctttctagatttaaaagtctgattctaacgtagtaataaaaataaaggcccaattttctctttaatattgcctgaagatattactctattattgcattaaaattaaacattcacacattgtttgcactgctaaataaaattatgtaagctagaataaagttcagatttaggagacacatagtgacaactgattggtgacagaactaatcctataatctgggaatacggttagtaaagtcaagaattacctttaagtttacacatccatgcacatctaaatctaattgtttaatagaagcagttcttcagttgcaaaggttctttgcagtagaattttctcagccaggaatgatcttcccccagatatttgcatggcttctttcacttagctgatctctgttctgatatcagctgcctagagagaattttcttgaccacattcaaagttagtggcctctccaccttgggtatcatccttttttctctttttcatctttatttattttcattgatttatcgctaactgaaatgagatggcctatttcttgtttatttgttctgcctccctataatgtgtgcttttcagagggcaggtatttatcttagacatcattgagtccgttctgcttaaagcaatgctagcaaagagtggacactggaaaaatatttgttgaataaatgaatataaagtccgtaattgaaaagtcaaattgagagatgcaggagaaaacaaaaagccattttacaggacaatttgaaggatcacagtctgtattaacagttttgccattcatataattcaaatcatatttgattttcaggtttatttatttgaatttaacttccacatgccatattatataggaataactggagaagtgatggctccttttgtctcttagttccaataacttgaaatatttttctccacatatttcagttttgttcatgaatattcaagaagacatcctcagcttgctgtctcagtaattctaagagttgctaaaggataccaggagttattggagaagtgtttccagactgaaaaccctcttgaatgccaagataaaggagtaagttgctctagaattttaggggagtatgaaaaactggattgatatcatctgttaaaaatgctgtttgtttgaaagcctctagttttcaactagttgttagccagttatatctatttgtctagatattaagctgttattaactagcagtcagcagctagtggcttgctttagaaacaaaaatgttaattgcttctcagccttttggctaagatcaagtgtagaaataaaaatgttaaccaaaagtcctttgatccacaaataaaggtagtattcattattcatttttggataacttcagaaaggcaagaatttggtacagaaagaactgtaaccatttatccaaagattgagttttgccattaaatgattttgtgatttataaaatgttaaacttaatctccccaaaatccattttctgtaattatcaaaatttacactttaccatatttaatatttaaacatctctgattggttttataatagtatataatattgatcaattttatatacaaagttatgcatccaagaaaagaaaaatgtatatgtaataattcttcattttcaggaagaagaattacagaaatacatccaggagagccaagcattggcaaagcgaagctgcggcctcttccagaaactaggagaatattacttacaaaatgcgtatgtttttgtaaacagtatttttagtgaattaaaattattaaagagaatgtagccttccccattctcctcctttggaagcaacaagaatgacctgtgaggtctgatctgtggtattgactttaagttccccatactgtgcaaatttttgcagtaaagatatccattctgtcatagtctgtccgagttaaagcaccaaaagatcacagttaaaatcaatgaagctccgaggttgagaatacaagtcaggcttcctcctggagtttgctttttcattgtgatatgcttctataataggagtacagggagtggttgttagagtaaatgcatctcaaaagttggttcaaataccatgtagatgaaacaaacgagctgacctcatgtcttctggcatgagagtagagagtctgtgagaagaagcaaggcggctaaaaactcatgaatgactcagcaggacttagttaaaaaatgcttctttcaggtttctcgttgcttacacaaagaaagccccccagctgacctcgtcggagctgatggccatcaccagaaaaatggcagccacagcagccacttgttgccaactcagtgaggacaaactattggcctgtggcgagggagcggtgagtgtctgcttggtttggtcccatctcatttctgccctgtttgacttgaaatagcctcataattcccctctagggaagacggtaaaaaccaatgtagagatggccttaggaggcttgtttgattagtcacggttggaggggtgtgagaacccagctctggatggctggcatgtggccatgcttcctattcctccagggtggctggtggaagttcagccagtttagtcaacaatatctgagccaactttatatatcggaaagacagaacgaccaacatgtaactcataattcataacaattcataattcataacttcaaatcataatttctgctttttgttcatatacttactttgatgttttaaaaaagctttatctttgattgattaaaattagtcatgctattttagccatatttatattttcaccttttgtaacatgatattattattatgacatcaggaataattggttccctttcgcagggtatagggtacagcacaggataagtattatgttctgaatagtaaaatgactttcgagtcagtaatgccaatattctttacttcctaatgtcactagtatcatacataagattacaggatgaattaaaaatatttttcctataaagtcataattgcaaacaaaattgtctattttatcctttttcctctttttcataatggggagttatttgctgttagtcttcatgtcatacattttttccccaaaggttaagagtaaaaggagagttcttgtgattaaatgtcacctcaattgtttgttgaatttcccatgctgggaggctgcagggatgcaggatggtgtaatggttcaggagtgtatgttccggaggccaccagccaacaaccgcattctactttcactattctttagttgtatcacagtgggaaagcaacttatgtcattaagcttgagttttttcatctgacatttgagaatacaaattataccaccctcatacgacagctgttttaaacaagataatctgcataactcacacagcactagtctgacagataaagtgcacacaaaacatattatttcttattacaagttattactaggtgattaagaaatatctcctaagtaggcaaggtagcaagattctacattaggaaagtcttaaaaacccacaaaattgctcttacttcttttcaattaggatgatatattagctgcaagtgtatacatgtgtatatgtatgtgaataaaaggggtaagtttgtgctattcttaccttcagatagtgattatcaaaagaaaaatggaaagttcaactaaatacacatgggaaacataaaggcagagacatttttgtcctttagaagtgtgtatgtaactggaagcatgtttcaaatagctgacacaaatagctaaatgactatcctcaacatcacatatggaccatctgctactacttgctaaggcttagcccaaacaaatgggtaaatcctggaatttacaatataatgtcacatgatcctacatagcaaattttcctgtaatattaattataaattgctgggcattagaaattattgcagcagttttctgaaaaactgaaccaactttgtgactaatgcccaatctccttacttttttttctcattctcctaaccaggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtaagaaactgttacttgctagcatggaaaagaatgacaaccccaaagagtaactgagacttctacctcgctcacctaacactattgggctcactaacagagcgttactcccaaaacacttaaaatgcctttgaaaatagttttgtctcagtgtcttcacagtctcattggggaagcaggtctagaaaaatcgacgagggtggacaatttcctgtttgtaaaaataatctctgttgtaactgttattgtgatatgtatttgggggttgaggaaaagtgggcaatctattctgaggaattagagtgtatctttgcagcaaatttgggtacttccattccaagcacaggaaacacatcattgaatctttttttacactatttacactttgaagagaataaccatcttatttaattcaaccatgcagtttgggtgttaagaaatgacatgtacatttcagttcattgtgggagctcttttgtaatggtgatggtcatgcaagtcaatggagcttatgttcttcaaactcccatgcattttaatcctcacttgttttgtaaatagtcttccttcattggaaaacccattcttctcttttttcctctatcacagtctgaggtatgtttcacagtatgataagaatgttgcctgttctggcaagctttttctattgctctggtctactttctattgctctggtctaagtccaacatgaaaggcttgctaagtgagcagtgcaggcaattagtgctgccagtgcccagataaggggtgtgataactggatgggcaggattcggagatctgggtctttgagtgtagataagacacagttaagaagagcggacaggaaaggatattcctgggggatgaggggagattgccttccactacacataagtatggtcaagtatgaaatagtgttttatccacaacctgcacaactccaggctggtggaacacttggcatgttttcagcctcaatctttctactgaaagtactagacaaggtgtgtgtggtcagtctggtgataggttgatggagtaagggtttaggctctgaaaattctctactaggaaggctgtagaaaaatagcattgcataacagacttctcttgtattttgttttgttttaaatcacaggtttctcattaaccttgtgaagcaaaagccacaaataacagaggaacaacttgaggctgtcattgcagatttctcaggcctgttggagaaatgctgccaaggccaggaacaggaagtctgctttgctgaagaggtacatgcagctcatttcatactcaaaatacttgctatggaattttctgtagtggataatgaaaggaagaccctacaaatttataactttaaaatattttcagagagatttaaatttcattgagaagcagattgagggattctataagatttaaaaaataatcacattttcttgcttaatattaggaaaatttataatattaaaatatattaatagaattagtaattttaatttatttcctagtagagaaacccataaagtgaatgtgtaaataattgacggtaatttagatagtttctggcctaaaattgatcaattcagctaaatggattaaaggatttaatagcaaattaattgtgcaaacagagtattaggagtctatttgtagaaaatgtttttgaactcatttagaagcttgcttttgtacatcaacagagtagtatttaggagttattttaattacatagtaattttagctggataattagccagattttctttaaccaggggattctacctaacatttaaaaaaattaccttttttcagctttattgaggcatgattgacaaatacaaattatatatgtttagggtgaacatgtgatgtttcaatatatttatacattgtgaaatgattatcacaatcaagataattggctaaattttacaaatctttagtttgtattgctacatatatttgaatatagcaacactatactttaaaaagatattctataacttagcgtttttgtcaattttacctttctcaccatgtaaaatccaaagacagatatatttagaaatgtagagtttttctataaataatataattagatgcatttgagtgtgtgcacttaccagtatatgtgtgtgtttttggtgggatcaggtagggtgggacatagataaccaaattagataaaactggtgaaacagatttgatgtgaagcatttctgaaaaacatgacacaagaagattaatgttctctaatctgagaagacatttatttagatatagagaacatgaacaaatagtagcagtgctttatctgcaaaccttttaatttctaataacttgtaatttgtagaggaaggggaaagattgagaatacgcattgatttggagattgttatagaagaaaactgttgatgtgaaagaatattgttttctccctggcttttactatcccaggttgttggcatcagagatgtgtttcttcatttttaacttagttaatctacaaacctatgaattcaccccggattgtagagtgttaactgtatgattggtataataatccatttctttatctgattatgtttattcttaattttcagggacaaaaactgatttcaaaaactcgtgctgctttgggagtttaaattacttcaggtaacaaaacattcagacaagcctgaatacaatgttgtttctccagaaatatcaatccataatgagatagatcatgaggagtgccattaattctcttaaaaatacatggaattcaaaaaaaagtttattttaaaaacacttgaacaaaattacgcacacaatgttaaattagtggctcaactatgcaaaatcctttttggttatttaaaagacttcaacaaatgctatcagaagactttcctacgtatccaatatttctctgatataaaataatagaaccagttacttactgcacctattagtttaattagtatttaatatatttttgctcatattgcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtttccttttccaagtttgcttatttatgaaaagttatcgataatttctttagttttgtataccattgtctgaagcagattctgttaaaatagcattaagtgttggttgttataggagattaaagctatccaaggatggatttacagcactagatcacttggtgaactgaaaaatgttcccaagttaaacactatttgatgctaccagggcattttgtttattaaatgaccatcactgaagtattctaacagataatctggagatgagaaaagaaattattattcttctatgggatctaagaaaatttaacatctactttttttctcaatcttgttcagttctctattcacagacattttaaaacataagaatattacagttttgattgaatataattaatgttttcatcaattaaatttttattccacaaatgtttattaagccttcactgagttccaggccttgggctgggtacagtcactgttctccagtcgcttcagtagagaaggaagcaacacaataatgatgcctcagattatgaccacaaggagttgacaacaaattgttgagggaacgaaagggtgggtgacatcagttctgactggaaaaggtgccataaatgtttaagaagagtcttagaaaatgaatgagcattcatcagttcaagtaaaagagaaggccattttatgaaagaggaaacatggtcagaggtactgggtatgacaaagtatgatgaatagttttagaggagtacagggtaggtaggaagggtagagatgtagaatgttaggcaggatgtggaagctatgaagggctaatccagactctcagcgctctattctaaagaggttggacaatatcttatgagtaacagaggaccacagtgatagctaagcagaggtgtgctattaataattagctttgaggaagataatctatgagatacggagcatgggcaatggggcagggaaaagggtagagggggcaaagtcagcaagaggtgacaaaaagaccattcccccagtagggaagctgtttatcttattagctttgaatagaaatctgaaaattacatgcatactttggcctgggctctgggagaagacaatggctttagagcaataaaatgtgctttcggttcttcttctctttttttttgaattggaatctgctatgttgcccagctggtctcaaaatcctgggctcaaaagatcctcctaccttggcctcctgagtagctgggactagagccatgaaccactacacctagcccttttagttctaactagattgctttctacttgacatttttctttccattgtactgcaacatctatgaactttgtctgattttggtgtaattctaaaaggtattaatttaaagatcacaataaaataaaatcacgttcaatataaaagcattaagctggaaaatgctttatttttttaagggaaaagcacaatgaaggtaaaactgttagggaaatttgtgagtcaaataatattttgttgaaatatataaagaaaaaatgattggaggcagaaggataaattgacgtaagtacaattgtaaattggggatttttaaaaatttattttatttatttatttatttttttgagacagagtctcgctgtgtcgtcaggctggagtgcagtggtacaatctcggctcactgcaagctctgactccctggttcaagcgattctcctacctcagcctcctgagtagctgggattacaggcacgcgccatgacacccagctaatttttgtatttttagtagagacggggtttcaccatgttggccaggctgacctcgaactcctggcctcatgatctgcctgtctcggcctcccaaagtgttgggattataggcatgagccactgcacccagccaaattggagattttaaaacatctctacctcattaacagaacaagttaggcaaataacaaataaagactcagggtattaaactgctgtagtcaggattaccaac

SEQ ID NO: 17073 - DNA, 72662 bp, Human
  misc_feature (1)...(72662): n = A,T,C or G
gggccagggttcagctcagcatgattccaatgtgtaagaggtagatcaaggaggagctggttgttaaagagcaaactcaggtagggaggaaacctgggacataagaccagagggaagagggtatttggaagcaactgtggtcaatcgcgtcaaatactgggatgagggcttgtaaaatgaggactgaaaatgatccgctgcatttacagtcatgaagcttgtctgtggacaattcagagccacttcaggtgagcggtggggacactggagagggctgggaggtgggacatgaaagactgtccatggggtaagagacagctgcagttgttggagagcaatttagggagaagagaaatctttttaaagaattgaaagacttaagcatgtttaaataccagtaagaaagagccggtagagaaggaaaggttgagagtaacagaaggaaaggagactcgttaagggcaaagtccataagaaaacagtagggtacctggagtaccaggaaggacaactctttctttacaagagaagtgagtcatgggcggagtccagaatcgaaccctctctgcttcctaaagacacgtctcctttaaaggacagaaaaagaatgattaagacttgaggccgggcgcggtggctcatacgtgtaaccccaccactttaggaggccgaggcgggtggattacctgaggtcaggagttccataccagcctggccaacatggtgaaaccccgtctctactaacaacacaaaaattagccaggtgtggtggcaggtgcctgtaatcccagctactagggaggctgaggcaggagaatcgctcgaaaccgggaggcggaggttgcagtgagccgagatcgtgccactgcactccagcctgggcgacaagggctagactccgtctcattaaaaaaaaaaaaaaaaaaaaaaagacttgaaaccccaaggagagggctgcagagttcactatcaaggagaatggggacctagtggtgccgtcctgagagacctctgaaagaacaattcagtagtttccagccacggaagtccccctgctgggtttagggtgcagtgggtgcgaatccctgctgtagaaaacaggctgaggaaagaaagcgacacaggatgttgtctggagaaaggcggggaggtaggatggggcatatttccaggggtccgggcaggttgtgtggcttggaggcctccgagggccgtcgacgtcagccatggtccgggcagagccccgcaaggtgccacagtatcggggccagcgccccccggaaaagcatgctccgctggcggccgccaggtttctccgcggagtctcggaaaggaaaacccgtccccacgggggtcccacgacgcccccgggtcccaggccccgggacgttggcagaggcgcagcagaccttcttccccagcccgcacggctccagcggtccggccgcgtcccagcccgggctgcccgtcccccgtctcccggcggcgtcggaaagttcccggggctggcggcggtcaagagcagagccagggcagccgcagccgccttctagcccgccgctcaccgccgcaggggcaggcctgagcgggggtttccaccaagtcgccgacacccctcgggaattcccccactgggccacacacaaaccccgcttcctccttcaaatttccgctgccggctttaccgatgcgaaagccgcggtggagtttagaccactcctcccggcgccgggctcagcccgccttcgccttccctctccccgcggaaccccttctcgtcgcccgaagaaacccgaaggtcttcggcaagttccgtccccagcgcgggggcggggccgctcgagctgctccgggcctagctcggctgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaagaggagcaggaggaggaggcaggagccagagagagccggggggacggaggggggacggggaggcgccggacacccgcgcttggggccttcccctcgcaggaggggccgcggtaaagatggagcctccgcccgagccccacaacatcgccgccgctcgcagcgaacaaagaataatggcggcggactggagccagcggcggccggggcggcagcgactctgcctgcagccagcggcggcgctcatggcggggggcggcgggcggcgggcggcgggcggggtgggagccggcggccgggggtgtgtgcgggcggccggccgcggcgagctggcgcccgcgttcccgccgccgccgccgggccgggcgcggagccgggaacccggagccgccccgggggaggccgcccgctcggcccggcgctgccccccgcgccgctcgctcgtccggcccccgccgcccgcctcgcccccggcccgacccggccgggcctccggggcagccgccgcctaggtgccggtgggggatggaggaggaagaaggcgacagttgagggcagaggaggtgaaggtgcctgctgccttcccggtggcttcggtgcctgccatgcccgcttcgcaaggggaagagctgcaacgtctgacctactcttctctccactctttgtgcaataaagttcgaaacccaaggtttcctctcgtgctgtattttattcgtgccctttcccccccgctcctacaccgttgaggaaatgctgctttctgccctgtgttgcttagttgagagatgagagcttgtgcttttggggggaatttttgactccctcacccctttgctttttttttttttttaaagtcagtcatggaaatgcatgctttttgggagaaagggtgctaagaaaaacatttataataactttttaaactgttgggatcttataaaagggaagctggtgtttgaaaacagtttcggttttaaccctttttaataaggtaatcatcacttgagatctatcattctgaaacacttcgttggaacgagtatcagccgatgtactcttgttttacatcatttcgcggggtgcaaccttgccaaccgcgtttgggtcatctggatctcccctcaccctccgtcccactccccctaccatatttcccacgaatttctgtgtgaactttaatgagagattgatttaatactactactaaaaatagacattaaagtatccattatttgtctcatgcagtaggtaacccccgtcttgagattgacaatttaagccacaagctgtattttttcttcgcctgttgggaaaagaggacagcagagaagtcattgacacattaaaaattaaaagacagtttttgaaggacgtgcggtatgacctatttaagtttgtaataccatctcaagttataattctaacctcagctggcgtctaacttctgaaggtttagtagaagatacttttgattgctgcctattgaaatcttttacatttatggctcatttcgtgatttaaaagtaaagccccgaacagttattttaggtggtgcaaaagacgaacaagtttgttttaaaaatacttgtctgtcactgtatgattgcattgtgattgatacgtacaaaccttctggttaagaacaaatattgattggcagcagaagcactgtcttatttttctgtattctagtcacttttccaaaacgtgctttgctgtattgcttctctttaaaagaccacattggcaatttgtcatttccaagaaaattaagaagaggcaataaaggcaggttttctataaagattggggaaatgattttatttccgagcactgaaaaaattatagtattgataatggtagcttaccatttttcctttatgttgttccgcaagccactatcagtagagtagaattttttttcttgttaagaatataagtcgggcgcggtggctgaggcctgtaatcccagcacttggggggtcgaggcgggcggatcacttgaggtcaggagtgcaagaccagcctggccaacatgatgaaaccccatctctactaaaaatacaaaaattagccgggtgtggtggcacgcgcctgtaatcccagctactcggggggctggggttgcagtgaattgagatcgtgccatgcacttcagcctgggcgacacagcaagactccgtctcaaagaaaaaaaaaaaaaagaaagaatatatgactcttcatttgtgagatttttaaaaaattgttcactgatggccgagtgcggtggctcacatctgtaatcccagcactttgggaagccgaggcaggcggctcacgaggtcaagagatcgagaccatcctggctaacatggtgaaaccccgtctctactaaaaatacaaaaattagctgggtgtcgtggcgcgtgcttgtaatcccagctactagggtagctgaggcaggagaatctcttgagcccaggaggtggagattgcagtgagccgagatcgcgccactgccctccagcctggtgacagcgagaccccatctcaaaaaaaaaaaagtttactgataagttctttctttagtcttgcccgagtagctgggattacaggtgtgagccaccgcgcccggcctgttttattatttatacattcataatttgtgattcttagcaattcccaggtgaaacttcaaacttgtattcattaatacttgaacattcacctggaacatgttactaaattnnnnnnnnnnnnnnnnnnnntggtgacagcgagaccccatctcaaaaaaaaaaaagtttactgataagttctttctttagtcttgcccgagagatattttaaattgtattttttatttttatttttatttatttgtttttttgagacggagtttggcccttattgcccaggctggagtgcagtgggctggtctcggctcactcactgcaagctccgcctcccgggttcaagcaattctcctgccccagccccccgagtagctgggattacaggtgtgagccaccgcgcccggcctgttttattatttatacattcataatttgtgattcttagcaattccaggtgaaacttcaaacttgtattcattaatacttgaacattcacctggaacatgttactaaattgtacttctgcactgttccagccatggataaaaattacagctggatctgcttgaatctttttttttttttcatgaacacctacatttagaaagctaataaattacttgacagagtttgcttgaagaatgttaaaagaacacttctttgggaatttaaaacttaagtgttacctgttttgaatgatttttttttttgtttacataaagagcctgaagaaacttagacacctgatccataaaaatggcacctttttctactttctgaaactcatattcttgattaggtctcattattagaaattttgggttcttcatagagaagtagctttatttctctctcattctaagacatttggttttgtttgtttggatacagtatggttatggggttatagtaaaaccaagtatgtcttcctcacgtgtttttaaattctactttttataacagaaaattatttttaacctaatgcttacaatatattaccgaaatttataatttcatttattccataaatagcttatcagatatgagttacataaacttgtttacagccagcttgtgacatagttttgcaaatatcttgatatatggtgtaactttgatggcttctttattgaatagagctcaaatctaaatttaagaatgtaatgagatgtcaagatggaaaaatgcaggatttttttttttcttacccatgtgtaaactcatctgtactgcagtatcacttgagacagcagtttatggtaattcaaatatttatttggcactcactgtgacagagaatgtagttgaaagagcatgaggtttggaatcataggcctaggtctgaatccaagcattgccactgctatcctgtacccaccctaaaggaattttgtgtcctgaaggaagtttcttaatctttctcagcctcagtttccttatatgtaaaattagaatactactacttatttcataagattgcgagataaacataaagtaccttagggctacaactaatgatagctagtcccttaagctttattttaacttcctacctgtgggcccttaggcaagttatcttaacttcttaatacctcactttcctttctgatcagtgtagaacaactacctcagaattgtgggggttaactataaagtaatacatactaagtcccaggcattgtgcaagtgtcgagtgctcaagtgttgacaaggcttttttcttttgttttaatttttttttgagacggagtcttgctctgttgcccaggatggtgtgcagtgatgcagtctcagctcacggcaacctctgcttcctggattcaagtgattctcctgcctcagcctccctagtagctggaactacaggcatgcaccaccacgcccggctaatttttgtgtttttagtagagacagggtttcaccatgttggtcaggctggtcttgaatgcctgggattataggcgtgagccaccacgcccagctggtctgttactttttaaattatttattattactatatgtaatacagtgggtcagaagctacaacaaatccaaagatgaattacgctgtcttatctctaccctcaggaactgttggggacacagtgactaaggcaaaatatgtgtcaaaagaaagcagtcaaaggaaaaagggatcacctttggtgaagtgaggagtatattttttatatttctaatttggttttttgaataagtaattcattcacatgatctataattcaaaacataataacagcaaaatgccctacattctcttgccctattacctaagtgttagcaattttttatttgtcctttaagaggtgttttatgcaaacacgagcaaatatgtatgtacagtctccccctttttgtacaaatggtagcatactaggtatacgctctcctatatcatgctttacccccaccacttaatatggcttagcaattttgtatcagcacataaagagcttcttcattttttaacatacaattggaagcattttattatgtaagtagactgtattaaccagttagtgagctgcttttattcttaggtcttatattaccttttaaactaagggaaactgccatcttgcctttatttctttaaatgaaaaactttctatttgaatgaaaaataaatagtttgtgacaggaaattgttatttaaagtccctcatttcctgtttaactccagtttttaaaagttttagtaaaatgatcaaaatgtacatgaggaggcaagcaagccaggttaagagttaactcacaaggtgaatttaactcttttgttgaggttcttacagttctgaacagactacttctttcaattattattttggcccaaaaggtttttatagctttctttcttaatgagaaagaacatttcatatagtccggtgtttttttgggttttttttaacagacagctcatgggatattattacccagtaaggctgattactatactagatttctccctgcattcatttattttttacatacttgttaacttaccttgacgattttctagtatttcttaatgtaattatgtgagttttatattttgtacctaaatttaaaaatagtgagattcacctatatgattgctgagatgataaactttactgcatagatgatttttttacccccgtggggaaacctttggtcaaccagttggaccaagtaatacgtatttcagccaaagcacaaaatgcgtttcactaccttttttttttcctctagcttttcgaaacagcattgagctacaatacttttttatttatttatttatttatttatttatttttatttatttatttttttgaggcaaggtttggctctatcacccaggctggagtgcagtggcacacacttggctcactgcaacctctgtttcctggctcaagccatcctcccatttcagcttcctgagtgagtgggacaacaggcgcgcaccaccaggcccggctaattttttgtagagacagagtttcgccatgttgcccaggctggtctcaaactcatgagctcaagccatccacctgcctcagcctcccaaagagttgggattacaagcgtgagccaccatgcccgaatgctgtagtacattttaaatatacatgctgtttgtatttatctttaaaatgtacacactatgacttttttgagttgattaaactcagaaagtgattaataatatagcagcaagggcacaaatctctttccagaaaacatcattaagtaaagctgtcatgggccagtcgcggtggctgacgcctgtgtgatcccagcactttgggaggctgaggtaggtggatcacctgaggtcaggagttcgagaccagcctggccaacatggtgaaaccccgtctctactaaaaatacaaaaattagctgggcatgggggcaggcgcctgcaatcccagctactcaggaggctgaggcaggataatcacttggacctggaaggcagaggttgcagtgagctgagattgcaccattgcacgccaggctgggcgacaagagcgaaactctgtcttaagaaaaaaacaaaagctgtcatggtatatttcgttttttgtattcccaagttggtgtttatgcgttgatcatatatacaaagtttttaatgtaagaatattgttttgaggttttactaatatttgatttaaaatattactatgtgctatttggccaggcgtggtggctcacgtctgtaatcccggcactttgggaggtcgaggcgggcggatcacttgaggccaggagtttgagaccagcctggccaagatggtgaaaccccatctctactaaaaatagaagaattatctgggtatagttgtatacgcctgtagtcccagctgcttgggaggctgaggcaggagaattgcttgagccctggaagtggaggttgcagtgagccagtatcaccccactgaactccactctgggtgacagagcaagatgccatctcataaataaaatattactgtgtgctatttgtacctgctaaatgattaaaatgtttacaaagtgctttgttgttgttgttgttgttgagacggagtctttctctgttgccaggctggagtgcagtggtgcgatctcagctcactgcaacctccgcctcctgggttaaagcgattcccctgcctcagcctcccaagtagctgggattacaggcgcctgccaccatgcccagctaaagagacagggtttcaccatgttggccaggatggtctcgatctccttgacctcgtgatccacccacctctgcctcccaaagtggtgggattacaggcgtgagccactgcgcctggcctacaaagtgcttgtctttacatatttggggatgggggtggggtagatcattgaaatctgtaaaggcagaacgttttttatctggaacatatctgtagactaacagagttaaatgatttcccacagtgtcatggaatcatcagtggattgcctcttggggtggaggcaaagatcattaaagcagcaaactgataatgtgaacgtggttgttttttctctgccaattaaatatatgctagtttagtcattatagaagagccagatgctggtcagcttgttgaagttgtaagtagaaggtgtggttttatcacatctgtaaatgtaggtttttgagacaaaacttaaataagaatagacgttagtttttattcacattcagaatgtctgactccccttaatatatacacactcttgtcttatctactgggtttttttgttgttgttttttgttttgccttttctctctctctttttaagctctgccagacaaggccctatgaagataggttttacaggttgagaatcttttatctgaaattcttgggaccagaagtatttccagttttgggttttttcagattttagaatatttgcatatacatacataatgagctatcttggggatgggacccaagtctaaacatgaaatttgtttcatatacacattatacacatagcctgaaggtaattttatacaaaatttttaataattttgtgcatgaaacagttttgactgtgaactgttacatgaggtcaggtgtgggaatttttcatggcatcatgtcagtgctcaaaaagtttgagattttggatgttttattagggatgcttaccctgtattatattttgcccagatgtttcctcatttgtcttctaggctaccagaaagatgttagcttagaaaaacgtattctggcgtttattccaacagatgagaaggcagtttctccagtgatgaataattacctataatttaatacgtgcattatacatctccagtgatgaaaaatcactgtgtattaaaaaattcttgaagctaggtacataatctcaactcctaaaaaagaaaataaacagtagtactccttgatgaacttacagatgctaagttgccttttcttagagttgaaataaggtgataaaggagtttaccgtgagactagctgtgtgaacaaagatgaaaaacaccctttcagttttcttcctcttggatgattctaggatctctaaaaaataatcttaaaaggggcgaggttttgagaggatgaggtctaaggaattgatggtgagttttttctgaaagaagagaagtgacatttgattagataagaaagggttaaaagggaagttattaataaaatagtttaggagtagagtggatctgaaagttgacttataccaatgatgatagaatgtgtcttttcccaaaggttagtgcatcttctctgaaatgaagacgtttctttcatcaattttaagtgaatttctaaggatctggttatctacttgtgagtttttggttgtaactgtatgacagtacagatgtaactaaaaatgtttgtaatttacccaaggttaaataaccattatttttgagggctgttatccctgttggtataagtaagtagttggcagtaggggacacagaaataccttgtttttcaccactgaagtgaaaattacagattattctgaattatttgtactcttttttttttttttttgagaggaatctcgctctgtctcccagcctggaatgcagtggtgtgatctcggctcactgcaacctccgcctcctgggttccagcgattctgctgccccagcctcccaagtagctgggattacaagcatgtgccaccatacctggctaattttttttttttttttttgtatttttagtagagacaggatttcaccatgttggccaagctggtctcgaactcctgaccttatgtgatctgcctgcctcagcctccgattacaggcatgaaccaccgcccccagccctatttgtactcttaaaggggagtcattttcttataataagtatcagtagtagctctattgtttgctgtgatcaatggtgacaccttgactttatgtattgccatttatcaatcatttattcagtgaagatttattgaccattgactttattatggttggtgaaataatcgcaagaaaatttattcagttaggtatttataaaaatacctaggtattaaatgaagattgttctagttgatataagcaataaagcctgactatatggctcctaccctcaagaatcttacggtatagtagggatgatgaaatagtgtaagaatgatttatatgtgccagagtacatgacagagtttttactgtcttgaagagctacagagttcagaagagaaggggcttagtgaggaaaagttttgtgggagaagtagaattcaagttgaatactaaagaacttcagtaagtacagataaaatggagtgtattctaggcagtggaatggacaaaaaaatgaaaacatggacatataatgaacttgacatactcataaattggtgaagaaagtattagattatagatctacattttgaggaatgctgagtatgaggcagggagctttgagtttcatgtaagagaaggtaagatataaacaggaatacaatgataaattgggctgaaatgtagatttcctgactcccaattcttctccttagtgtagacagagatatacagtcatgcactgtataagaacgttttggtgaatgacagattgcatatacaacagtggtcctgtgctagtgtaagcaaacctattaagaacttcagataggtccttcaggaggtattccagaagaaggcattgttaccataggagatgacagctccatgcatgtgattgccccttgaagacattccagtgggacacgttgtggaggtggaaggctgtgatgttgacaatcttgaccctgtgtaggcctaggctaacgtgtgaatgtctttttaacaaaaaattttaaaaagtggccgggaatggtggctcacgcctgtaatcctagcacttggggaggctgagtcaggcgggttgcttgagcccaggagtttcaagcagcctgggcaaaatggcgaaatcctgtctctacagagaatacaaaaattaattaactgggcttggtggtgcatgcctgtaatccctgctactcacgaggccaaggcaggagaacccaagaggcagagattgcagtgagctgatactgtgccactgcactccagcctgggtgacatagtgagaccctgtgtcaaaaaaataaagtttaacaaaaaagtttaaaaagtaaaaaaaaaaaaaaaaaaaaaaaaaaaaggaaaaaaccttagattcttttattgctttactttattactaaatttgctttcacttaaaaaccctttagagaaaaaatatttttatacagctgtacaatttatttgtgttttaagctatgtgttattacaaaagagttgacaagttaaaaaaactaaaaagcatatgaagttacagtaagctacggttaatgtattactgatgaaagaaaattttgtttatataaatttagtgtagcctggatgggcacagtggctcacgcctgtaatcccagcactttgggaggccaaggcaggtggattacctgaggttagaagttcgagaccagcctggccaacatggtgaaaccctgttcctactaaaagtgcaaaaattagccaggtgtggtggcaggcgcccgtaatcccagctactcaggaggctgaggcaggagaatagcttgaacccacaggtggagcatgcagtgagccgagatcgtgccactgcactccagcctgggtgacaagagcaagactccatctcaaaaaaaaaaaaattagcctaagtatacagtgcctttgaagtctacaatagtgtacagtaatgttgtaggccttcacatttctcacactgattcacccagaccaacttctagtcctgcaagctccgtttgtgataagcaccctgtacagatgtaccattttttatcttttatattttatatcttttatttttactgtaccttttctatgtttggatatgtttcgataacaaatacttaccgttgtgttacatttccccacagtgttcagtacaataccatgctgtatgggtttgtagcctatactatgtagccttggtacatagtaggctataccatctaggttttgttttctaacctaattaactaatgatgcatttctcagaacatattaccatcaagtgacacatgactgtatatgtattacagttaaaaattggacatcatagattcttttttaaacagctttattgaaatataattcacatactctacaatacacccatttggtgtgtacagttcagtggttttcagtatattcacaaagttgtgcatctattaccaccatcagtttaggacattttcattatccctaaaagaaatctacacatctcctctcagccatcacctcttaatctccccatacctgcagccctaggcaaccacctatcacctttgtgtctctataggtttgcttattctgggacattgtgtataagtggaatcatatagcataatgtccattgtgatgagctgcctttagcataatgttttcaaggtttattcatgttgtagtatgtatcagtattcatttttattgccataatagtccattttatggatatagaacattttatttgtgagttcacggacattggactttttgattattatgaaaatgctgccataaacattcatttatgttgacttgccttcatttctctgagtatatactcaggaatggaattttatggtaactgtgtttaaccatttaaggaactgccgggctgttttccaatctgctgcaccaccagcagtgtattagggttcaaattttcccccatcttcactaacacttgttatcatctgttttttggggttttgggtttttgtttttgtttttttgtttatttcaattatagccattctactgagtgcaaagaggtagctcagtttggttttgatttgtatttccctcacgactaatgatatcaagctgcttttcatgtgctgatttggccatttgtatatcttctttgggaaaatttctgttcagatcttttgcacattttaaaattcggttggctttttgttgtaatagttgtttattattctagatacaaatctcttgtcagatacatgatttacaaaaattttctcctgtgggttgtcttcactttcttgatggtgtctcttgaagcacaaaagtttttaatttttatgatttccggttcatctaatttttcttttcttgtttgtgttttggtgttatattgtgtatatcataaattcttgtttattataaacatttaaaaaatatctctgatctctgtgaaggcccaggcaaacaagataccattatttaatgaaaaataactgaagctactaatgtgtatttggagttataatccacctacctcaggccttccctttattctgtgtccatatccttcagtttgtagtgacagatgaaagaagcaaagatgaaaatcgagaaataattttgagtgaaacattttaatttgaagcacagttgtcccttggtatcgatggggaattggttccaggaccccttcaggtaccaaatccacggatgcttgagtcccttatataaagtggtatagtatttgcatgtaatcgacaaatatcctcccatatactttaaatcatctctagattacttataataccttatacagtgcctgcccatcacttgactcttatgggttcaacataggagtcagcatgcagcaaattcaagctttacttctgggacttggggatttttttcccccaaatatctttgatctgcagttggttgaatccacagatgctgaatctttggatacagaggcccagttgtaactatgatccaagaatttgttatttattatgagagaatttattataatgactgcgatggtagtttataacttataaactctaccatatttgggaaattcacagttacaaacatttacctatgaagggggagtgagtagtcattccttcattttttacaaataagctgagtcgtggagaatttaagtgatgtgtgtagaaactcacagtaagtaaggcgtagtcttcatcactcttgtagtactgcattatctctttgtaaagttttcagggtttctgttttattaatggttattaattttatttatttatttatttatttatttttgagatggagtctgtcaccaggctgaagtgcagtggtgctatcttggctcactgcagcctctgcctcctgggttcaagtgattctcctgcctcagcctaccgagtaactgggactacaggtgcatgccaccacacccagctaatttttttgtatttttagtagagacagggtttcaccatgttggtcaggatggtatcgatttcttgaccttgtgatctgcccacctcagcctcccagagtgctggggattacaggcgtgagccacggcgcccagccaaaatttgtttttttgtttgtttgtttgttttttgagacgaggtctcgctgtgttgtgcaggctggagtgcagtggcaccatctcagctcactgcaagctctgcctcctgggttcatgccattctcctgcttcagcctcctgagtagctgggactacaggggcccgccaccacgcctggctaattttttgtatttttagtagagacagagtttcactgtggtctcgatcttctgacctcatgatctgcccgccttggcctcccaaagtgctgggattacaggcgtgagccactgcccggccaaaatttttctttttaagcaatattagtttaggcttgtaagtagctcacttagggtaaatattctagccaagatcatgaaaaaatacattgatttcattatgttcttaatcagatctgcatcagattaccataaataggcagctattctttctttttttccacagttcattgtattcctaccatttccaaatagaagtttatggttttaaattactgatgttaagtacttgtttggaaggaatttatagttaaactagttataataatttatacctgtcaagctctttcatatatagtacatattttatctctcattagtttctgtaagctcttgagagaaaggttcttttttatttccaccttttaagttcaggggtacatgtgcaggatgtgcaggtttgttacataggtaatcgtgtgccatggtggtttgctgcacacatcatcccatcacccaggtattaagcccagcattcaccagctgttcttcctgatgctcttcctcctcccacccccaaccctctgacaggccccagtgtgtgttgtccccccaaccaccgatgtgtccatgtgttctcatcatgtacctcccacttacaaatgagaacatgcggtatttggttttctgttcctgtattagtttgctgaggataaaggcctccagctccatctatgttcatgcaaaggacatgatcttgttctttatggctgcatagtatttcatggtgtgtatgtaccacattttctttagtctgtcattgatgggcatttaggttgattgcatgtcttcgctattgtgaatagtgctgcagttaacatatgcgtgcatgtattgttataatagaatgatttatattcctttgggtatatatccagtaaggggattgctgggtcaaatggtatttctgcctctaggtttttgaggtattgccacactgtcttccacaatggttgaactaacaccaccaacaatgtagaagcattccagagaaaggttcttttatttttgttttgttttgttcgagacagtctcactctgttgcccagactggagtgcagtggcatgatctcggctcactgcaacctctgtctcctgggttcaagtgattctcctgcctcagcctcctgagtagctgggactccagtcatgtgccaccatgcccggctaatttttgtatttttagtagagatgaggtttcactatgttggccagctggtcacgaacttctcacctcaagtgatccacccgccttggcctcccaaagtgctgggattacagacgtgagccactccgcctggcctaattccagagaaaggttcttatatgttttatgctacagtcccatagtatgggactactactatgtagtaattttcagttctgctgaaaatgctgtagtcgttactacgtagtaggcgcagaatatttgtttaatgagtgattctctattaaagggtcataaatttgaaaggtaaaggttaagaacaatttctctttagagttgtacagattaaaggaagtgaacttttttttttttttttgtgagatggagtttcgctctttctgcccaggctagagtgcaatggcgcaatctcggctcactgcaacctctgcctcctaggttcaagcgattctcttgcctcagcctcccgagtagctgggattacaggcgtgcgccaccacgcctggctaattttgtatttttttagtagagacaaggtttctccatgttggccaggctggtcttgaactcccgacctcaggtgatctgcccgccttggcctcccaaagtcttgggattacaggcatgagccaccgcacctggccaaacatatttttctttaactgaggaaattagattcattgtccaaagcttaaaaggaagattttctactttgagtttttattaactctgatactttactatgacagtacttccagcctctgagacatgagaaatagcgtgagattgtagtaatcaaaatgaccttaccagaaatcaccaccaggttggtgaaaaacagtacatctacacagaaggatggacttgatgttgattctttcaagattaaagatgaagatgcccgaacttgaagcaagtcttttatcaaaaccgtacataaagcaaaacacactgtatgatactgtaatggtggacacatatcattacgcatttatctgtagaatgtgcaacaccaagagtgaaccgtaagattaaaaaagaaacaacaacaataggctgggcgcagtggctcatgctggtaatcccaacactttgagaggctgaggtgggcggatcacctgaggtcaggagtttgagaccagcctggccaacgttgtgaaaccccatctctactaaaaataaaaaaattagctggctgtggtggcgggtgcctgtaatcccagctacttgggagactgaggcaagagaaccgcttgaacctgggaagcggaggttgcagtgagctgagatcatgccactcactgcattccagcttgggggacagtgagaccctatatcaaaaaaaaaacaaaaaacaacaaaaacaaatcaaagcctgtacataaagtatgtactgttgcctgcatgccatttgtcagttttaaagattaaccatggtcagtttttaaatgtagtccagtatatccttggtacctttgagttcttgggctttttcctttgctgtttgactagtaagcaaaatgtaataaaagtaattagcatattgcataatagtccacatagttccattcccaaatattacagagaactcctcattttttgtaatattggaggctgttataaccctgaagtcttgaacattccttacaaatctcttgacatcttttgttctccatctgtgaagttagctaacaccagaattcctgtattatgactcctcccataacatgtgctgtctcacctcaagaaaactgaattttcactcttccatgtccaatttgtaaataattcaccaagaataacatttcaaaatttagttcaaaataacagatgttacttcataaacttatttaaaaaacacttggacattcatctcccatttggatgtagtgattttgacgtaatcactttgattttcttaagtaaatgtaagtaggctatacatatttaacttcggggcatagtaacttttgggtacttacagtttcagcattgagctagtttacgaagcagaactaacatttgaagacagcttcattctttagtcaacataaaaattgtttttgtcaaagtaactgtatgtaggaagtatgtgatcctttttttcttaaaaaaatgagctccaaatagccatttagtaacacttcatgtatagaggtttctgtgagatcaattcttccaagtgttcaaagtgtaaaaagctgtgaaacacccattaagtgggtgtttggaatgaaaggggaatggaaagagatgagataaaaatattatctaaaatattgcatagtcgtggctgctgctttgctaagcaacactgtctcttggtggtcacatacatgaagacttgtttcaaattcatgagtatagtcttacctgaaggaaaacaaggcaagtaaactttgcaaatacttaatttcaaacaaacaaacaaaaaactttaagaaagcactacagctttcttgttgaaaggcgctatagagttagtcacatattctgagatggctgtcaaaccatgcaatatgtttctatatatcagatgatttttttttttttaaattgagatggagtctcattcaccgtgtcacccaggaaggagtgcagtggtgcaatctcgactcactacaacccccacctcccgggtacagcattcttgtgcttcagcctcctgagtagctgggattacaggtgcacaccaccacgcccagctaatttttgtatttttagtagagacggggtttcacaatgttggccaggcagatcgcaaactgcctcaagtaatctgcccgcctaggcctcccaaagcgcagggattacaggtgtgagccactgcatctggctggcattatttctaacacacttctgttaaatacttccttcaagaacaatatctttgtcatagaatatgctacattttttaaaaacaaatttatttatcaaggatggcattcaaataccctggtaattacaaaactgcaatgataaaatacaaaatattgaacttaaacagtttctctgagctaaatccaataaataaatcagggaatttgttttcttaaataatattgaaaagattcctggggccaggcccggtggctcacacctgtaatcccagcactttgggaggctgatgcgggtagatcacctaaggtcaggagtttgagaccagcgtggccaacatggtgaaaccctgtctctactaaaaatacaaaaattagccaggtgtggtggtgcacatctgtaatcccagctacttgagaggctgaggcaggagaatcacttgaaccggggaggcagatgttgcagtgagccgagatcactccattgcactccagcctgggcaatgagcaaaactctgtccccgcctgcctcccccgctcccccccaaaaagattcctttttgctatttattgccctgtttttgatgactatggtggtggttgggttattttggtatttactattaatacagtttataaaagtaaacaaattttcaagcttgcttttatttttgtcatataagtaatttaaatcttatcaaattcagatcacagagttaacttcatgtataacttttcttgctttgtaatatctagattggaggctgaaataaggatttgttctctgttaaaagcagaaagaccttggtaggagcacagggaaaactcagcttgataaagataccaatttattttcatttatcacattgtctgctctgacttgttcccttaaaatatttataacctttgttacagtgtgatcagtctaatctaaagtttattcagttgaggttgatctatgttgaggagtgtgtgtacatatatacatacatgtatatgcatatgacatttgaatatgcttttttgcctgtctggtttcaatgaaagtgtgctatatttaacaccaatagactattattagcatcagaaacctggagcattgctaagtttccagtattgattagataacagctcagttctgccaggttggacatatggtaaagataaatgacaagtattttaaggttaaccctcccccgcttaaaaaaaaaaggtgcaggaaaaaaagtaggggaaaacagtagacagtgcaccctagttattgattcttggaaagctaaaatctatcgtgtagcacctgaacattataacactttagaaaattaagacatttgaaggatgtaagaatgtatcagcaaggctttggctggggtgcagtggctcacgcctgtagtcccaacactttaggagcccaaagcaggcagatcacaaggtcaggaaatcgagaccgtcctggctaacacgatgaaacacaaaaaaattagacgagctcacacctgtagtcccaacactttgggagccgaggtgggcagatcacaaggtcaggagatcgagaccatcctggctaacatggtgaaaccccatctctactaaaaatacaaaaaaattggcacacacctgtagtcccagctactcgggaggctgaggcaggagaactgcttgaacccaaggggcgggggttgcagtgagctgagattgtgccaccacactccagcctgggcgaaagagcgagactccatctcaaaaaaaaaaaaaagagagaaaagaatgtattagcaaggctttcaaacagttaccctaaaaactaaatacaggcacaacataactgtgtagacataattatgtatcacatgtaggtacttatagatatatttatgcagagtatttttagttaacatatctgactgtgacaacaaaatagtcatttagtttgaaaatcatgtgcccaaatatgtgttttgctgtggttaccctggagactttggagttctgccatgtgatttccttaaatccctggaatttttgattgctgagaattcaggaggagttgcccacttgttagtgtgcagggaaatgtgtttttctcatttctagttgaggtcattctttttttttttttttttttaaaccatagcatgtgttccattagttatgaatgtattatttctttagagtcaaaattcacgactcatttctttgaatattatctctgatcctagatgggatcaaaattgccctagatttaggagttttaaaagtttactaggttgtggggaagatgggtttatttttcataaacttgaactagaatgttgacgattataaggactgggacacttcctaaaggtcaaaatattttaaggcgaaagtatgtattctttccttttgcttaatgattgaaagaaaaagtggtaatatgcgcttgctttctattatgagctttaatttgtaatttgatgaagatttttgttaacttgctataggtagtcaggtaaggaaacagtggtgccagaatttgtccctgattcagtatagttctgtgcaggtcttgagtagatgaatttaaatgctactttattagtaagagttagatggtcagccttgtactgagaacctccaaccttcttcccagctttatttttctacacgcttcccatcatctgacttacgtgttttacttgtttactagaatgtaagctacatacaagcagagtttttaaaatttttattctgttcattgctttattctgagtggctattatcgtttaccttttttccttgttttctatgcaaagtctcttatcagccactacttgctcatttccatacagggctatagttcaaccctttgctgataccatttttcttatagaaaaagttcttccaaaacttatcaatactgtattcatcattaatgcctctttggaattctctcattctcctgactattgctgaacatagtctcttcttttaaatgctgaggaagcactcatttgacactttgctgagatgtttacctaaactacattttaaactttttaattactactgtttttactgtggaaaggggtgtgaaagtgttacagccctttactattgggaaatctaatcagataaatttcgtgaggctaggatggaaaggaaaaactttacaagttaagcaaagggactgttaattaactgtttaataactctaacgacagttatgaccagagcaacataatagataaaagacaatctccactaagagccttcattgggtaatagtatgacttgtagtttttttaaaaaatgctaataatctcaggttgtattacagtctcatggttatacagatggatgggaatatctctatttgcctaggatcaagaggctaggtgacctcttactcaatgggtcgttctttgttatatgtattagtatatagtaaaaggaaatacttcctttaccataaatgttattttattacgtggccatgtaattatggtctcagctcctaggatcagaggatttaaacttagaagacatttttcggctgggcacagtgactcaacacctgcaatcccagcactttgggaggctgaggtgggcggatcaggaggtcaggagatcgagaccatcctggctgacacagtgaagccccatctctactaaaaatataaaaaattagctggcatggtggcgggtgcctgtagtcccagctactcaggaggctgaggcaagaggattgcttgaacctgggaggcggaggttgcagtgagccgagatcgagccattgcactccagcctgggcaacaagagcgaaactccgtctcaaaaaaaaaaaaaaaaaaaaaaaaattaagaaggctatcctctaccctaaaaaggattggtaggctgcttgaatgaaatgataataaaacaccagttgtttaaatggggctcctatacacactttgttttaaaaagaaatatcgagttgtggagggaagaggatgaaaaacattttgagtatgtctttgtaactaaaatttacttggattcactaatggctttgttcctttattgtaatggagtaatattttctaaaacaaaaagttgtaatggtgttctataccttaaatgtcaaaaaagattaagtagtctcaatgtgttgtaaataaaaatgaaagaaatggtcaatctgtgcattagattgtgtttaatcaaatggtagggtaaaactacgcataccagatgacagcatagctttaaaaatgtggcttggaataaagtctttcaaaaatggttgtgtataccctgtctacaaaggaggtattatgatacatttgtatttatctttattctagataaaatgatggtttacagggggagaaaatgaagaaaaaattgtgaatgtcttttttttttttttttggtaagacagtcttgctctgtcacccaggctgcagtgcagtggcgcgatctcggcttactacaacctccgcctcccgggttcaagcaattctcctgcctcagcctcccaaatatcccaagtagctgggattacaggcacctgccaccacgcccagctaattttttgtatttttagtagagaccgggtttcaccgtgttggccaagctgatctcgaactcctgatctcaggtgatccacccgcctcggcctcccaaagtgctgggattacaggcatgagccaccgcgcccggctgtgaatgtctgctcttaatactttgactcattactgtcattgagtgtattcatttgtttattttattttattgttattgaaactagttttttgtttttatatgccattttcttcaagatgaaaattacggataacttacaggtagacttttttttttttttttttttttttgagatggagtgtcactctgacaccgaggctggagtgcagtggcaccatgttggctcactgcaacttctgtctcctgggttcaagcaattctcctgcctcagcctcccgagtatctgggattacaggtgcccactgccacacccggctagtttttatgtttttagtagagatgaggtttcaccatgttgaccaggctggtcttgaactcctgacctcaggcgatccacccgctttggcctcctaaagtgctgggattacaggcgtgagccatcgcgccgggcccaggtaaacttttgttgttgttgtttgttacatttgatgtctttcttattttgagtttaaaagaccacagtttgcaaaatataactcagtgaattaatcagttattatttgataatttgattatttgataataaccagagttatttgataatttttaagttttcttataatttagaaatacagggtgaataggcaaaatgtaaacaaaaatggtaatttcatataaaaaagtatctggtgtttaaaaaactttgtatgcatctcaaaatcatgattaaagtatagttttggcttattaaagtgttatatatgtcttctgatattaaaatttgttttaattatccaagtaatcctgaatccattctcatgggaagaaagatacttaagtcaatattaaaatactgaaatatgtgaagagttaaaggtgaaagtcattctgtacagttctacaaaattctgtttctctgttcagagctactgcttatagtttagtgtttaatcttgcacaccttttgcatgcataaacctttacaacaatttgttttacttttttaaaaaaataaatggggctctattttacaatgtgtcaatatattaattttttttcatggttacaattttgtaatggttctcttaatgatggataattgttttcaggggtttttttgctatgatttaaaaaattttacagtgaatactgttgagctacatctctggatattactatcgattatatggtcagtgcacttgtggctttatgaatattttaaataatgtagtcaagtctgttgatctttttccttgtcatctgtgttttgtggattttggtatttccaaactatattcatttctacagagttattttcatttccattttttgaactgtcacttgtaaaacactttctttttatagaaccttatgagtgatagcaagatgtattagtatgtaatacattgtgatggagtgtaatgatcacaaggatcagtgacagttttgatgaccaatttcagagttataaaataaatgaaatatattctggaaaagtcatgggctttttgtgttgtttgtggaatcactaaaggtagtccctcactattaacaaatttgttttgacacataatatgtgaggcactgaattataataggcactagaaacattgcctattttcctgaatcctttagacaggattgcttccccagttaccagagatttctctaaccttgatttacagtagctactgctggtaggaattgctctccactccacttttgctgccatccagtgttacattaccctacaaatatactaagtgcttagcaaagcagagtccaaatgtaagatcaatttttgtcttacccagaattttacaattaaaatatataaataaaagatttctctgtgtgtggatgtatgtgtacagtatagtgttgcatgctatacatggggtgaggtatcagaatgctttttcagtgtttggcacctctaatttggctctgtggccatttattccacctttctaccttgaaattccacaacttgggctcttgaaattacctggtatggtgcaatgcacgtgtattctcagctactccagaggctgaggcgggaggatcacttgagcccaggagtttgaggttgagattgagatgaactgtgagaacatgctactgcactccagtctgggcaacagagcaagacctcatctctaaaaaattttgggcttgaaacgggctgattttgtcctaccactagtaatcacttttagaagtagcttacaattgctgtttcttccttcttatggggggaaatacccttataggaggtattatgaagccaatatctaataaactctgtcatcattagctcacttccactcttctgccatctctctgtacctgattagtatagttttgaaaaattataattttgctaccactgcacctctccttgttagtaggggagatttatgtaagagaagaatcttttatttctagacaaggtaatatcccattgggaagaaacagccaagggagaagaaatgtttttttcttctttgaagggactagaacttttatagctcagcaaatttgaataagtttgatggtaattcagctacattatattttagctagatttctgagttcatttggtaacctaaccaccacatatatacctatttataacttgaaatttgcctttaaagtcacgaaagcacaaagcactgtggtgcttgtaacactcttccatattattataggtaactaaatgaccatggaatctggagccgagaaccagcagagtggagatgcagctgtaacagaagctgaaaaccaacaaatgacagttcaagcccagccacagattgccacattagcccaggtataaaatacatggagagattccagtttgtgtctcttcctagaggaatacgtttccaagagaatttagttgttattacatagatatacatagaatgagcagagatactcttacaatatcaaaattcctatttacttagtattagagtatatttagaaatgatagtattaattcaataacagtaaaatgtattattaaacaataatacagtatttttagtgaaatgatccagaaataattacattttaaacttatgggtaaatggtgctctcagataagggaagaaaaccttggctatgtatgacaactgctttttttatttttttaatatgacacagatttattttttaacagtgggaatgcagataatatgaaagcctaagtttatataactaaactaaaaattaggataagcaaataaattgacatgtaaggaaattttaaggatgatagcagtttttgtttcctgtatattttaaatataatttctgattctttcatttcatctttctctttaacatcctatctttaagaatattttctctcattcttatgtttttgtttgcatgcattctcctcaactattttattaacagctgtttacatagataggaatgagaaaggtggttaacttaaaaaacaaatagcagatacagacctgctaggtaatagtgtgataccgtctctttcagatgaaggttcccaggagaatataatcctagcagaagctctgatatatgtagcttcagtttctccaagagtttaaaagttcctagagaagtcacctagcaagaatgaatcatgggaaatagaggactcaccacacttgggtgtctggctgaggtagtgtgagccagatactggatttccagcaagaatatagtcagaaggagtgagctgttctgtgttttctcctaagaccaccagggtttacctccagccttcaggaataagacaaagccaaatacatctaatgtactcatacgaggcaggctgcaggattgaaggggagagagccaggacttccatcaatatagggtcaacagataagaatctgggctcatctgtatattttgccctttagaaagaggaagacacaatgctaggccgggcgctgtggctcacgcctataatccaaacactttaggaggctgaggcgagcgaatcacttgaggtcaggagttcaagacgagcctggccaacatggtgaaaccccatctctactaaaaatacaaaaattaaccaggcgtggtagcacacacctgtaaatccagcgaccttagaaggctgagggaggagaattgcttaagtccgggaggcagaggttgcagtgaactgagattgcgccactgcattccagccggggtgacagaacaagattccctctcaaaaaaaaaaagaagatgcaatgccagcaggcttctttatgatgatagcccttaacacatcttatctctggagtcacactattttgtccagtctggttgtccccagagtaggctgtattgtgtcatcctgggaattcctttctccctacttccattttctcacagtttgtgtttttgatatggtaaagcatgtttttcagtggttttatgagaaagaaaggttggctgagtaaagatagcatgttataaaaattgaatgtatgggccgggtgtgatggctcacacctataatccccacactttgggaggccgaggcaggcggatcacgaggttaggagattgagaccatcctggctaacacagtgaagcccgtctctactaaaaatacaaaaaaattagctgggtgtggttatgggctcctgtagtcccagctactcgggaggctgaggcaggagaatgtcatgaacccgagaccgcaccactgcactccagcctgggtgacagagcgagactccatctcaaaaagtaaataaatacaaataaaaattgaatgtacatgtgccttaacatctagaagatgtacaacaaaaatattaaaagtgattagctatgggtgataggaatataaagggtttttattttattttttatatctgtattttataaatttataatgagaggagccattatataaaattattagtgtagaaaagggattattcattgagttagctaggtatattttccctagagaagactcaggaaagagaacatagtaattgcttcaaatattacaagagcatttatatggaattgagatgagatactctgaataaggttatggttctcaaacttcagtgtacgggaaagtatgattgggttcctgttagagttgactttacagagtatcctgtgtgactctaatgaagctattccatggaccacattttgagaatcaaataaaactaagcaagatttatagtggccagagagaaagtgattaataagtaaggactttattactatccagagatggaagcttctggttttaccctatatgccaaagacactgtctttatagggatcttccccccaggcttcacagtcacatatttcgctgcctgctaaaataaacatctctacaaattcagatgtcagagtagtttcatcatcttccattacaaccccagtcacccaaaagcctatccttacttcttgcattctctttttcaattaaggacagtctgccaattctctttcagacatgaaacattgggtcatctgcagttcctctctcacctcttttaactattcataaagccctttctggactgcttccaaattttcataaaatcacttccctcgttcccatctctactactactaactgccctctttttggccttcatcatctttccttaactacttcatgggctttcttcgttggtctccccaccaccagttttccccctgaaatatatatctttcacactgccactaaagtgattttttttttttttttttgagatggagttttgttcttattgcccaggctggagtgcaatggcgcgatctcggctcactgcaacctctgccccctgggtttaagcagttctgcttcagcctcccaagtagctgggattacaggcacctgccaccatacctggctaattttttgtatttttagtagagatggggtttcaccatgttggccaggctggtctcgaactctagacctcagatgatccacccgcctcggcctcccaaagtgctgggattacaggcgtgagccacattgcccggcctaaagtgatctatctaaaagcaaacatcaccatggtattcaggagttcaaaagcccttcagtggcttctgcaataccctcaggataaaatgcagtttctctgaggtgacataatacaggctttttgtgactagcacatctagccccacctgcctctgttgttttctctctccctacttcatacatcatacagtaacacacttatgtgcaccattggtgctgagctgctggttatcccactctgccatgtgtgctgtttctctttgcttttgccactactccactctgtgcttgaaattctgtgactcttccctgtaagtaataataacaagtctaacttttttcttttgttttaaattcacattcttccctgatagcctccccttctcttaggttgggtagagtaattctcagtgtgtccatttttcttttagcaaacctcattactaaactgaattgtattgtgtctcttttccccattccttcgcatacatacccccaataatttatttgaggtcagagacccctatctttctcacttttgtagtttcagttctaacattattcctggaacataggtccccaataactgtttcctgatttagcaaataaaattcctatccttgaatgtgttcaagcataggagcaataaataacatctgatagacatgtatgatttaaggacccttttaacctgggtattgactcattaaaactgccttagttctagacttagtaggtcaggtttgcttatgcttgagagcagttagattttagaacgtgacttatttaacatgatattctttagaattttatgtttcttcaaggatagtatatctgttgaccttgggtgaacacttaatctcattgagcagttatttgtgtttttaaaaatggagatccttatcacccagtcttcagtttcttcaaatagcaaaatcagaaattggaaatgaaagcaggtgggaaaatgtaaagtgccatacaaataaagtgatatctcatgttcagagagtctgtattacatatttggtataacatgggaatagtttttaattttttgtcacttgggaagagctgaaaaggataggggtatagtttttggtgttttttatagtgttttttcttaaagaatattaaatttagtcattactttcatatcagtgaaatacatatctagcaaaaaggtcacgtttttgcttctaaaaagttatttcatattgaacatgagtactgccaaagagtgtctgggatgataattcttttctgtgttcaacaccataggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcaggtatgtgtataaaaagttctgcatctattttaataacttttgtttatagccatatctctctcctttcactagttatgaaaataaggacacatctagttcagtttattttattcacagtataggaatatgctgcatctgtatagtcaccttatgtataggaacatatatacagaagaacaaacataaaagaaaatgactaatttcttaagctgcagaggaaaaagaattgattggggaaaataatgaagtacatgagataaagtggaagtgtttgggagaaactgtaggactgaagtacctcagtcgaggaaaattgagatgcaaaaatagtaactaattttctaaatctgcaattggagaaaaataaacccttgatcaaaaattaataaccttacctaagatattatttgaccttagagattacataaagcatttgtaaaatcagctgtgcttagggttttcagttacagtgtgtaactttgaaataatatattcagaggttacatcttaagggtcaggaattatactatgcatgttatctaattctttggagagatctttcctttgggtttgatccacaggtaataaaggcactgtagacctttgaaggtgactactctgtttaactgtagggaaccgagagcagtatagatcattgcaattgagcttattgaaaaaaaagacttgaacgttcattcaagtaggccataaccccagcctcccatttcatattttttgcttcacagtcttcctgtaaggacttaaaaagacttttctccggaacacaggtgagtcctaggtcctagatttggagagaactattattagaaaggaaggtgagaaattattctttatgtctttgtccttttcctctataaacatggaatttcaacacttgaacaaaaacctcagagatcttctgggtctaggccatacttgttacctccccagcccttagtctgttgcttaattctgtttaacatttctcccctcttcctaatggtagtccagcatttacttgaacactttcagagaaaggaagctcaatctcctgaggtaacctgtttacaattaggagtgattgctaaaatattcttctctgtgatgatccaaaatatatcttcctaaaacttttacctagtgatcccgggtaaacacaggttctattctcggaaactagattagcaagtctaattcctgttctattggactgcttcctcttccccatcccccgcacccttcctatttttaagaaaatttccagactaaacaaactatttttctttagccatttattagatggtataactctgtttcctcttcaccatcctggttgttttcttctgggtgagcgctgttatgttttctttacatatagtaaccagaactgattaatatttgtagaggggagaagtgctgtctttgtcctggaagcattctattaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaatcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacattaataagtcaaatggccttgggcacatctacctttctctttttcacttatagaagatctttctataaagaacacaaaaattacttaagttacagccacaaaatttgctaagattactgttttttattgtaatatgtgttattgttgattgtattcttgattttaatctttattctggggcaacataatttggacatgaagattttatggccattaagtatagaaatattctcttttttttatttgcttgtattcatctttaaggaacacatttgtccattaaggtccattaaggtgagctgtacttctaatttaagagtgtgtatttataaaagaaaagttggacttattgaaccctggattctacaaatagagatacaaatataatatttttttctttaaaaggcctaaactatagaatatctattttaatagttatcttagccagttaatggtgattagtgttaacaactaggaaatagtttttatcaaaagagatgatcaaacaaggagaggatcttctagatgggagacctcattaatattccagaataaagtttccaaaatatacaaggtacagttctcttgttgtgagaatagattattactttaaattatcattcattcctacaacaaatgtttattggtgacatgctatgtcactgttctgcttgctataaaagacagcaatgagcaaataatacttctctgttctcaagaagatcacattttaatgaaaagagacagactatgaaaaaataaattgtgtcaggttaggagaattaacgagagagatgaataaagccaggggaaagggatggagaatgatgtggagggaagggtgttctactttatgtaatgtgctcagggaacacagcacagaccagaaggcaatgaaggaggctaaggcatgcagatcgaaaggtttggaagtgagggtatacttgggatatcaaggaataacagaaaggtatggctggaatagagtaagtgaggagggaagtgattggagatgcaatttacaacgtaagtttgtctcctttaaaatgtcaaatctacgtattttaaaaccctaggaatagaactttgtaaattgttcaggagtcttccggagtttcagcaggtattgaacttatttcttaaaaatacaaaattgtaaccccttcctattaacatggaataaactgacttagagccagggagatgaaaataataaactagataaatctcattgaaagcttgcataattggtagatgcaaatgaaaatgattatttagtaagcatacctcaaatgcacctagttttgttatctacatgaagttttctttttcaatgccagcagttgttaaatcacatttcagaaaacccaagcttagaatctgacttctaaatgactgttataaagtgttaaatgaggtcagactccgtggctcattcctgtaatcccagcactttgggaggctgaggcgggcggatcacttgagctcaggagttcgagatcagcctggccaacatggcaaaacgccatctctactaaaaatgcaaaaattagccaggcgtggtggtaggcacctatagtcccagctactcgggaggctaaggcacgagaatcgcttgaaccctggagacggaggttgcggtgaaccaaaatcatgctgctgtactccagcctgagtgacagagtgagactctgtctcaaaaaataaaagtgttaaatgatttttaatgaagcatattatgtcattctcactatcctgaaaaataatattatttatctttaagaaatatataaatttttaatatttatgcttatcatatctctttaagaactcttgttttataatacgaatacttaaaatttagaaataagaaaaatgtatgcctgtgtaaaatttttcttatttataagagatacatgcagatcaaaagagttggaagatcattgatctagactttcagtaagcttcttgatccaatgagtaaaacactgtatctaaggccaggtgcagtggcctataatcccagcccaggcaggaggattgcttaaagccaggagttcaagaccagcctgggcaacatagcaagaccctgtctctacaaaaaaattaaaaattagctgggagtggtagtgcatgcctgcaatcccagctaactcaggaggttgagtctggaggatcccttgagcccatgagtttgaggctgcagtgggctgtgatcgcaccactgcactccagcctcggtgagtgagtgagatcctgtctcttaaaaaaaaaaaatcttaaaaaaaaaatatatatccaaaccatgagtctcaactctaccgagggatagtacttaagtttccaaaggaccatatataggtttaggaaacatcgaatatcaccattgttttgattggttctagttactttatagtttattttaaaatttcaaataatcgaaacggggtcctccacctttccaatataaacaggtagtatgggttttaaataaaccaaagttgagaaatacagacctaaaactttatatctacaagtggtagtttagctttttgaaaatttcttgacttacaagtggccaaaattaaagacctatttaaggaattcagaaagaagttaataagtgataggagatgagaataaaaggaaggggttccatcattggaatgtgatgatgatacgtgatgtttataattgggatataatttttcatatgatgtttttattctgttatttataaaaatagatttttgacatgatttttattgatctcagttatgtgggtccagtatgtttttttttttttaacatcagttttaggttcacagcaaaattgagaggaagctacagagattacctgtatactccctccccaactccatggatagcttcccctgttcttaacatcctcccccagaacggtacatttatgttataatttgatgaccctacattaacacatcataattacccagagtccatagtttacattaaacttcattcttggcttggtatattctgtggcagtatttttattattgattaagtgatagatcagggactccataggaattagcttcatggcttacttctcttcagatggtattcccaaagaggaagtgttgtgtttatttcagtggtctgaattctctttacatttacaaagttgcaagcactaaatagtgataagttaattccttctgtgtgaattgacaaaatcttacaggtcagagaaaggcaaccttttttttttttttcattaagggccatagatccagagttagaaaaaaaaaggacacagattaaaaaacaacattaatttgtttcatttcaaaactatcctgtgggtagtttatatggcatgttttaatgttgttgttttagtgagttccaacttggaaggggggtgttccctaatcactatatgtccttaagagaagcatgtaaggatggggcatatgagagtcaagcagtggacacagaaagagccacagaggagctaagtgaattctgagtggcgtattaatgaagggaaacaacacttgtcacagtactatcaactttgagttcagtcttgttattccttgaatttctgatcctttcctcaggccttttcatagctcctgatcttctgtatgtgagaaagtttgtgcagagactcttgtgtgtgggctagttacagcagctactgattaacgtgaaacttttctgtgtgcttctttggcagtaattacagcattattattctgctgagaatcacagactaaattcagcattactcatctttttatctgtcatttgtgaattcattatatgttgcctattgatttttaggtctttcagattgtacttagactttaaagtgtttggatggggcaaattacttcattataaatatattttactacaagttactaactttacctggtttcattttaaatgagcatgcatatcacaaagccctgtaaaatgaatgcccacttgggagaactgttaggctcagaccacacatagagtacgcttggaatttctcaagtacttctgaatatgttttcttactgccattgccatacgttttgacgtggagctgacctacatagacccttttgtcttggttaagtataattcttactctgaccgcataatgtgcccctagttcaggaaagagcataacgtttctgctgattagagaaacttgggcagtgtaaatttgacaatcaagcatacttaggtaagtgaactcttctagtctagaaaaggtgtgaaaatgccactggttgctgcttctgacaaacctggtttgagactataacagtctggtttgagactggaaccaccaggattttgatgctggtaaggatgtctaaaatggaggttaatgacagtggctccactacttcctagctttgtgactcgggtgagttacttctttgtgccttagttcttccatctatggaatggatataatagtatagtacccatctggcgcctacattactgtgagtattaagtaatgtagtatatgtaaatgcattagcataacacctggcacataggcatctgtaaattctagtttctatcattaatatcccatgtaaattttttattcacttatcttcattacttttcagtctaggtattcttatcagaaaagcatagttctttaccttgaatttttacttaaaagtgattatagaatgctaactttgaaacatgttaggagtttttcctaacttgctaggaacaactgtcagggatgtcatgatggatcgccagtcttactgtacaactgtaaatatattcataagtgtttatacagttaaataataatatttgtatagtcactatatagacttaggaccaaatatttagccatccattttatcctttatatcagaaaccttattttagttggtagttttgttccaacagatgtaagaaaaaactgataagtaatactgatgcattcaggattgattacatggagtcctgaaaaaaaaattaaactgcagctattttaggttctctaacttcatcgtagtttatagggtaagtaaagggaaggggaaagtgattggtgtggttgtctcccataagaactgatttttttctactgaagcatgtataaagtttatatatgactttttatatttgtttaataaaaattttacaggaactaaatttgattatcaatatgaagtttttctttaatttcagatttcaactattgcagaaagtgaagattcacaggagtcagtggatagtgtaactgattcccaaaagcgaagggaaattctttcaaggaggccttcctacaggtatggaatttaatagttagaatcaaagatgtggaggaagtcttaggtagttgcagataaagagatgtcagaagaccagttagttgttcacgtcagttccttatagattacttttcttcatcttgagttatttgtctcaaataaagtggaagcttatcctacagaataagaagagcacttgttactctcaccagtcctaattttttttttttctgtttctgtttctgtagactgtgctggctgtctttctgttaaaagtttggaatacagttgataaggttatagcattttttagttataagccaactctgaggctctgttatttatctacttagtaacacattgcaaaccattttttatgccatggtacttaacagatagctattaatttaataattgtctcagggagatgctttactaacatcccctaattttagcagtagcttactgtaatttttgtgttcagttatagatgttgcctagtccatgccttgcctccaaggtgaaccaaaaccattttttaatgtaaaaattagctccacattaaatatcttcaggaagggcagttccataaatcttgataagtttacttcagcattgaagaaacttcagactcataattatcttccttgttagtgtaaattattttttatatattcctatttttcaaagggatggttttttccccccgcttggctattaaactaacccttttctctgtccttacaattaaattaagaatcctaagtgactagcaataaatagattttgaggtctaagaaattttatattaccagtttatgttatatgtatttatattcataatttattttaagtatagctagtgttagattttaactttgaagtatatctcctgttagtatataacacatttgatcctgaagcaaatccaaccaaatactactagtaaagtaattacacaggtaaatataaaagccaggattattatagttttggtttgtaactcctttttttcctatgtgattggaaagacaaaggcatagaacaataactataaatttatgtgactaagcacatgatatatgaagatgtcatttttgacaatagcataaagggacagagtttataactagtttgttacaaatttaagatatcaaaaattacttgggttagggtttttaggggttttttcccacctttcagtgtgattatgttattcatttgaaatatggtatggttcctttgtttttgggttccattttagagtttctccacccatccttgttgatctttatttttttttctagtaagtgaaacatttaacactgtaccaaaagtcagaattgcacaaaaaaagtatactcagtagtgcctccccattccttctgtcgttttcatttctttcctacccatccccagtaaatagctaaaaccattactctctcgtttatccatcctgatttttttccttgaacaaatgagcagatacatgtctgttttcatatttcccttttttccttacacaaaagatatgctgtatccattatttggatgtaccatagttgattcaaccacttgcctttatatgggcatatagattgtttccagtattttttttcctttttatttgtttttctattttagaccttggatatatggctccagtattttgcagttacaaacagtgccaatgggaataatcttaagcgagtttattttaatattgttggaattggggtgaattcctggaaatgggattgaggcacgaacacccatatttccttaaatatcaacaattccttatatcgggattgtgccagttttatactcccagcagcaatgtatgagagtgtggtgttttttgtttttgtttttgttttttttgtagctttgctaacagattttgttaacacttttttgtttcccaatctgagaagtgagaatttaaaaatcaggttttgatcttttttccctttagttgattgttgactttttactttccgactttgtgtatgtgttctttgagatgcaaaagattttttttaatgtagtcagtcttattattacccttaattgcacccttccttacattgaggttaaagataatacatctttttttttgtttttgtacatatttgggttccttttgacatctagatcaatccctgacccatgaagagtttattcatgtaatttatatattttaaacttctgctggctgggtgcagtggctcacacctgtaatcccagcacttcgggaggccaaggcgggtggatcacatgaggtcaggagttcgagaccatcctggccaacatggtgaaaccccatctactaaaaataccaaaaaaattagccaggcgtggtggcaggcgcccgtagtcccacctactctggaggctgttgcagaattgcttgaacccgggaggcggaggttgcagtgaaccaagatcgcgccactgcactccagcctggcgacagagcaagactccatctcaaaaaaaaaaaaaaaaaaaaaaccttctgtcctaagcactagcagctttctgtgagttttctcatctttaactatatttgtatttagccagtaaattgtacttatatttttaattattctagttttctaattttgtaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatagtgagtaatagacaatttctgtttctattgtgaggagaaaaaagtgaggagaaaaagctaatagttgcattctcttcagagaaaccaatacaagtgccaagtcttctcagttttgctgccattattatatttcctttactcttcactatgcaaaggtctgtaatggtagtattttcttttcttcagagagttttagttaggattagtcaagtgtataaaccttttagatgtccttttgtttttgtgcagatgcatggaaagtctgaagtttttgaaccactaattgagaccctaggtttgaggcctcatgtgttgagagaacataagttttttagattaaaaaaaatcattccttgaatatatctcggtattcattttaatagtttgtcttgccttctgaaagtagcattttaatgtcttcgtatttaataatgtttcaagtggggataagcatggcttggttgagtcagcacattcaattattccttttcatatgaaagatagtaatatactttttggcccacataaagcaaaaattgctcttacaaaattatttaaaagttttcatttctatgatgtctctgtctggcacttaggtctgtcttcttatctttcaccaaaatctgttataagacacttttgaattttattttgtttgatcaaaagcatttgtgtgaatggtacttttttctctttttccctttttttttttttttttttttttgcctctcaaagtgctttattcattcagtgatttttttcatttgtatttgtttattaaacctggtgctgcccatttatacccttttccccacccaccttagtttcaaattaaatgtacacattgaaacttctttactgagatagtttcctaatccctgagggaatctgtatcagaaatatgcataaaagtttgaggccaggcacagtggctcatgcctgtattcccagcactttgggaagccaaagtggaaggatcacttgagccatccaggagtttaagaccccatccctatttataaaaataatttaaaaattaagaaatatgcatgaaagtttgacccccatgttattttttagttccagttcaactttgttttgcgtaactctaatttgcattcccatctgtattaaagacaagttctcaagtagcaaactttttaactctgccaaggctgaaacttttgagactaagtagaaggaaggcatttttgactaaggtttttatccactgtgctcaattagcttagtcatcttttttcttcttaagatctttgtggcagatataaagtacaactctttacctacaattctgtacgtgtatgtgtattatcagttgaagcctcataccagatgcttttagttattcaagatatgtgttcgaagacattgatacatgatgtttatttttcttctacttcagcatacctgagggatacaacatactcctgtcagtaacagattcactgttacagagattctcacttgaactaggaagcatgctctttaggaaagaggcctatcagaatctaaaaaggggaaatgaaggttagaaaagtaccagcacccccatagatgtttaatttggtacactcgtctcctccagcagctgaaaattgctagttttaagagattgagccaggcgccgtggctctcgcctgtaatcccagcacgctgggaggccaaggtggtggatcatgaggtcaggagttcaagaccagcctgcccaacatggtgaaaccctgcctccactaaaaatacaaaaattagccgggcatagtggcggacgcctgtaatcccagctactcgggaggctgagacaggagaattgcttgaacccaggaggcggagctggcagtgagctgagatcacaccactgcactccagcctgggtggcagagcaagattccgtctcaaaaaaaaaaaaaaaaaagagagattaatactttgaaatttttaaagctttgttcattatttttatcctgtgtcctctctgtatatgtacacatggctttggctttgatggaactgatttaacattatattcttgattttcattaagagcaatataataaatacatatacagcaacatttatatttcttaacttataaaatgaacatatggttgtcagaattcaccatagatatataaacacacatagttatatattttgtttaatagctgcattgtgtttcactgtgtaaatacagcacttatttaaacattctcctgctgatgaacatttaggacatttctattgtttcaaacagtgctacataaatatcctaagagtggaattatcgaccatcctggctaacacggtgaaaacccgtctctactaaaaatacaaaaaattagccgagcgaggtggcgggcacctgtagtcccagctactcgggaggctgaggcaggagaatggtgtgaacccagagggcggagcctgcagtgagccgagatagcgccactgcattccagcctgggcaacagcgagactccatctcaaaaaaaaaaaaaagagtggaattatcaaattaaagcatatcctccgcaagtacccttccaggtggaggcatgaatttccactccttccttaaattggttattttattaaattcatgctgttactagatttatctgttacttattagttcagtgtcccagatagtaaaatcttattagtgattctgctcttagatagaaaatgtgtatctgtcattttgaacttgaatttttttgtttcagtaaataaaactatgactcatgatgtttccctctttattctggcaactcagattcttagctaactttctgtttaattgtattcttttcttagtctagattttcttctacaattgttttatataactaaggatacatccgttacttgacttctgtctttttatttttgttttaatgaattgtgttttattgaaagctatctcaaatctttttggaataataaagtgtatacataaacattatagagaaaaactgtgttcagtaggattagacttcagtttccaaagtattttcatatacatgacctcatttgatatttacaacaattgtacttagtggctagaacccagatgcttttgtttttagagaagagagaacagaatcaaataacagtttagtgatggctgggcacagtggctcacgtctgtgatcccaacacttggggaggccaaagtgggaggactgcttgaggccaggagttcaagatcagcctgggcaacatagcaaaaccctgtctctacaaaaaaatgtctttagaaaattagtagggcctgatgtcctgtgctagctacttgggaggctgaggcaggaggatcacttgagcccaccagttggaggctacagtgagctgtgatcttgccactgcactccagcctggaagacagaacaagaccctgtctcaaaagaaaaaaattaaaacaaaaaactgttcagtgatggaactcaaactacaacccagtcttgtcatatatggtttactatttctttcttcttcccaccttgagttcactgctctgtagccaagaagaaagtggtatgttaaatacagtaggattcactcattaactctaaatgagaaattgtgatttgtttctgttaaccttctgattctttcaagtaatcatgcaaaattaatcttagaatagttcttactcatttttctccctgcctaagataagtaaaacttctgggattagctaaactagatccagtgtatatgccagcattttaattttcacaagtgtcattttgctaaactaatcacactgtagccattaactcttcttacttcttgatgaggcagtaatcaattttccatgtacagatgtctcaggatgttatttcccatagctggtggataactgatcccaaactaattcccttctaatggacagtaacatgcttaatcagacatgttgactttcctgcattgtttacttttttcttactcagttaaaatcagttttgtagttttatatgtgatattgtgatttttggtccttctctttctgaaaagcttgacccctacagggagaattgtctagagaggatattgccacctatctaaaaatgcttcttccaaataaatcatctaatttttaaattaaatttttctatgtactgtagcataaaggtgatttagtttttcataaagtgaaatatctactagtatgagcaaaagttgactgatttattgtttaacaaatgaatgacaggtgtggctaattagggcataaacaacaaagggttctatatgagaatgcttggatatgtattaaataatttagaaatgacagttaaagttttttttctaaatgatgatcttgagctctgattttaaaattccatgagagactgttgataattaagttccataggatatttcagttgtttcattgagtggattagataccattaaagaatttctacaagagttagggaatacaatgcactgatgaactgctttattagttatatgttaaaacaaccatttattgggtgcctatttcatggctgccactgtgctaagtgtatgaaagtatataagaaaattcctactctccagaaatttatttactagtgggacaagtattaatacattatgcagttaatgctaaaataaaagaaaggatcacagagtggaacctcttcagaaccaaataacttcagaaggaatttaacatttttccacttaaaaaaattgttaacaggcattattattataaattagaatgcagttcatagagtgcatttctattgtagaagttgaatatgggtttcctgaggagcaagttacttgaatatattagacccttcttggtgatgttatttgctgtaacttctcctagattattttacaaattattctacattggatgtaatgttttaaaagtcttatatggtattaaacttgtaacaataaaatccattggcttttagttgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtaagggaattcagaattcacaggtgtggtaaattcttcaaaatactaaaattttataaactcacagaaaaagtaagtatcatattgcaaaccaccattcaaatgtagttaacatttcttcaatattgatagtatttttcatgaactcttccattattccaattggaccaaaatgtcatggcataaaaacaactattttcagtttttaaaatattgcatctacctttaacatcttttggggtagaagaaacaggataggttagaaggaaagaccaggaaatcaggagttagaaaagatggattctgtatctaactgcatggatctgctatgaggccttgagtaaaagtcagctgctctgagcctcaggaaagtgttttgttttttgttgttgttgtttttgttttttcatctgtaaaataagagttgcactgaatctctggaaacaatcttcagaagttcaggattctgtttctctgcttccccccccccccccaaaagaaatttaaatcttctgagatcatcagtttttattattattattattatttttttctagagacatggtctcactgtgttgcccaggctagtcttgaactccgggcctcaagcaatcctcctttctcaggctcccaaagtgttgggatgcctctgcacttgactcagtttttgtttcaaatgaaaacattatattccacaggatcttataccaatatgcaaatctgctgctctttagagaaaaagtagttgttaaattctcgacaaattatagaagttgctttttttggctttttttttttttttttagttttttttttctgtttatttcaggaatctttatggatagcagttaaccatttttctttggatttgtttgaatatttcaagaatatagttaatgccaggttagaaatttgctgattgaggaaataataataaatttgtttctgaaaatatttttataaataataatgcattttgcctgtgttaggtaatgacagttgtatcctttcaccatggataattgaataatcctgaaacaccaactggagagagtcataacttatttaaagagccctaatgtttacagaatatattctgttattaaacgagtatttgaaaaagatactattttgcttattgatgagagtaaaacaccttttcactttacatgcaggtactcaaaaattgtaaagcaggatgtcagtgaatttgaattctgaacgtcagtttgaagatggtaacatgtttagtatataaatcttttccactcaaaccatacattttaattgatattaataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttagccattatcatttacattaaaacaatatgtttttcaaataatataattggcatcaagtgatacactttttcatacttttagttttgttttaattcaaaatttataatagttgaccataatgctttatcttctttttcattttgctattttatgaaaaatcatggtcgtttttatgtcgtggcaagagtctacttgaaattttttaatatgaatttaccaatatcaaaggaagacactgaggactatactctatctaggaagatcatccaagctgtgccccacttaccttttagacttaaggttggtaagcatgttaacaacagaatagaactgcattcaaatgaaaaataaaatgtaagatccagcggacataggttactgtaataaatacattacattgggaattatttcttagtagtggcgcgaagagtgctgattctttcaacgctttagccagaatcatcttttcttttttgtttcccttttagtccaaaatacatgcttagattgatgattgatacacataattgaatcaagttgcaatgtttctgtcttacaccatgctcactgtttttttcagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacaggtacaaatactgcatttacttagattgttatgtgttaagtgtgtcttcacattctgctggatgtgtatctttacatctactggtaataggatctttgcattgaattttttttttccagcagaattaatggatcttgctaaattttctttatttaataagctgcacttataagatagctgtatgattatgggtcaatctttgatcgtggagtagttttctttcatgcagtttccccacaggagatttaatgcacaacttccctatgtctgcactccaaccagttagccaggttatttaaaaatggtttcttttcatgtatagtattgttcaagaagatcaagagtttcatatatgtatattaactgtgtgttaaattttatctatattaaatttacttgatataaagtaaatgtatggtggccagttcatgttttaatgaataatatctttactcaaaataataacattttaacacctaaagattcttcaaaaatatgttaattctaagaataccatgttacggacaaaaatcttaaaatatagtcttcaaaaaaatactacattcaaaatctgtgaaatgttggtaaagcaattctcagaaagtaactttattgctgtaaatgattttgccatcaaaaacaataaaaataagttactaaatattggtttagaactttcatatagaagtgaccgagacaaacaaaagaaaatgaaaataaggttatgtaaaggtttaaaaagtttgaaattagtgaaagtatctcactgttcatcccaggatacttcaaacactgataaagtgaaagaagcagggcttccaagtcctagccctatccctccattttgggagaaggtattaaccttctgtacctcagttttgtaaaatgggattccagcacacacccaaagtattgttgtaagagtcaagtaagagaatcctttgaaagcactttgtaactgtagtgctctgttgaaatgggtttgtgtgtgtgagtgcaatttcacagctcagatcagcttttttgttcctaaaatattcttagctgtcacaatgttagtaaattatatctaaactctgagaaatggcagagatttttctgggatattagaaaaagagttggaaacaagccaagtgactttttttttttctcccgagatgaagtcttgctctgtcacccaggcaggagtgcaatggtgcaatctcagctcactgcagcctccacctcctgggttcaagcaattctcctgcctcaacctcccgagtagctgggattacaggtgcccaccaccacgcctggctaatttttgtattagtagagacatgatttcactattttggccaggctggtctcgaactcttgaccttgtgatccaccctcctcggacttccaaagtgctgggattacaggtatgagccatggtgcccagccctcaagtgacttttatttgtgctccatccatctgtgattttgagtatttaagttttactaaagagaagcataaaagctgcattcataattcaaatatattttaaaatataaattaaaatctgtaaataaaaattaaaatattttcagtttttaaaaatgtttataaggaaacctttaacttaaaattagaagcaagtctgatcaagaagtctcaagcaaaggctgagtagtaatatttaagacaacactgcttactaaagaaaagagttcaaagcaaacataggagcagaatcaaaaaataaatccttttgattataaaaaacaacagaaggacttctgtttatgtctatgtagtttggctgtgtggaacaaaatgtttacccccgttgactggcagaccaaatttcctttttgttctatttatttttctttcagatttatgaccactgccaccaacaagttaggaacagggcacacataactacagttcctaccaggctttgcttgcctgagatcttcagggaaactacccgacttaccatggactctttcataacattactttgcttagatatagttaccctactctttaaaaaggaaacttcccattgattctgccatagttccttttcccctttgttaccagattactgctgcttttactttttcagcctccattcactggaatctggcttctatgactagcataccgctcatatgtctataaaaaggtacaaattccctcccacttggcaaatctagtattttctttcatttaattttaactctatggagtatttgacactttcgacttctcattactctaaactcttccttggcttacttcacctggttttctggctacttttcaaatttttcctttgaaccttcatccatacccatgtatttcaggcattactttatatgctgatacttcttaattctgtatattctggctttgacctttctgccgagtgctatttattaagctccagtatatattattttattaattctacctacagtgaggtagaagcttatccccactttagaggaggagaaggtaaatatcagaaaattcaaatattttgccaaaggtcacacactttatgagattagtagaactgaaatttgaacccatatctggcaccaaaacctgtaaacatgctacttcactgattccagtatgcagccatcttctgctgtgcctctcaaaccagagcacatggcagtatgctagggatgtgtagcctaaggaggtgaacgtggagtgctttccttgaatgttcattttgctaaaatatttgagagaaataaaccttatttttaaggtaaaataagagatttaaaagaaatttataccagcagtggttttgctgcacccccagagtctccatatttggtttcctcttctagtgtggctatttcagtggaaaagttaagagaagcacactcctaagcatgctcactaggatgaatttcccttatgcacatcaaacacagcctatcttaaagtttgataggaaaagattgtaatccaaaaaattcatcactatccaaattgccatttatttcaagatgaaggtaagtggtaaacattctaaaagaaagtgtagacagctcttctgttaatttgtgttgctacagtaacaaccacgaatctcagtgtcttaaaatttcttcctcacttctgttacattttggcagctgcaggtcagttgctgtggctctccttcatgtgcccatctgggtctaggatcctgggctagatagagcagcacgtctttgagaaaagggcaatgcttttgaaagcatttgcttgattttggtgaacgttacatctactcgtgatctgttagccacagcacaggcaaggacaagcccaaagtcagtggagtgggaatgaactcttcctacaggaagtggagagtgaaaaattgtgaaagtaatacaatctatcacctttgcctttatgtaactttacattgtagggggattttaaaagcagattccctaaaggcagaagtaacaaaggaaaaggttaaatggatttgaccatataaaactataaaccccctatttaggaaagtaaaagataaagtagcaaacattttaacaaataatgtcagaagactaatgagttgagggatataaataggcagattcttagaaaatggatagggtaaaaaatttgaaaaattctaaaaaaattaaaatgtatttgatatgaattaaaatatatccattcaactatatacaactagccattaagagtaaataaaggtgtatttttattaagatgggaagatgttctcggacaaaagcaggttaccaaagagtatttacattactatcaggttttttaaatttattattacacaagtaaaacatgttcattataagtaaattaagaaacattacctaaaaattgaattacttctaatttcaccatctaaaatgttaacattctaaagtcagtttttttactcaaaccagtacaaaggtaaatatacatttttaatatatttttaagtaattttaaacttacaaaggagttgtaaaaatacagagttccggatacccttcatccagctttctctaatcttagtatattacataaccagggtacatttatcaaaaataaaagtacattggtataataccattaactgaattatacattttatttccccagtttttttacttacataatccagtttgggtaccatatcgcatttaattatagtctccttcagtctgtgaaagtttgtttccttgtctttgatggccttgtaacttttgaagagtagtgatctgttttcttttagaatatccctcagtttgcatttgtccagtgttttctatggatagattgagataataggttttggggaggaattccacagaggtatagtgtgcctttctcataacatcacatccgggagcacatacataattggcgatattaactttgatcacttggttaaagtgctgtccaggtgtctccactgttgagctaccatttttctctttgtccagcccatattcaaggggaggagaattaaattccacctcctaaaagggagaatatgaaagaaatttgtggtcatatgttaaaaccaccacagtaattaggtgtattttagaagaagtacttggaggctatgcagatatattcttttctctttaaagttttgcccaccagttttagaattcatcagtaaatcttgtctacagtaattattactatttgctattctaatgggaattttgtatatctccatcccttctaatatatttaacaactgaattctataaacaagatttgtttcttctccacattatttattttatcaatacagacacatactttgggagttataatccaatactattgttatttattatgttgttcatattgttctagctttggctactgggatcttttataagtgtcttctgtgtccttttgacatgccccatttttttctttttaagcacatctttactttctgagactacaagattgtccaggttctcatcttgtgttttcccttccctagccttggaatgagctgtttttccaatgatctctagttcctttattagaaaatggtggccaatatggtgaaaccctctctctactaaaaagagaaaatttagccggggtggtggtgcacgcttgtaatcccagctactcaggcggctgaggcagaagaattgtgcgaacctgggaggtggaagttgcagtgagctgagatggcactactactccagcctgagtgacagagtgagactctgtctcaaaaaaacaaacaaacaaaaaaaaaaatatatatatatatacatacacacacacatacaccttcatatatgcacacattcttatttctgtatctttatatatagttggctctgttttccatagcccacattcaagaaaaaaagtaacaatataacaattttttaaataatacaaataaaaaagtaacctagtataacaactatttacatagtatttacattgtattaaatattataagtaatctagaggtgattttaagtatatagggggattcatataggttatatgcaaatataatgccattttatataagggacttgagcatctgtggattttgatactcatgagagttcctgggaccaatcccccacagatactgagggacaactatatacttaaataggaatacacactaacatatctgactctaagctttaaccacgtggctcattttagacttctctttgcctgtttgtaacttctttctccgacagaaacttggcttatatgtttgtttaaatctactatacatacagaaaacttgtaagaattgataatatgtaccattgtgagaaacaggattaccagttacagtgcagtatttatatacacttctttttgtttttggcctaatagtatttagcaaaagtgctgttttctaaagttacttcactctgctcctttctccacccctttcaatgaggttatatcatatgattgtagtacagttagatttgtcacaatcttcagtctgggattttctgacatccctaagtttttatccttaaatttgcatatacataagttcactctttgtgctgtatagttttatgggttttgatagatgcagtgtcatgtatctgtcaccacaatgccatatggaacaattatactagttaactaacagttatataatactaagtattctcttatatccctttgaagtcagcttcccccacgccctgaaaaccaatgaactgttttctacccttatagttctgcctattccataatctcttataaatggtatcttaaattataatttgtagccttttagatctggttccttcatctagcaaaatgcatttaagatttattgattttgttgcatgaatcagtagttgggacttatcccagataattccattttatagatatactgtgctttgtttattcactttgaatttcatcccagttatttccagttttagagaaataaagttactatcaacacataaaggtttttatatgaactttccattaacatgagtaaatatctaggagtaggctggttgcatgaaatgtaactaactgtatatttaactttttaaataaactgtccaattgttttccaaaatggctgtaccattttatattcccaccaggaatgtatgagagttcagttgctttgtatccttgccaaaacttgacattgtcaggtttattgtttgtcccccagctctagaactggtataatggatatcttatggttttaacttgcacttcactagtgactttttttttttgagacggagtctccctctgtcatgtcacccaggctggagtgcagtggcaccatgtcggctcactgtaacctctgcctcctgggttcaagagattctcgtgcctcagcctccctgagtagtcaggattacaggcacctgccaccacgtctgattttttgtatttttagtagagacagggtttcgccatgttggccaggctggttttgaactcctgacctcagatgatccacccacctcggcctcccaaaatgctgggattacaggtgtgagctactgtgcccagccttcattagtgacttttatgtgatttgctatctatatgttttctttgatgaaatgtctatttagatcttttagtcatttctattgtttgttttcttttgttttcagagaccttttttccaaatcctttgtcagagcaagtattttctttcagtctgcagctttttctttaattttcttaacattatctatcttttgcagagcaaaaggttgccattttgatgaggcccattttatcagttgtgtccttttgtacatcatgcttgtggtatttatgaattttctgcctggataggcccagcccacttacacacgtctaggagcctatggacaggcccattggtgtccacatacatcatctagggtgcctgaggattggttggtcctgcccaccagcacccactgtctggaatcatgaaggccagctcgctctcactatcacattggccacccagaggcctgcagataggcctgcctggcctgctgccaccgtaaaggcctttgtgtccacataccagccaacctgatgtccccatcctcagcaaagctttatcacagcctccactgacaaccgaagcctaagccactgaagaaatcatagatgccatgagagaatcatagataccaccattgatgacagtaaaagaaatcatacagagacaacacatctgaacccacctagaatcaaatccagagcaccctacccagctaacactacagctacatctacagtaaaagtctttctctacaaaagccagtccataaaattggataaagcagcagttgcacagatatcaagataaggacacaagaaacataaaatactgaggaaacacgatacctccaaaggaacacaataattttccactaacagatctcaaagaaccaggtaatcaataaaatgcctgaaaaggaattgaaaataatgatcttaagaaaactcagcaagaaacaacagaacacagatagacaatacaaataaatcaggaaaacaattcatgatctgaatgagaaattaaagaggtaaatagttaaagaaacaaattctggaactgaagaatttaataaataaaaaacagtcgagcagaaagaatttctgaactttaagagagaggtcttttaaaataacccagtcaaacacacactaaaaaggatgaagaaagcctacataggacatcataaagcaaacaaatatttcaattttgggagtgccacaaggagaaaatataggaaaaggcatagaaaacctatttaacaaaataatcactgaagacctcccatgtcttgagagagagatatatatccagatacaggaaggtcatatgtactaaaacagtttatccaaaaaggcctttctaagacacactattttcaaactcaaaagtcaaaaacaaagaaaaaattcttatggaaccaaaaacagcccaaatagccaaagcattcctgaactaaaagaacaacatggaaggcatcacactacctgacttcaaaatatactacaaagctatagtaaccaaaacatagtattgatataaaaacacatagaccagtggaacagaataaagaacacagaataaatctacttatttacagcaaatgtgccaagaacatacattggggaaaggacactctcttcaatcaatggtattgggaaacctggatatctgtgtgcagagaatgaaactagatacctatcaccatacccaaaaatccactccaagtggattaaatacttaaacataagaccccaaactcttagactactagaagaaaacatgggggaaatgcttcctgacattagacttggcaaaaacttcatggctaagactccaaaagcacaagcaacaaaaagaaaaatagttaagtggaaatattaaactaaaaagcttctgaacagcaaaggaaacagagtgaagagacaacctgcagaatgggaggaatatttacaaactgttcatctgacaagggactgataaccaggatatataaggaactcaaccgaacaggaaaacaaacaaaaatcctattaaaaagtggacaaaaggtctgaatagacatttctcaaaagaagacatacaaatggccaagaaatatatttgaaaagctcaacattactaattgtcagattaaaaccacaatgaagtatcattagatagaatggttattatcaaaaagacaagaagtaacaaactgatgaggatgcagagaaaggtgaactcttcctctttgtgttaggaagtatcattagttagaatggctataatcaaaaagacaagaagtaaacactgatgatgcagagaaaggtgaactctttctaactctttgtgttagaattgtctcagtgttgatgagaatgtacattaatgcagccattacggaaaacggtgtggaggtttctcaaaaaaactaaaagggccaggcgtggtggctcacgcctgtaatcccagcactttgggaggccaaggcgggtggatcacaaggtcaggagatcgagaccatcctggctaacacggtgaaactccttctttactaaaaatccaaaaattcagccaggcatggtggcgggtgcctgtagtcccagctactcgggaggctgaggcaggagaatggcgtgaacccgggaggcagagcttgcagtgagccgagatcgcaccaccgcactacagcctgggtgacggaacgagactccatctcaaaaaaaaaaaaaaggaaaaagaaaaaaacacacaaaaaataaaagaaccactatatgatctagcaatcctactactgggtatctattcaaaagaaaggaaaccagtattgcatcacttcacagtagctaagatagggaatcaacctaaatatccatcaacatatgaatggataaagaaaattgcagtatatatacacagtggtatactgtcaagccactaaaaagaatgaaaatacatcatttgtggccatgtggatgaacttgggggacattatgggttatgcaaaataactcaaacatggaaagataaataccacatgttctcactcatgtgggagctaaaaattttttgagcttatggaagtagagagtaaaattgtgggtattagagcctgggaagggaaggtgagatagggagcatggggagaggttggttaatggacacaaacttacatctaggttggtagaatgatttctggtgttctgtagcaccatagggtgaatatggttaaatacaacttgtgtattttcacaaagctagaagtgaggattttgaatgttcacaacccaacaaaatgataagtttgaggtgatggatatgctagttaccataatttgatcattacatactgtatacacatattagaatattactgcatctcataaatgtctacagttattttatgtcaactaaaaataaaaaggaaaaaagaattctttgcctaaatcaatatcacacagacttctttgttttcctctaaaagtgttatgttttatgttagagttttatatttagatctataattccctcctgagtttacttttgtataaggtgtgaggatgtgtcgagatccatttttttatataggaacatccatttgttccagaccatttgttgaaaagactattctttctctattgaattgcccttgctctttttttcaaaaattaattgaccatatttgtgtgagtctgtttcttggatatctttccattgatctttgtgtctgtcctttagccaataccatgttgccttgagttctgtataataagtcttgaatttgataatgtgagtcctccaactttgttcttaaaattgtttggctattctggttcctttgcactttaatgtatattttataatccgcttgttgatgtctacggaaagtgtgctagaattttagttaggattgtgttgtgtctatagatcaaattgtgaagaagtcacatcttagcaatacttagtttttgattccatgaacacaatataatctaatcagcacatagatcctgtacatatcttactggatttatacccaagtatgaactgttttctggtttttttttttgttgtgtgtgggggtggggggacatgtgctatttgaaatggtatattcaattgttcattgctggtatatggaaataaaattggcttctgtatatttaccttttatcctatgaccattctaaatttacttattagttctaggagctttgtcggggggggtgtagattctttgggattctctacacaaattatcatgtcacctacaaatatggacagttttaattatttctaatctgcatgccttttaattttttttccttattgcaatgtctaggacttgtgctatgatgttgaataggagtggtgagagaggacatctttgccctattcttgatcttagggggtgtattagttttctattgctgcatgtcacaaactgccacaaacttactggcttaaacaacacaaatgtattgttttccagttctataagatcagaggccttcattggatctcactgggctaaaatgaaggtgtcagcaggactgcattccttcctggaggttctaggtgaaaatgtgtttctttgccatttctagcttctagaggccacccacattttttgcctcatggccccctttctccatcttcaacatagtgttatctctgttccccttctgcagtcacattttcttctgctttcctgttctacttttaagaatgcttgtggtttaactgggcccactcaggtaacccaagataattttcctattttaaggtcagctaattaacaaccttaattccatctgcaacctaattcccctttgccatataaggtaacatactcacacactgcagagattagtacatggacacctttgggggaccttaagtaatgtaatagctgtagggtctctgtaaaaagctcttcattacatttttttaaaaactctctttgatttttagtttctgagagttttcatcataaattgttgtttaatcttgtcaaatgcttttccagaatctactgaggtgatcgtgttgtttctcttatttggtctgttattagagtgaattacattcatactccaattttgagatatgcatgcattcctgggatgaacccccaattggtcatgaagtatcatttatacattgctggattcaatttgctaatattttgttgaggatttttatgtctacgtttatggctaatatgggattttagtttctttgccgtgagtttgttattagggtaatgctgaccttataaatgaggtggaagtcttcccttcccttctctttttctggaagagattataatatttgtattatttaagccttatatggttggtagaatttgccagtgaacccacataggcctggagttttctattttgagaattttttttttttttttttttaatagatacgggatcattcagactatttcttcttcagtgagttttggaagtttgtgtttttaagacattggtccatttcttcaaagttatcaaattcatgaccatagagttgtttgtagtgttagtttattattcttttactgtatgggatgtcagtagggatgtccccccgcttcattcctaatattgttaatttttgtctttcctctctctctgtattcgccacccctaccccagccaccctcctttttttttaagtctggctaaaggtttatcaattttgttgattgtttttaagcaaccaaaattcttagtttcattagttttctccttagaattgtattgatttgtactctgatctttgttattttctcctgcttgctttggtttttttagttgttctctttctagtttcttttttcattaactgtaaattttttcctattaatatatacctttgtcttatttcagtttctaagaaaacttctgcaggtatctagtttcttaagacaatagttggatcagtttggcaaatcttttgtaaagggccagatagtaaatatttcaggctttgcagaccaaatgatctgtcacaactactcaactctgccgttgtaataccaaagcagcgatggataatactgactgtgttccagtaaaactttatttacaaaaacaagcagggaagcaaagtttggcaacccttgatataaataattgatttaagccctttttttctaacataagtatttaaggctgtaaatttccattttagcattggtttagctgtgtcccacaaattttgggttgtcatttttatttgcattcagtttaaaaatttttttatttcctttgagacttcttttttgacctatagacttagaaatgtttaatattcaatttccaaataatcgaggatcttcccaggtgttttatggcccaagaacatactttgtattatttttattctcttaaattatcaagtatcatatcaatgtcagataggtgtagttgattatgtcattcaggtgtactgtatcatttttaattttctacttattctgtcatctctgagactctacttagtctatcatcactgacaggagagtgtattaaggcattcatccctttgttcatttctcctttcagttctattagcttttgcctcatacaggagaattacatcttccatttagaattatgtcttcttagaggatagacctctttattattatataatgtctttctttatccctgacaatattccttcttcagaagaatgctttgtctgatactaataaaactaccccagttggtttgttttgtttttgtttgttgagacagaatcttgctctgttgcccaggctggagtgcaatggcagtggcacaatcttggctcactgcaacctccacctccctgattcaagtgattctcgtgcctcagcttccaaaatagctaggattacaggtgtgcgccaccacacccagctaatttttgtatttttagtagagacggggtttcgccatgttggccaggctggtctcaaactcctgacctcaagttatccgctcacctcagcctcccaaagtgctgggattacaggcgtgaaccaccattcccagcctccttttgattagtatttgcataatatatatccttctccatcctttttcttctctgtttatatttgaagtgggattcttgtagatggcatatacttaggtcttccttttttactgagctacatgccttttaaatggtttagatcagggattggcaaactatggcacaagtagaaatttttaattttacatttatatatttaattttcaattgtcttcatttccttatataaatccatgttttaatctattatatttctgcctcaaaaactcttttttacatttcttagaaaatagatcttctggcaatgaattccctctagttttgtttgaaaaagtttatttcatcatcatatttgaaagatatttttgctgggtatagaattctgggtttatcatttttttctttgaagtgacagactttaaagatgtcacttaaggctgaggtaggcggatcacaaggtctggagtttgagaccatcctggccaacatggtgaaaccctctctctactaaaaatacaaaaaatgagctgggcgtggtggcacacgcctgtagtcccagctactcgggaggctgaggcaggaaaatcacttaaacccgggaggcagaggttgcagtagcccagatcacgccactgcactccagcctggcaacagagcaagactccatctcaaaaaataaaaaaagatgtcactttttttcttatgatttaaatggtttctgacaagaaatctgtgtgtatataatgctccttttcttcctctgcctctgatttgcagcaattcaaatataatatgcctagggattttccctctcttccctccttcctcccccatccccaccatatttatcttattcttcttgtgtctgtggcttggtgtctgtcattaattttagaaaattctcggccaggtgcagtggctcacgcatgtaatcccagcactttgggagaccaaggcaggcggatcacgaggtcaggagattgagaacatcctggccaacatggtgaaaccccgtctctactaaaatacaaaaaattagctggccatggtggcgcatgcctgtagtcccagctgaggctgaggcaagggaattgcttgaacctgggaggtggaggttgcagtgagtccagattgcaccactgcactccagcctggcgacagagcaagactccatctcaaaaaagaaaaaaaaaaagaaaaaaaagaaaagaaaattctcagatatactttcttcaaatatttttccgtcctgtcctccctcttcttctgagattacagttataaatatgttaggatgttggagacggtcacacagctttttgttgttctgtcttcaagttcactgattgtttcctcagctgtgtcagttttacttaccagaacatcaaacatattctttatctccatttccatttgattccttttcataatttccatgccactgctgaaataacccatctgatcttacatgttatccaccgttcctattagagcctttaacatgttagtcatacttaaaatttgtatcaaggctgggtgcggtggctcatgcctgtaatcccagcactttgggaggctgaggcaggaggatagcttgagcccaggaattcaagacctgtttggaaaacataggaagacactgtctctacaaaaaataataaaataaattagctgggcatggtggtgcatgcctatggtcccagctgctggggaggttgaggcaggaagatcacttgagcctgggaggtcaaggctgcagtgagccctcattgtgccactgcactccagcctgggcagcagagcaagaccccatctcaaaaatgaaaaatagaagcaaatgctacttttttctgaattgatagttacatgaggatgaagacatcaatggaattacaatgtactgccatttggagttacctaaaaataataatagctaacacatcttcaacatgctaggcactatattgtgtgctttacatatattaactcatttgatcctcacaaactttttttttttttttttttgagacggaaacacctatcacccaggctggagtgcagtggcgctatcttggctcactgcaatctctgcctcctgggttcaagcgattttcctacctcagcctcccaagtagctgggattacaggcacctgccaccatccccagctaatttttgtatttttagtagagacagagtttcgccatgttggccaggctggtctcaaactcctggcctcaagtgatctgcctgcctcagcctcccaaagcgctgggacctgggattacaggggtgagccaccacaccagccctcacaaaccttttgaggtagaaaatattaccatgtccttttttacagtcaggaaattaaggttaagtaataagattgtggcccttgaccacacagagctaaaaaagaatttactggtttagattgagcagcttgctaaagaataatttttaattatttttaatctgtgttagatttttttaaataatttcatttttaattgtggtaaaaaatataacaaaattgaccatcttaatgagttttaagtattcagttcagtcatgttaagtacattcatattgtggtgcagtagatttccagaacttgttcatcttgcaaaattgaaactctgtacccggtaaacaacaactccccatttcctcgttcccccagcccctggcagccactaatgtaagtcctgtttctatgaatttgattgactttagatgcctcataagagaaattacacaatatttgtctttttgagactagcttgtgtcagcataatgccctcaaggttcatctacgttttggcatgcagagggccttcctaaggctgaataatattaatattacattgtatgtatataccacattttgcttaccactcatctgctgatggacatttgggctgcttccacctcttggctattgtgaataatgctgcaatgaacatgagtgttcagatatctcttcaataccctgatttcagttcttttggatctgtagcaaaaagtgggattgctggatcatatggtaaattttgttcttaattttttgaggaacctccattccattttccatagcagctgcaccattttacattcctaccaacagtacacaagagttccagtttcctcacatcctcatcaacaatgggtattttctgctggtggtggttttttgatagtagccatcctaatggttgtgaggtgatacctagtggttttgatttgcatttccctagtgattagtgatgttgagcatctttttttttttttttttttttctgagatggaggctcgctctgttgcctaggtagagtgccgtggtgcaatctcggcttactgcaacctctgcctcccgggtttaagcgattctcctgcctcagcctcctgagtagctgggactacaggcacccaccaccatacctggctaatttttgtatttttaatagagatggagtttcaccatgttggccaggctggtcttgaactcctgacctcatgatccacccgcctctgcctcccaaagtgctgggattacaggcatgagccaccgcacccagcctatattgagcatctttttataggccatttatatatctctggagaaatctctgttcaagtccctatgcccattttttaaattgggttattttgctgttgagttcaaaagttctttatatattctagattttttttttccctttcttttgagacagcatcttgctgtctcccaagctgtggtatagtggcatgatcatggctcactgcagcctcgacctcccggcctccaacctcagcttcctgagtagctgagactacacgcacacaccacctaactaatttttaattgagacaggttcttggtttgtcacccaggttggaatgcaggtggcaggatcacggctcactgcaacctaagacctcctgggcttaagcagtcctcccacctcagcttcctgagcagctgggactacaggcatgtgccaccacacttggctaaatttttaaaaatttttttttagagacagggtcttaatatattgcccaggctgttcttgaacacatgggttcaagagattctcccacctcagcctcccaaagtgctgggattataggcgtgagccatacaccttgcctattctagatcttaaccccttagcagatatatgatttgcagatatttcttctcattctgtaggttgccttttcactatttattgtctttcgatgtgcagaagttttttagttggatatagtcctatttgtctatttttgcttttgttacctctgcttttggtgttgtatttaagatattactgccaaatccaatgtcagagagtgttttcttctagaagttttatagttttaggtcttacggttaggtctttgatctattttgagttaatatttgtgtacaacataaggtgcggcccaacctcactcttttgcatgtggatatccaggtttcccagcaccatttgttgaagagactgttagatttttttaaatgccctgaaatgattagtttgtaagattttctatttaaaggattgttacacattgaaatttagctttaatgttttcttagttattgatatggatagaatttcaagttttgcaggaattatgcagaatattttaattaatagtaagatgtaatttttaagtggtcatttaggtcttgtttgtttatggagttgtttttttgtttgtttctttgagacggagtctcactcttgtcactcaggctggagtgcagtggcgcaatctcagcttactgcagcctctgcctcccaggttcaagcgatgcccatggctcagccttccaagtagctgggactacaggcatgtgccgccacaccccgctaatttttgtgtttatagtagagaggggtttcatcatgttggccaggctgatcttggactcctgacctcaggtgatctccctgccttggcccccgaaagtgctgggattacaggcgtgagccgccacgcctggccagattaaaattttaatataaggtaatttccaagtaattctgtatatcttttccaatgcttaatatatactaaaatgttggttgctgtgagctatttctttaaaaaagaaaaaaaaaaggtaatccaaaataaatatgtggaaatcatttgcataatttttcccgtcctcttttgcttgtagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatga

SEQ ID NO: 17074 - DNA, 140725 bp, Human
ggtactacatttaccaccagattaccttattttgcaagagtgttgtcagtgtttgtacttgtcacatcacttatttgctataaaataagccttttactgagtctctgtcaagttcttcttagtgtttataaagatgttcaaggaggtatatttatcagctcttttagaccagggtgccactaatgaactcatctctactgtataatattcttaagagaaactatacttaaggatttatcttattcttaggaagtaaattttacatacttaaagcttttttgatctagagctgaaaaatctctccttgtacaaattattcatcaatataaatatctttatgcaaaaattaatgcttcaaggtacagaatgaatttgaagactagtggatatttgtattgaatagaggttctgttgtggataacagagaccacacttgacagaagtttctctctctctctctctttctctctctctctcactcatagttgtatggatacaggaagcccacaagtatggtgaccctgttctagaaggttgtttggaatttgacttggtgtcctatggcattaaggatttaggagccttgtttctcattgttctgtatttaaaatttaatatttgttaatttcctttttacattttatggattattattgagtgactatctgatttggcagtgtgcttgactgaaagtataagtcatggtttatttatagtgttttatgggtttggtatggcaaaaagatcttgacaatgaatatttggtgaattacttggaaggtcagatatgctggggaagagtcattaatctagacctgtttgcaagacccctgtgatatatgttgtggagcttaccacccaggggagggatgggaaagggagagacagggaagcacaaataaagtgcttccaaagccctgaacgtgaagactgtgtgaagaaagacttcatgaaaagcattgcaggtgggacgcctttgaaggatggggagagtttcaatcatcataaatacagggaaggcaaagaggagcatggggtagtattggggggaaggagggaatagaaagtactgggagggagatgcctggtgtgttcatgctggtgtccagttaccatgcatgaagcacttcacagatgatttgcagcacccactgtgccttaggaatgcaattctggaggaaggacgttagtgagtcaaggaagtacagtgtaggtgtttcatttagccttgttctttttttttttttttcctgatagtgtgacaaaggagagttttatgttagctaatactttgacaaaactttattgatttgttaatttgcaatattcaagatgcttctgtgagctataataatctttaacatctagtaaataggattcatgtttagatggaattatctttgtagtttgaattaagacaaaataatgacaatatttataaacatatgactcttaaagggggacataagctctcagtattcacaaaaggccaggttctaagtgctttctgaagttacaaggttgtactctcccattttactgtcatattctgctgatacatcatttagagaacgttccaagaaagttctaattcctgctgaagagcagagcactgacatgatttttcacttaggtgtgcagaaagagttgtttagctttatgcacaaaacgggctgaaatcaagctttaattagtcagacttttgcataattcgtcacggtcactttgtaagtccagcagaatatgctgttggtttttatcttagtgggttcattttcaaggatgtgttgtcttattagctctttgctacccaaatatttagattttcctagcaaaaccatgatattgtatctagtctcctaaagaaatgaattgctatatgatgatacataaggaaatgaactgatacataaaagttattcgtcttaaatatcattcttgataataatctgtcttaaagacaggaaagtaagttaaggttcttctgtctttttgaatccataggctgtccatctggcccaggcaagcttccagattgaagccttcggctccaaattcattcttgacctcatactgaacaagtgagtatttagacataatcttcttaagaagcaggtgcaataaagctttgtttttataatatcggtttagtcaaaataatgtctgttgtttaacaactattttctagcagattattatagagcatgtaaagtataaaattctgaatggtgaattatatatttttttccgaaataaaagatatttaacatgttaagcatctcaaacacagcacttacatattataattttaaatggaataaatatttgaagtaatccagttaattaaatgttaattataatcatcactatatataagaagcatgataaatttactgattcaagtataatttgactacagtctagaaatttcttccatttactctttataatgcaattcgcatgacttctgtgggaagaacagagtaagtgatgacttgcaaatacctattttgagaagattctttgctttataatttgctctaatatggtttcttagaaattttggtcctgatgaaaatttacccgattgtctctgagcatgtgtttgttgatatttaaatgctgtttcctaagttcaaatcagttgtacagatgtctttgtacaaagtgtgaacaagagctgttgacttaactaaggctcttcagcctcaaatagatctagcagtgagcctttctttggtgaaagagattttctatgtggttttcttgagttacagaaattatagtcagtattttaagcttttgtcagtattttgatcaggactgcatctttgcaagaaaaatacctgttaatgctatcaaacactataatgtaagtgaccacaaccaatatttgagaaattgcaaagaattataaagaacaactattaaattttttgtatgccaaattctgtgagctctgcagaaaaaaatgcaaagtcagcttgggtgttccttaccaagtgttattgcagctttaagtcagaatgaatcagcagaactcagaattgcctatgtaaaggtattgcaggttttcctctttggttgagttccgtttcaccatgctgtgtcagcagtttgtctgcctaagggacttgtcttgccaaatcttacactatgttgagtggcaagatagagctaattttagtgtaagtcctcaattcctttaactcttactgcggtggagaccatcatttcaaactgtagcgagatgatcgcaaccaaccctgctgtgtgttttgagcaataaaatatctcagccatagcagagcctcccagtcaattagtacatggcagagaaagggtcatatgggatggccagggtacttagaggtctggaaatgtgccagaagttatcagtaacatttagcatgcaaaggaatcaggttgagcacctattatgagcagtccctgacttgaggaatttagagtctacttgggggaaggttgatagacaagtacgtaattttagaagagtatgaaatatgctggaggttaaaatggaatgttatggtagcaccaaggagtggcagctctcaggctggaggagtgtgaaaaggcgtcttgggaaaggtgatgcttgagctaaatcttgaagtgtgttctaggcatgtgagatagtatatctgaagaggcaaggccacgttgcagtgtggcatgttagaggagcatgagccttttgttgaccttcctcataaatgacaagattgagacgaggaagatgagttgggagaggtaagcctagggacagctcagctcatggaagttctggtatttcacgtgtcagtgctgggccattatcccctagactgaaaaatcaagtcaggggaataaacagaggtcctgttctcaggaagtgctaagaggcgtggagagggaatactttcaataaatctgcagttgataaaaattattaggattgctccatgtggataacaaggcagagaggatagttaaagccaacagaggtacctcgattggttggttggtttgagggtgatgtctagctgaaatgggcagtaccagggaacaaacaggttaaatggtgaagggaagagaatgtggcatcagaagagacatgatagatttgaggggctttgggacatacatgtggccatgtctaggaggtagctggatataacctcaggggagagatgggagctagagatagtagacttggtaggtatttttatataaatgttaatgaccaacatggctgtgaatgaggttaccgagggagggtaggtagagtaaggagacagaagctgagaagacaggtaagaggaggggagaagaggaggcacccatgaaggaaattgagaaggagtgattggagaaataggacaatcaggagaatgattaaacagagtttcaaaatgggaaggtgtgatttacagtgtcatctgcagtagagccatctactggcacatgctgtggaataatctaatgaggtaagaggcaaaatttgccctttggatttgccatttgagcagtcaccggtggttggaaagcagcagtttcaatgaaactctggggtggaggaaatgagaggggacagaaaccgggttacagtaggctgggagtgaatgagaggagatgatgtggaggcagcaaatatccattgaggaggtttggatgagaagaaaagagagcagaagacattgggatcaaggcagggctttttaatgatgacagagcaagttggcagagcaagttaacagagcaagtttggtggactgagagacggagctgataagagtgggaggttgaagatgcagaaaggagagaggagatatctatagggcaagagctgggtagagactgaagggaatgagatcaaagcccaagggcagaacttagttttgaaccggtaaagacaggttgtcctgcactggtgtgaagctgtagggtgtgtgcagatggagattgacttgcaggtgaggggatggagttgaagaaacacatttctgaagttatctactgtaggggttgggatggagagggaggttgggttggggcttgaggaaaatgacaaaattgctgggaagaatgagtgaggaagcccatcaaggtcaaatgcaagaatttttgagcaaccttcattagaaatcatgtgctatgtgttagtctttgtgtatttctttctggtgttgttttttatattttatttgtattatttttaaaaattggagtgctttgtcactgcagagtgtgaatgaaggaggcagactgtagtgtggacccagggctcaatctctgtggtagcacagaataagaacagtgtaggcaaagctctttgaatactcatgaataacttgcatagttaagtatcaggatccagtctgggttagaagggagatgaggtcaagaggaggctatgaactggggacaaatggaggtctctgaagggaaaactaactgcagtgagagagaggccatgagagctgcactcaagtgctatctcccttgatatggtttggctgtgtccctacccaaatcttactttgaattgtagctttcataatccccatgtgtcatgggagggccccagtgggaggtaactgaatcatgggggcgggtttttcccctgctgttcttgtgataatgaataagtctcacgagatctgatggttttatgaaggtcagttaccctgcacatgctctcttgcctgccgccatgtaagacatgcctttgctcctccttcaccttctgccataattataaggcatccccagccatatggaactatgagtccattaaagctttttttctttataaattacctagtctcaggtatgtctttatgagcagcatgagaatggactaatgtaatacatcccccatgctgtcctgagctttctgagtgcaacctgagtgtgcaaggctggcatgatgaactggaaatgagggaactgtgttagaacatgagatgtgttgctgggggtgggctctagtttagattacttctgtctgggattaaccaaaaagtttgatatgtgttagaataaaggtagagagtcaggagaatgtttaagtcagtaatagaggacccaaaagagcttctgaggaaagagggacctcatttccactataggatgatcattgctacattacagacagaggtgttaagttatcaaaggagggaaaggtgtctggtaagtatgtgggctcagggtgtggaggaatgagcacataaaggtgttaccataagttaatccaggtggtgaccatagaatcttcagagttggtgacctcaccaggcccagaagcccagcttgtgaggactaacctgacaggagttcctgagaggagagcctggtttgcatctggcttgtggaggcatctcatggcagtgctgtgtgttttattcatttgttcagcaaatgttgagtgagcatctgctatgtgcctctggctgttataggtgctgatgttgctgagaataagatagacaagacttgtgccttcccttttagagcttcattccagaggaggaggcaaacagtgggccaccacataaagacatataggatggagagggactggaggtggggtgtccagcatgatttagatggtcagaagaagcaagaaggcctatctgaggagggaacctgagctgagccctggttgtcaaagaggagccacaacacgttgctggaaggctgagggttctgcacagctgggacagcaagacagccagagctaaggaggatgtgggatgttcaagaagggcagaggccattatgcagtgcagggcaggggatagtgggagaacgaggagacgagatcagagaggaagcagctgtgcagtcaggcgatgaaggactgtggtccatggtgaggagtgtgggtctgaagccattggatggcagtaagcatggaagagacatggtcagatttctattttatttagccccaaaggtcttagttatggccttagaggtcctttaattacactcctctcagggtgctcctcttttaaaattttgtttagtgtttcctctaaaatagccgttattccaggttacagaagattttgaaaagatcactagggtaacgtttcttgtctttccttttttttttttagtgtcaaacaagcattttagatattttttattttgatttttattatccactttattgaggtatgattgatgttagagcaacaattcttaatgtttatcagtccttggaagtctcagaaggtctgaggattgattgtctcttctctgtgtgtgatcagaattatgccaaagcctatattacccataattatatttgctggtgttttcagcaaatgtttactgagaataaccatgattagagtggcacaatggttgaaagcatgggtaactctttgatcttgggcaagcttcttaacttcttccttttcttcatttttcctcttcctcctctttctccttttcctcctcctcctccttctcttctaccacctccaccacgaccgtcatcacctatcataaaactcacttttctaaagtttaccattcagtgttttaaaattacattcacaaaattttgcagttatcaccacaatctaattctagaacgttttcatcatccccaagaaaccctgtacccattagcagtcactccccattcccttcttccttaggcccctggtgaccgctaatctacattctgtctccatgcattcgcgttctggacatttcatacgatatgcagccttttgtgactgacctcttttacttagcataatgttttgaggttcatccatgttgtagctgagtaatataccattatttggatatattctaagcttcttaagctttagtttccttccgaagctgtaggttgttgcaaggattagatgagataacatgtggtgcttgcacgtgtttgttgacaatgaattattattacctccgtgaggcagtcactgcgctgagatgttgggggattctacattgaggagaagaggcattgatctcatggaacttatgatctggtgagagcagctcaggtcataagaaatgctgcttgtcttccctttggcttcagtcagtctttttctgactttagtaagtgagaagggaggggtccactatgtaatcttttctctcttcaaagtcggctgaagaaaaaaaaatggagacaatttggtaggccctgggttgataggtgctcaaggtagtgagcactgggaattcagataacatacttccattgagttgaaagcatgctcgcgagacacttggtacttgtccagttttcccagagctgctcaccagacatccattaaagaacatgacacgacttgcaggctattgcgtatatgtgggtatttaagtttccaggccatctgactggtccgaggtgaacacccaggtcctcagcatgctgtcctgtttattgtgaagtgaaatccctgtgcttcttttagcccctgcccgatgcagagaggaaagaattcttaggatgcatcaagggtaatgccttcttggttaaaaaggcagcattatgttccttcttaatagaacgctactccagcgagagagtgtggtgatgtgacatgtctttgtacattcatcttgaatgatgcccagggagaactccgggtgaaatcagtgtaagacatccacattgggtggctgactccaaaaactgaggagtagacccaaaacttggagagtaaggtagtttcggatttaggaaaacaatctttattctgattttctgggaatcagaggtgtttgatttaagatgaatatctagaaaatgctgatttaaagaaatacatgcaggcagtactttgctcgttaaaagcagttcacgctgtgttttggaaagaagcagacagctacactgatatagtttcagttagcttaaatacagagcccaaccttcttgctgactgacatggttaattcattcttcattcagtcaacaaacatttattgagcttctcgtttgcgtaagacactgtgctgagcaacacgggggaattcagagctgtatgaaagaatttctcgtcttcaagagcctgtggtagagaaatgagattacagtgtacacgaatagtgttaaaacatgatagaaagtgacttgagagatcttggtgatgagggaaggttttctggggaaggtgggattccatgggactcctacaggaggctgccttggttttgggtcccctggtagcagaccctgagacaaggagggaggagctaggaaagggtgagttctcaagctgtttactcctctgggcagctgggattctcactgagagctctgggagtctgtggactcatgccagagagttatcccacctagaggcagggagctagagttttgtccactaactgccaggctgttgttggctgaagtctgtttcttggggcagtaacactttactacctcctcctgggtagagtacaaagccctcaggcccagggtctcaggcagttccagtcagctgccttcagtgtgtggaagtgaatgccaagggcatagtggcagggcccagtggagcccatagcaggtgctttagactttgaaaggtgtgggaaggagaaagacgcagactccacaggaagtggcaggcagaggtgtggaagcccaaaagcaccaaactcctggggtgagtcaggactggtgaggccccctctcttaaagaacctgaattaccaagctgcaaacagaaggcaaactgcctggtgggagtccctggatcctaagggggatattcagctttatttggctaaatgtttttttcagctctgcggatttggagattgaacttaaatatggttgtaagaaggaacatgtggagaagaaacaggcctcctgcctcatttttctcttgtggtcgagtaagaccaggacaggagtcaggagctgtggctggggacagcttgaggcaccttgacctataccagcctgagctgtggtgttgctgtcttacgtcttggtttctaaatttttgtgattcctgaatccagattggcaggccttttgtgtcattgctggcctttttctctccaactagcagcccatcatgctcactgctgtcatttctcttacacatctgagagagggaatcagggaaggcactggccttaggaatttggagtcaagacttccaatttcacctctgcttcagagagctggtcacacactctgggccttagtccgaaggaattagaggagactatgtgaacattgctttccatttcaggagtctcggggtttatgatgctgctaactcgaaggttaaatgctttacttcccagtttcaagagatctgcagaaggaaggctttctattatggtgatagacactgtgccaagccctatgtgtacccatagtctcctatttaagttcctttgataaccctgtgaggaagatgtgattatccccattttactgctgagtaacatgcgggctggcgagattcagtcacatgcagggactccagcatgggctgtctgcttggagtctccttcaccgtggctgctgtggtcacagcactggactaccaatttgcaagtgagctgaacctaattctgatgattgcatatctgttcacattaagtgagaaaaagagtggaattattttggtcaatttgtaactatatgaggaaaacacggaaggtcccaaataggattgaaaataatgctgtttgttgagtagaaccatctgttatgctctgtgtgtctcccactctgcattcgtacgttgaagttctaacccctagtacctaagaatgtaactatatttggaatgaagtctttaaaaaggtaattaagttaaaatgaaatcttttgggtggcccttaatttaatattactattgtcatgaaaagagaaagtttggacacagacactagtgtgttggaggaaagaccatgtgaagacacagtgagatggacggcggctgtctgcaagccaaggagagagccctgtgaataaaaccagccctgctgacaccttgatcttggacttctagccttccgaactgtgaggaaatacatttctgttggttaaactaccagtctgtggtactttgtggcatccttagcaaactaatacaccgttctaattcacttattgctcacctattgcagtgagacattcagcattaagtgctgcttgttaatgggtaaaactgtttgtcccttatactatgattttcaagtgctgttttgagaaattgtggtttcttttgcatttaggtactttaggatgattggaactgttttggtagttttgaaaaagtgtgtgatgataaagaatcttaagaggcaggtatccccaaagttgctgtaaatattgattgccactgtgctgtgtgcaatatgatgtagtcaaatattgcattgtatatgtcctagaggcctgatagtattctaagctttctagtgctggtaggaatgagttgctatggatttttctctcctgaagccaccctttcctgtctgcttctaaactttttaattctagagtgccaggtaactctttttgttgccatattttctctgatcagggtgatcagacatttctggtctgagtcaacccatattgaatgccttgggtattatcatttgcttttgatgactcatctttatgctggtagatcaggtccagaaaatcttgaaaacatatacaataaaagaaatattgtctaaattttagtagattctggttctatttacttagggtgtctatgcaacctactttcaaaatggtttgagaatgacttgcacaattaaacataacaagattattaaaaataaaatcacaaccaaaccattgatacttatatactgattcttgattttcatagatgaacaaaatccagcataactcttgggtggtgaaattcaatggatgtttgccctctgcctgcccctacccctgcttgcctattaacaataattattgtgagtgactgggacccagggagattaagcaccaggctagagaaatgaggagggccacaggagccagatttagattttctaggttctgggagatgagaaaactgggattgcccagaaaagaggaccctgtggctacagtctttagcaggagaataaaaagtatggcaactaagaatttgtagcaaaatcaaaagaatttaattgttgatgggatcatattacactgtttatcttacctaggatataaaagacatctctagtgagtcaggagactatttcttgactggtggataaaaggagaccctttgcgggtatccaccccaatgcagaatgtgggcaaataaaatctgaacttgactcattttttcagagcacttcttggtcttttgaagacaaagacaaataatgtataaaaattccagcagaagttaattgtgacaaaaaattgaaaagcacagagaattagatgtgaccaagcatctgagataagtttattacagtagttactgaaatgagatcttaccttttagtgggttgtgtaattttcattatctgatacaagaattttatctctctagagatataaatgtttccttgtcaaagaggaattatcccttgacgcctgatgtagtagggcattcaatagcataatggttaatgtgtgcaaccattatgtttcttaaatgggtttctcatattgaccctctgtgttagccaagtgtataaagttctttctaacctgagttgatggatagatttccattgacagaagccattcatgaatgattccgagcacttttatttcacaaatgtttattgagtgcctgctaagtgccaggcactgtcaaagtttgcctggagaagtccttccctcatgaagcttatagaacaatggaggaggaaagacaaatctgtaggcatttaatgacaatctgagaagtactgtgatggggaaagtacaggatgtttttatcccacataggaggggtacctaacccagattagaggtagaaatggataacaaggtaaatgtttatggagctaaatgtctcaactcaggcctaaagcatgtttaagaggtggtcagaaaaggcttgaagggggagagagtgtggaggcctgaaggtaagcaagaaacttgggacatggagtgagagaaaatggaggctttgagaggtgaacagaaccacacagctagtaagtaacagccaagaacagacctaggaatgcccattgtcaaagccttggagagttgagacattatctaattcgtttgtgctgctataacaaaatgccatggactgggcaatatttatatattgtttatacaatagaaatttacttctgatggttctggaggctgggaaatccaagaccaagccttgatatctggtgagggatctctgcttgcaagattgtgccttgttgctgtgtcctcacgtggcagaagagccatatggaagggccaggcaattctcccaaagcctttattgtaagggcattaatctcattgatcatctcattaatctcattaatctcattgataaaggcaaagctctcatggcctaatcaccctgaaaagaccccacctcttcataggtggggtttaaatttccacatgaattttggagggacctatacattcaaaccatagcagacgttttcagtgataaagaagtctgactaaaaatgtgtttgaaaagctctacaaatgtgaaccttagagaaataaaaaactttatatcatttgtgtcttaaccttgctttattttgaatactactattcattgcataaatctagtcccaaacaataacttattaaattttcctcttggttctccatagatttatataaagtaagggcttgacatcacatgaactggctcattaagactcttgatggtcatctgttgccagtgagaattgtgttgttttagaaccattttttggatgattcatacactagaatctcatcatctagagtcatttctcctaatcttttaaaattaattataaattagaatccccaaataagaatcctaactatggtttattatgggctatttataaaagtactctctttaacaagtttgttctaatgcttcttccatgatgatatccatgagccttaatataatatttagattgtgtttaaaaacaaaataatctatactggctttttatttatttatttttttgagacggagtttcgctcttgtcacccaggctggagtgcagtggcgcgatctcggctcactgcaacctctacctcccaggttcaagcaattctcctacctcagcctcccaggtagctgggattacaggcatccgccaccacgcccagctaatttttgtatttttagtagagacagtgttttgccatgttggccaggctggtctcgaactcccgacctcaggtgatccacctgcctcggcctcccaagtgctgggattacaggcgtgagccaccacacctagcctatattggctttttaaatgaaacaatttctacaaaaagtttcacgtcctttaatataattacaaatatatttttccattttacaggaatatctttcaaataagaaggtggaaatctctaatacattgtagagagcacatttcatttcttcctcctttcttttttgcccaagtgagttcacacatccaataaatcagactaaactacatgtgaccagaaggatctcacagcataagaatagattatatctcttgtaaatctccaggatttcttgtttttcttgaatgtccccctctcatctttattgaagataatggacagataaaaattatgcatatttaaggtatacaaggtgatgttttaatttttgtatacattgtgaaatgatcaccacgctcaagctaattaacatatccatcacctcagatggttatcttttttctgtttttgtgctgagactatgtaagatctccttttgcaaatttcaattatacaatacagtataattaattatagtcaccatactgcacattacatccactgaacttactgattctgcaaaatggaaactgaaaccctttgaccaaccaagggattcttagaaacttactagtgtctgaggctctcccttattactgttcatatttattcattaaggactgagctaatacttgaccctaaaaaaatgtttgctctttaaagctgttcagtggtaaagggtttctttatatgattgctagcatttgccctccctgtgcactatgccagctcatagggaaacaagaataagatgcagttcgtttaaggagcccacagtttagggtgggatcagggaaagctatacagaggaggagatggttgagctgttttgaaggatgactaatttgagggtgagtagttcagtacttttgggtgtggtgagggacaataactttttgagcatccatttattttagctggccattcagtggttgatatcaaatgtttactggataaatggaagtgatggattgttgatacagcttagctattttgcatcttttttcccactagtatctcaacctgacacagctttaacagccagaagttttataagctgcaaaaatgagtactactgatattttagctgaggttaaaaatgtacatgtgaaaaccatggcacgagaactatgtgacgaatgcacaagcctcagtaaccaatgctatcaactggaagaaagggtatcagcgatggaagacaaaatgaatgaaatgaagcgtgaagagaagtttagataaaaaaagaataaaaagaaacgaacaaagcctccaagaaatatgggactatgtgaaaagaccaaatctacgtctaattggtgtacctgaaagtgacggggagaatggaaccaagttggaaaacactctgcaggatattatccaggagaacttccccaatctagcaaggcaggccaacattcaaattcaggaaaaatagagaacgccacaaagatactcctcgagaagagcaactccaagacacataattgtcagatttcaccaaagttgaaatgaaggaaaaaatgttaagggcagccagagagaaaggtcaggttacccacaaagggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagatttcgtcaccaccaggcctgccctaaaagagctcctgaaggaagcactaaacatggaaaggaacaaccggtaccagccactgcaaaaacatgccaaattgtaaagaccatcaaggctaggaagaaactgcatcaactaatgagcaaaataaccagctaacatcataatgacaggatcaaattcacacataacaatactaaccttaaatataaatgggctaaatgctccaattaaaaggcacagactggcaaattgggtaaagagtcaagacccatcagtgtgctatgttcaggaaacccatctcatgtgcagagacacacataggctcaaaataaagggatggaggaagatctaccaagccaatggaaaacaaaaaaaggcaggggttgcaatcctagtctcggattaaacagactttaaaccaacaaagatcaaaagagacaaagaaggccattatgtaatggtaaagggatcaattcaacaagaagaactaactatcctaaatatatatgcacccaatacaggagcacccagattcataaagcaagtccttagtgacctacaaagagacttagactcccacacaataataatgggagacttaaacaccccactgtcaatattagacagatcaatgagatagaaagttaacaaggatatccaggaattgaactcagctctgcaccaagcagacctaatagacatctacagaactctacaccccaaatcaacagaatatacattcttttcagcaccacaccacacctattccaaaattgaccacatagttggaagtaaaacactcctcagcaaatataaaagaacagaaattataacagactgtctctcagaccacagtgcaatcaaactagaactcaggattaagaaactcactcaaaaccgctcaactacatggaaactgaacaacctgctcctgaataactactgggtacataacgaaatgaaggcagaaataaagatgttctttgaaaccaacgagaacaaagacacaaaaaaccagaatctctgggacacattcaaagcagtgtgtagagggaaatttatagcactaaatgcccacaagagaaagcaggaaagatctaaaattgacaccctaacatcacaatcaaaagaagtagagaagcaagagcatacacactcaaaagctagcagaaggcaagaaataactaagatcagagcacaactgaaggaaatagagacacaaaaaacccttcaaaaaatcaatgaatccaggagctggttttttgaacagatcaacaaaattgatagactgctagcaagactaataaagaagaaaagagagaagaatcaaatagacacaataaaaaatgacaaaggggatatcaccaccgatcccacagaaatacaaactaccatcagagaatactataaacacctctacgcaaataaactagaaaatctagaagaaatggataaattcctcgacacatacactctcccaagactaaaccaggaagaagttgaatctctgaatagaccaataacgggctctgaaattgaggcaataattaatagcttaccaaccaaaaaaagtccaggaccagatggattcatagccgaattctaccaaaggtacaaggaggagctggtaccattccttctgaaactattccaatcaatagaaaatgagggaatcctccctaactcattttatgaggccagcatcatcctgataccaaagcctggcagagacacaacgaaaaaagagaattttagaccaatatccttgatgaacattgatgcaaaaatcctcagtaaaatactggcaaaccgaatccagcaacacatcaaaaagcttatccaccatgatcaagtgggcttcatccatgggatgcaaggctggttcaacatacgaaaatcaataaatgtaatccagcatataaacagaaccaaagacaaaaaccacatgattatctcaatagatgcagaaaaggcctttgaaaaaattcaacaacccttcatgctaaaaattctcaataaattaggtatcgatgggacatatctcaaaataataagagctatctatgacaaacccacagccaatatcatactgaatggacaaaaactggaagcattccctttgaaaactggcacaagacagggatgccctctctcaccactcctattcaacatagtgtgggaagttctgaccagggcagtcaggcaggagaagggaataaagggcattcaattaggaatagaggaagtcaagttgtccctgtttgcagatgacatgattgtgtatctagaaaaccccatcatctcagcccaaaatctccttaagctgataagcaacttcagcaaagtctcaagatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggagctcttcaagaactacaatccactgctcaatgaaataaaaggggatacaaacaaatggaagaacactccatgctcatgggtaggaagaatcaatatcgtgaaaatggccatactgcccaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcgagctacttgacttcaaactatactacaaggctacagtaaccaaaacagcatgttactggtaccaaaacagagatgtagaccaatggaacagaacagagccctcagaaataatgccgcatatctacaactatctgatctttgacaaacctgacaaaaagaagaaatggggaaaggattccctatttaataaatggtgctgggaaaactggctacccatatgtagaaagctgaaactggatcccttccttacaccttatacaaaaattaattcaagatggattaaagacttacatgttagacctaaaaccataaaaaccctacaagaaaacctaggcaataccattcaggacagaggcatgggcaaggacttcatgtctaaaataccaaaagcaatggcaacaaaagccaaaattgacaaatgggatctaattaaactaaagagcttttgcacagcaaaagaaactaccatcagagtgaacaggcagcctacagaatgggagaaaatttttgcaacctactcatctgacaaagggctaatatccagaatctacaatgaactcaaacaaatttacaagaaaaaaacaaccccatcaaaaagtgggtgaaggatatgaacagacatttctcaaaagaagatatttatgcagccaaaaaaacatgaaaaatgctcatcatcactggccatcagagaaatgcaaatcagaaccgcaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtgatgattcctcagggatctagaactagaaataccatttgacccagccatcccattactgggtatatacccaaaggattgtaaatcatgctgctataaagacacatgcacacgtatgtttattgtggcactattcacaatagcaaagacttggaaccaacccaaatgtccaacaatgatagactggattaagaaaatgtggcacgtatacaccatatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaagaggaacatcacacaccagggactgttgtggggtggggggaggggggatagcattaggagatatacctaatgctaaatgacgagttaatgggtgcagcacaccaacatggcacatgtatacatatgtaacaaacctgcacgttgtgcacatgtaccctaaaacttaaagtataataataataagaaaataaataaaataaaaaaaatttacatgtgatcttactcctttgagaggtttagttaactctgttgctgtgaaatcactaatgttctcatgtctgaatggaaacatctagtgacaacagtgcttttagaagtaaataatatgtctattttcatgcagctttgaattcctgggttctttgtatacgtttgattcagtgaactatgaaaaaatgagcaaaccttaagacaccatgaagtattttcaataaaagcagtttgagacaaggttttcaggttggcggattaaaggaatcaaactgttccttcacccagcaccgtgaacaacacccgtactacatttttcttgttttgagtttatctctcctgaagatatgctgtttggaagtatttttttattattaaaatattgcacgacttgtttgaaaatttatttttgctggttattttttatgcagaaaattctttcttcctataaggcccagaatataaggctagcttaatgccttgttgtgttgatcagatactaatatcagtgtagatgatctcgtactcattgttgcattagatctattgtcatggtagccacaccatataggaagcaaaagaaaactagtgtttttgtctctttctttgaaggcaacttcctggtaagtaatgattaaattatatgactctcaaagtacaaaaataacacaattccttagatattactccacatttgtgtagcaccaacatgcaggtagttagccatgataatggatattatgttcatgaaaaatcggtgctcaaaagtagcttttagaagggaaacaaaaccttgtatattagtaagatttatctctatctcagcggtgaatgatacagggtctgtaatcaaaatgtttttcttagtataatttgactactagctctataggtaatacctttcacagagaagcatggatgcccatctcctctcctttgtgcacaatcctgagggttagtcttgtccttcctctgcccttggcatcaagggacctccaggaacctgagagtgtgtatctttgggctgtatctactgtcatctgcttccacctgtgtgagggatccctggttcgctgggagatactttcctgccagcatttttatccaccgttgatgaatcaccctctctcatctgccacatctggtagggctttgagtgtcacaacctcatgcttttaattatttatttttttagtagaagatacagttttcttactgttgaagaaagcatagttcaacctcttttttgaaagttgggtttcagtgttttcctgtttaaagtcaatatatcaaagaaggctaagaggtgagccactcacttttttttttttttgacttagttgtgtgtagtgtttgaattgcagggatttatacaggctactgaattgaaaagagctttgattgtgatacctcagtgaaaacgattacatgtatgtttgtgtatttgtttcctgtttccaagaacaacttgtagctttttaaaaatgagcttcctttttatcatgacatgttgaggttagataaatctttaaatgtcctgcaatctaactccctagctgattttcgaatctcttcttatccctattgagagctcttctggtgtattcctgaacacttccagacttaggtagctgattcttaaactatgctgattgctatcaagtacttttttttttcatgtcattctgtaacgttttatcccctggtttcaatttttgcacttaaagcaactcactcatggagactgagcattaggctacttcattcagttatcagcacctcctggaaattggttcctgacattgctattgtcccaaagataacagccaaagttctgttcgtatgtgtttacctagaatataaaataagaatacagatcattttccaagagtggaaaattataaaaagaacttttctaaggcatgaaaaatactatattttaagcacataagaagctatttatagtttcttcctgccagtgtccagtgctattaaacagcaggagatttttatagtctgaaaagggatattttgagtctataagaactttttgcaaggtgatagcaatctcaggttgaattctgccagattttgctgtctcaatatgatttacaaatgaattgaagttaatactgtctgttaagagagaagttaatacctacccattattaaatataaaaccaatgtgttaaatataatttagttttatttctaaaatttcattgaaatataatgttttagcattctggttagaattgaaatgcagtaacacaaatatgtttttagtatcttctttacagaaaatattagtttattctaaaaattaaatttgatgccaaaaattaatttgtatctggttgcattgggaagaataatgtcaaaaatgcactaacttcctttgccttgatttggggaatgatggtggtgtataaaaaatgatttagaaaccatcagtatgcaataccacaattttgtgattattgttatcttttgttattcttaacacatctatcttccaaatgcgattgaaaacagggcatgctgtttaaactggctctttggccatagtctttgttcaaaacaggtcaccttttgatgattttacctaaaaacattttataaataactgtagttattttctcctgtgttacctatgagccagcagaaacttttcttctgtgtttatggatttaaaagagttttttgtttgtttttttggtttgtaattatgacattcagcttattacttctttcatatgtaatacaaatgttggccaaaaattggtatttttccatcgactttgaagaactgtagaaaagaagtcaaacacttgtaaatcgtatgttttggtgattctaagtgatactccttgggtttccaatgaacttcaggtacagagggctgttgttaattgtctttcacatttatgccatgttagatcattgatctgagcaaagccccagtattgtttaatgttttcattatctttatctatctccagtccccatcttattttccctgaccatatcctaatgaggcaaccaacccgatgtgttttacacgatctttttattataggtgttcttaaaaattacagtttgtggacatgtaattttatttaataaaaatagtgttatgctatagatctctactcaatacaatgtttaaaggtctgtctgtaaacctgtgtacatttttatatctaaccgtggtagagtaccctatattgtgtctctaactgcttcatcccccagggggagatatgtagattccccgtggctctccacaaccacaagccatattataatgtatatgtataaatcaggatgaatagagcccatttatacatatacatatacattggctgtataggccaatgggctttatccatcctgatttatacatgtgcgttataatatggcttgtggttgtgttgctggtttattgggccagtgtgtacttaatttgatgaagtacttcaggatcgtcctccagaagggctgcactgatctcctcttgagcaaagcatgatgttcactagagtgttcaaatctcatatttgtttttgggatgaactaaatgactttttttccctaggcatagttactctctgtatgttgggtttgaatgggtgatttcttacagtagacaagaaggtacttgtctgaaagttaaaggagaggagataatgaagtgagaaaaggatgagggaaaaagaaatacattgcttatcagctcctaaaactaggcctgacacaaggtagagggtcagtcaatgtttgtataatgagtgaattaatagtgtggtatggtagatgttttagatttatagctaaatattttgacttacattctgcttctgccactggggggaaatcgtgagaccactctgaccctcagtttatgaaactgaaaactgagattgatggaagggctaattgaggtgcagtatgtgaagggactggcatgtataataggcatttaacgggtgtttcattcctttggcaaagtatactttctattacatgaccagtaataatcagtttcttctgcaaatattctgtcataagtcaattctgattttggcctttttaatggctgctgtaaggatttgtgaacagtctgttatttcctattttgctattcatggaagcattaagtaaggttttacttaaaaaccactcagagttatcatggcttcactaacacagttgtctgtgctgcaactacgtaaattttgacctaattttttcccgatcacctaaaacctataaaggactattttgaaaggtcttatattgtaaagcctcatttatacaggcttctgggaatggagttttacacattaagtaggttttccaggtaacttaaatttattccttgatataacttttatatatccttggtatatctttgatatattccttgatatattcatgacctatttcttgatataatctttatatatctttaatacaacttttaaaaaaggtgccatttaaaaatcctctataatatgttaaatacatttttttgatagaatgtattagatgtaattttactttttaatatgcaaaattattggtttgcctgtttaatcagcaatatgataggctttgtgactgttttcttgttatataggttatcatatttgccctgagtgaacctgttgtatcagcccagctcttaactaatttgttcctttttaatgtgttagagccagaataagaaataaccaaaattagtagcattttatgttagtcatgggttagtaaccttgaataaagacttgaggtcttctctggccaagtgtaagagacgccctgccttgaaaatagtgcttttgaagactcaactttgtatcctagatgctggccatgttccaggtacttaagagtatcatgaatctgaaatctggaaaacaaagggctttatttcaatttttagcaaaataacttcagaaatgtagctattaatttgacacatactttgtagagttacagagtttgcaccaaattccaccatctacagatgaagacccagaaatttagtagtggacacttttgtccagggtccccttggggtgtgttgagccctagaacccaggactctggactttcagcccatagctcttgtcattctcctttactaatagggacagtattgcctatagggctcttatatgtgtaagctgtagattatgtatgtggaattattaaatgtaccgtctgtacctaaatatttcagaatatttaaatagtaaagattaagtaaaaagaagaataagtatgtcaaaacattaatgaagattctgggactgagaatatgttttgaggtcttcagtaccagatttgattgctataagacttcctctcctgactttggtaagagccaagtggcctataggggaagaaggggctatcaaacctactagctatagaattttccaggaggtatgtatttgcaaactaaagcttctaaaatggtagtttagatttggttttcacctccagaattgtcagcaaaaggataaaaattttagctcaaagttaacagggcctggaatccaggcaaaataacactaataatcaacttaatcactaataatctacacatttccagtgtgtgttatagtgtccaaagtgccttatatgagctaactcattttgttctcacagcaaccggggagatagttactatttgtattagtttgttctcacatggctataaagaaattcctgaaactgggtaagggtttatggagaaaagaggtttaactggctcttggtgttgcaggctctacaggaagcatggctggggaggcctcaggaaacttacagtcatagcggaaggtgaggggaagcaggcaacgtcttacatgaccagagtaggaggaagagagagaagggggaggttccacacacttttaaacaaccagatcttggataacttgctcactgtcacgaaaacagcactaaagagtgaatcctccctcatgatccagtcactttccacaaggccctaccttcaacattggggattacatgagatttgggcagggacacagactcaaaccatattactattattatccccgtttgcagatgatgaaactgaggcatggaggagttagatcttgaatgttaagttgtacatatagttgatttcatctgcattctggctctggatctccaccggctgtctaaagaggcacccccatatagctgcaagtgcaaaggatatccagattttcaccaggctttctccttttccttagagagagaatgtgggatttttgtgggtgacacagatttacattggttcttgggaaggtccagcccttttttagttgtgtgttgacactttatagaatggatcatcacattaagaagggttagatttaaagtctagagttctcagacaagacaaaataatttatttcctgttaaattaacatatgcctcatagaggctaccagatttcatgaaatttcttaccaagtctcttctagacaagccttttgtttttgcctcaccacaacaatttctgcaaacaaaaggtggtatctttctacacggttattctttgtcatatttaagcaacttttgcagaggaaaaggcttatgggtggggattcattaccacatgctgaccctggaccctgtaggatggtaggaaaataaagtagaagcaaagcagaatagggatgcaaaaagtagtaacttcagctgaaaagtgaaatgtagtgggctaagcctttgctctcaaggttcaccaagtggagctgatgtttcgctaggcagaagaaaacttcagtttaggagtctttctccaggccttgtccacctactcacactacaggctgtcatggaccttaacgttcctaggttcccactgtttggtttttactctttcaagcatttcgtcagttatagcttgaaatctgtatttccatattgaggtaaacagagtaccttcatttggattttaccttttagattgcagatctagtctgtttatttttctggatgtttgctctctgaagggtaaagcccgtcatgcttaatcatcatttgcatttttttcttaacttctctgctgttcacaaaacaatctaattctttaagcaggtgtgtagtcatgtcccttggttttatctaagtaaaatgagaaaaatcttgttttccaatcaatcatacttgcattttgacatgaaacagcaggtatttgtcaaaattaattgttagataaacctgtataagtgaaaaagagtgggatggctgaaatcatttttaaaaatggaaaaaggtgctcagaggatctgaaaaatgttggattggattgtaccttaccttgcaataaaaggagattcacatctatttaaggactcttgcttttcaacattcacatagtgagatataaatgcagggctattttttttaactataagaaagtatatttaaaatttgaccattgataaaactatgacatcccatatgataagttgcagtcagatgcttgcatggtaggtgatatggtttggatctgtggccccaccgaatgtcatgtcgaattgtaatccccagtggtggaggtggggcctggtgggaggtgattggagcatgggggcagacttctcatgcatgggttagcactgtatccccctgggtactgtcctcacaatagtgagttgagttctaatgaaatctggttgtttataagtatgcagcaccaccccccttgcatcctcttcctcctgctctggccatgtgaaatgccggcctcccaccttcaccttccactgtgattgtaagttttttgaggccttcccagaagctgagcagatgccaccatgcttcctgtatagcctacagaactgtgaaccaattaaaccacttttctttataaattactcaggctcaggtatttctttatagcaatgcgagaaagtactaatacagtaggatttattgtatggctttttcctgcgtgcttcatttaaaaatgtacttttcttaatgagattttgtctgaatgtccactgttgtgtatttttaagccgtagtctaatacttttgtttggtctcactgatataaaaatgcaaacttgccttttaagtttataggtgtctttaagctttcctgggtcttttatttcctgatagactttattttagcccgtaaatttataggctggtattcaatggtgattatagagcacagatctgcagaccaatgatcctgtgcagcctgcttgggcttccctcatttctaggtctgtctctcagtggaggtaagggtttaatgaaatgaagaagagacaaagagtttttctcctttataaataaattgcctagttcacttttttttttgagacggagtctcgctctgtttcccaggctggagtgcagtggcgcaatctcggctcactgcaagccccacctcccaggttcacgccattctcctgcctcagcctcccgagtagctgggactacaggcatccaccaccacgcccagctaattttttgtatttttagtagagacggggtttcaccgtgttagccaggatggtcttgatctgacctcgtgatccgcccaccttggcctcctgaagtgctgggattacaggcgtgagccactgtgtccggccgcctagtttactttttatcactttactaacaggtcttagaaaaggctaggctgggcgtggtggctctcacctgtaatcccagaactttgggaggcagaggcgagcggatcacctgaggtcaggagtttgagaccagcctggccaacatggggaaaccccatctctactaacaatacaaaaattagccgggcgtggtggctcacacctgtagtcgcagctacccaggaggctgaggcaggagaatcgcttgaacctgggaagcagaggctgcagtgaaccaagatcatgccactgcactccagcctggactgagactgagactctgtctccaaaaaaaaaaaaaaaaagaaagaaaaagaagaaagaaaaggaaggggcttagtaaagccccctgcttttcaaatatcacctaatgaagctaaacatagcatgcattgaggtacctactaagttccaggtgctgaaataggcattttgtatttgagtagtaaagaccttgtcttatttctgagaagtcatcaacaacataagacttgtaacaaacgcaccttataactctatgaataattttctcaatttttctctctgagatcgctggcaaagttttgtccaaaaccaaggattcattaaaatggcagcttgtcatgatgaagcaatgaatatcccaagttacttgttcatcctcagtagtgaagttagagacctgttgtcaccaaaccatcatatgaaaagaagatagcaatagatgtttatattagtttctttttcattgtcagaagtctttgtacttttgagacatagaagaatagctgttaaatcaaaagcagtttttttgtaaagagataatgtttttggaaaagtgactgctcattataaaatgtcaagtcgatacaaaaagaatacaaagaaaaagtgaaaaacagattcgtattcagaagtaaccattattaatattgttaaacttaattcagagaactctgtatgtatactgatagaaggcttgatagtgtacacatatgagattattctataatgatattttaaatataaatgattaaatttaacaaaatttgaatacaatattaaatttatttttcagggggagattatttgtattttcttttttcttttttttcttttggagatggagtctcgctctgtcacccaggctggagtgcagtggcttgatcttggctcactgcaacctctgcctcctgagttctagcgattctcctgcctcagcctctcgagtagctgcgactacaggcatgcgccatcacgcccagctaatttttgtatttttagtggagatgggatttcaccatgttggttaggcacgtctcaaactcctgacctcaggtgatccgccggccttggcctcccaaagtgctgggattacaggtgtgagccactgcgcccagcctgtattttctttacctctgtatttttgacattgtaatgaacttgtattattttcatagttaaaattatataacaaaaaataaactatggtaataagttttatgtaatgaagacaagtatcagtagtggctgtgtgacacatgagtgattccttctctcctcctgagcccgtggctttgacattagctaatagttgtaggagtctttcctttggatcccagacttgagctcagaatctttatcaacatagttttgtagattgtcagacccaattgactgcagttagtcttgaattgagactcatttcctagacttggtctctttatttagttccttcctagtttttgctttctaattatgcatcatagttatgaagtgcatatactgtgcatgaaatcacattaggaggaattatacgtggaggaactcatggtctgtgattctaattatgagcaccttcttttggggcttaataaatattaaatttaaaagaaaaacaaatgaaatgaaaggaattggtgaagatcagacaaatactgtatttctttataacaaaacatattacttgctaaaaaaatcctactaaagttgtgaagaactttgtatggagtcgtttaaaaagaaatgcctcagattgtatatttaagaagagaagaaatttatatactaagacttctttcacttcattctcacctgttataatgttctttttacattgccaagatttattaaatttgtgttttgtttagtaaccacaataaataccaattctttacttaaaataactgggcccatcatgggtctttttagcatggtttctccatacttcctggattatttgtgtttggcttgactggaattaattaaaaagcagattgtctgagaaagacttttgagtgttgtatttcatgagttcttcaacagttgggaagtgtttgaagaataacttggctggacatgaaattttgaatcatactttccctgggactttatagaaatggctcagcttaagctggagatttgctcagtgagtgtgaggccacctagtttttccttttagagagctcgctttttcagccttagatggtcatatgatttttctttatcagtaacttccaggtgtactaacactatttatgttcattgttttaccagtttttccaggaacatggtatagttttttgagctgcaaattcaagtctttctttgattttaggaaagttctgttctgttatatttttacctatttttttctcttccatgtgttttatttaggagtacctaccaacaagatgtatcttttatcttttttgtctatcatctctataccattttatcattgattcctgactgtattttcgttgtttttcctttttctaatttgggttgcacccttgtactatttattttttatttcatttttttctctcctgagctttgccagctgccttttcatgttcttttatgatgtctctttgaagtccttttacaaaagaggttctttctataatttctttgagatcagagtatttgaacatttcctctgttttcttatgatgcatatccttcatctcccctgcggtttgctactttccttctttcttttcttcctggttatctgtgttcttttctttctcattatgattcttccatgcatggggacagctatttgctgaagcagagtgtggggaggagagccagtggggacagggagggaagagtgagccagggttccacagcttgtttggagtttgttgttttgatcactcttcaccagtctgttgttctctgccttggaggggtgcatccctccctaggggcataatcaggacagtggagctcatagcagaacctccttggagctctgtgtggcaagcaggcgtttgaactttcacatttcttcacttcacccctagaaggtcctctgacctgttgaaattctggggatgcatgtgttggcttagacttctcagtatttagctttgtagtttttagcagcttgaaattggactaatttctttctgtagggaatgtgtagtaattttttattcctctttttttattcctttgttgctatttatgaggaacttatctgtgcaaggaatccaaataaggaaaaattaatgatagtctaagacagaaaatgagagggaaggaaacattttcattccctggaagtattttgattgttacatatttccctaggtatgttacagtgtcagtggccttggatgacaaggtaacgaatgaggttctgttaactaggaacattcactgaggtattcaacactaggtgcagatgactgggatttggaatatttagaaggtaatttcaatgacatatgtggtgaaatgtaggtaactgtaggaaatggtgtaatgcttagaattcacataaaagagataaagagaactgatagccacatgcttatttcatgagattatgggtttaaaaattagaattactttcaattttctaaacaagctgcttaatagcctcttaaaggacgaacaaattcaaattcttctctagttaagaattgtaagaatgatcaggcatgagacacagaaaaaaggaaaaaagcctcattatgctattacttcactcatcatttctgattttaaattgcagtttagtgtgggtatttaaattgctagctatttcaaaaatgtcctctggttttagatactataatcagctgaaaaggctattgagtgccgttacatggcctcaagatctaaaaacttttgtataaaaatagaacaatttataatactgatctgaccctctgagcatgcatgtgaagacattcctagaataaccctttttagaattattggatgttctaaatagtctaacaatgtaacgtattgtctttgatgaaaaaatagaaactctgaaaaagactttttttttgagcaaaaagcatctggaagtgccttgaactatataaaatgagtgcacagatatacctagttttatgttcttcacttaattgtgctttgcagatattgtgcttctaacaagttgaaggtttttgggagccgtgcattgagcaagtctattggcaccatttttccaacagcgcatgctcacttctctgtctgtgtcatattttggtaattctcgcagtatttcagactttttcattattatttaaattattatgatctgtgatcagtgatgtttgatgttactattatggttgttttgggggtaccacagactgtacccatagaatccagtgaactttatggataaatgtgtatgtcctggcttctccactgactggccattccccttctctctccctctctggcctccttattccatgaaacacaacaattttgaaattaggtcaattaacaaccttataccggcctctatgtgtttaagtgaaaggaagagtcacatgtctctcacttgaaattaaaaggtaggaattactaagcatagtttcaaggcatgttgaaagctgagacaggttgaaactgaggcctcttgagtcagttagcaaagttgtgaatgcaaaggaaaagtttctgaaggaaattaaatgtgctattccagtgaacacaggaatgataagaaagtgaaacagccttgttgctgatatggagaaagttttaatgttctggatagaagatcaaaccagccaaaacattccattcagtgaaagctgaatccagagcatatctcccctcaattttatgaagacagagagagatgaaaaagctgcagaagaaaagtttgaagctagcagaatttggttcatgagatttaaggaaagaagctgtttccataacataaaagtgcaaggtaaagcagcaagtgctaatgtagaagctgaagcaagttatccagaacatctagctaagataattaataaaagtggctacactaaacaacagattttcaatgtagatgaaacagccttcctattggaagaagactccatctaggactttcctaactagagaggagaactcaaaacctggcttcgacgctgcaaagaacaggctgactcttgtttggtgataatgcagcttgtgactttaggttgaagccagtgctcatttagcattctgaaaatcctagagcccttaagaattatgcgaaatctgttctgcctgtgctccataaatggaacaacaaagcctgggtgacagcacatctgtttacaatatggtttactgaatattttaagcacactgttgagacctatggcacaggacaaaaaaagattcctttttaaaatattactgctcattgacaatgcacctggccaccaaagagtgctgatggagatgtacgaggttaatgttgtttttatgcctgataacacaacatccattctgaagcccatgaatcaaggagtaatttcaactttcaagtcttattatttcagaaatacattttgtattacattttgtaaagtgatagttgccatagatcgtgattactctattgggtctgggcaaagtaaatagaaaaccttctggaaaggattaaccattctggattccattaagaacattcctaattaatggaaggaggtgaaaatataaacatttacaggagtttggaataagttgatttcaaccgtcatggatgactttgaggggttcaagagttcagtggaggaagtcactgcagacgtggtagaaagacagtaagagaggaacaactagaagtggagcccgaagatgtgactgaactgctgcaatctcatgataagacttgaatggatgaagagttacttaagtggtttcatgagatggaatctactgctggtgaagttgctgtgaacattgttgaaatgacagcaaaggatttagaatattacataaacttggttgggcagagtttgagaggattgactccaattttgaaagaagttctgctgcgggtaaaatgctgtcacacagcatcacatgctacagagaaatctttcatgaagagtcaatcaatgagacaaacttcattgttgtcttatttcaataaattggcacagccactctagccttcagcaaccactgatcactcagttcagcagccatcaacatcaagacaagaccctctaccagcaaaatgattacaacttgctgaagggctcaggtgatcattagcgttttttagcaataaagtatttttagatataatgctattacatgcataatagactagagtacagtatagtgtaaacctaccttttatgtacactggggaaccaaaaaattgtgtaacttgctttattgtgatacttgctttattgtggtagtctggaacagatcctgcagtatccccaaggtatgcctgtatctcagtatagtcgtgatcataggtcttgcttttctttagattcactgttggtgttatcatccatgaatttcaccttcctgtgtacaaacatctcttattacagtaggagaatatgggagtcagaaaaggaagacatttattgtcattatgaactcagaaatatgttttctagtgatcattgaaacaactgagattgatattttccagccacggcagttttggtgattgaaagcaagatctgttttttaaaaattaaatataagtttgcacattcttccagggaagggcacgggataatttcccttgccattttattttgaaaccagctttgttgtggtggcacgctccatgagatttgctccatgagatttgctccatgttgcaccacacacagtctttgctcctgtgtccttccatagaaaaaaacagtgtggggaaggatttggtttgtcttaccctttaatcttctgctcctacagctctctggtctgatagttcactattttggtaataaagtcagatatagttcaaatcctgtctggtctattatttcgtgaaatttttgaacttttccatgctttggcatcctccaagaactttttcctttctaagttttactgttttaatataaatggactcctatgtgaacacttttagactggagtctaaaagtggcctaataggcttgctatttttagagaaggagaaagttgccttttgttctctctgtgcttttcacctcccacatgttctttagagttttttttcctgttctggtcttagtagtgacagctttctaattccagaggctttttcctgggtctgtttctggctcattttgtctcatactcaaaatttttaatgtcagaattgggctgggctcttctctttctattatctgtaaacattttgggtttcttttcctctaatttatgaaaattatgaaatgtacacataaaggagtggaaaatatattcacccagtttaaagaagagtaataaaatggacattcgtatatacccaccatccaggttgagaaatagaacattgcttgtgtctcagaagctctctgtgttcctctcagtcacgttcccccaccccaactcctacccaaggtaacctctcatcctgaagcttacatggaagatttgggcatttttattaaaaaaaaaaaaaagaaagaaaaagccaagtagtgataaaaaatagtaacaatagaattttcaggaaaaaaataaagataatgtaaatgcgttttttttctaacattccacaaaagaataatttgtttaggattgaggagagaattaatgcttgtcttagtctgctcaggctgctatagcaaaatttcatcaactgggaagcttaaacaacatttatttctcacagttttggaggctaggaagtctaagatcaaggcacctcaagatttagtggctggcagagaccctcttcctggcttatagacaagccaccttcttgctgtgtcttcatatggtagagagagagagggagagacaaagttctttggtctcttcttaaaaaagagaggacttcacccctttgccctcatctaaacctaattacctcctaaaagccccatctcctagtaccatcacattgggggttagggcctcaatatatgaattttgggagggcacagacgttcactcttgaaggatttcagctattcgtgctgtgtcactgaaattagaactagtgtaaaaagaaaagttcacgtacatataatgcaaatattcagtgagctggcacccaacctacccttgtttgataaggaataattggaaattttctattttggcctagcagtttgagggcagacaacttcttctgacctcatttcctcctgatcattgtggacatacaccagcagcatttccttgtcttacaatagtaagcttgctaaaataataataaataaataaataaaaataaaataatagtaagcttgctaaaataaaaaaacacgctcgtacacacaacacatacacctaaacacacgtatgcactttctttgtaaagctctgtttgaaatatactaaagaggactgttcctgaagtaatcttgcagtcatgtctgctctcatcctttgttctttcagcctcacattcccagtcttcatgggctgactgcctgggattgacttttgccttcacagatacttatctgcaaaagatagagacagaaagtagcccgagtctcaaagttttcttgctgccactgccgtgtgctacctcagacccctcattgcttacctgggggctaagccctgcctctaggaccctcaggttcctgtggattcctgtcttgagtatggtgtgccatcttgtttttttctgagctgcttgacttgttgactcttcatcaacaaatgttagaatgcctactctgtgtaggcagctataccaagaactgtggatgcaatgtggtgcctgtcctttttatgggatggttattttggagagtcttgtttgcttttctagtgtccacaggctggtatgatctctagcctttataggcatttctcttgacccagaattttgactctgctagaccacaagcttctggatttttcctggagtggccacttcatttttctacccctgtcatgagttaccaaccttggtgtggctttcctggatgtgaatcagttcatttaggacttttctcatatcttctctagtcctaaccattctggttcctggaactgatactgatagtaaattcgccataatggaccatatacagttaatgctagcatttctaccagggttctaaaaatgtctggttttaagattaaattaaaaatagtccctctgaaagacctaaatagaatagtttctctctttttctgtgtcagtctctttgggatttggctgcttctggaatcttacaaaggttttgcttttgatccaaacactgcaaggcactttgtgaatgtgagtaagatagtctacatgggctgaaaatttaagaccatttaatgaaagttgtctggctgcaggaaaaatgctcatttttacaaattgtcttaaagttctgatttatagatctgttctgcatttttctactaccactggattttattactggcacattatatttaattaggatagaaggaatgtgtgtgctcataattatttaaaatgatttcaggacatatatttagagaatcgagtgtaaatacttaataatagttaaaagataaaaattcagttttagtattatgcaaaatgtctagactctataattagcctggagtagattaaattatgcacctctaatcactattttatacatgtctttcaaagtgacatcaattgtcatcaaatttgcttattataagattttgctggatgagtacttatattttcagtatatttattttttagtgtctttgtgattaaaaacatgttagcatgactctcaggtttttaaaatttgttttaattacaattaagtgatggttttctaattgtgttgtctgattttcagcagaccacttaaatagtttggtgttaatgcaactgtggctttagcagatcttgatcattagctctcagatgaatttctatgtaaaggaattttgttatcaatctaatctgtagaaagagtgtatcactttacatcttggtaattggggtacagtctttttgttgaggtacatagaaatatgtagaattagaagaaaatttcagcagctctttacagcatataggcaatacgaatagaactgttctttcagcaccttctgaaaaagatgggcctgaagtcatcccagtatgcaatagctgattatttgacaaagcatgtatcaaatagatgaaaatatcaaatagacgtgtgtgttaatagtcctcaacttccagtttagcctaggtgtatatttaaggtaggagatgatgacaatcatactcatattcactcttttagacttagaagttttcttggagaccctataattcaacattcttggtttttgtaagggagaagactagttggacaatgttagttacttctctgagatctcagagatggtcagctcctgggtgcctgtttagttcaggcattcccctgtgacaggatatgacagcacagtgaaaaagggccggttagcacgctcataaacaacactgaatctgaaagtccacaccagttggaagaattatcctttccaaagaagctacaaatgactgatagtttttccaatatattctgtaattttcagaggtatcttagcttgttattattttaaaattgtacataatttagaagaatgaaaattctgtttgttagagaaattagttgtgatttaggtaaacaaagcacaatcatgacttttttttaaacaatcgaagtcccagtgaacaatttttgtgatgctatgaaatgtgctcagaaggtgggcttatttgaaggtcatttttctaaatgataacttaaaaaaatagttgccactttgtatgatagtagttttgtacccacatgaagaaagcattaaaaattctctgttctctttctcttcttggtaggttgtgttcttatctaccatactggtttgagattactgtagaagtatgtttctaattgctacattgtgacaattacttaaacatatctactatttaagaagaaccagcctggcaaggtggctatttcttctaataccagcactttgggaagccaagaagggaggattgcttgagcccaggagttggagaccagcctggggaagatagtgagactccatctctacaaaaaaataaaaaagataagccactcatggtggcacatgcctgtggttcccagctacttgggaggccaaggtgggagaattgcttgaacctgggaggttgaggctgctgtgggtcgtgatatttctaccaccttctagcctgggtaacagagcaagagcctgcctcaaaaaaataaaaaataaaaaggagcaagattatcatctctaaagattcctgtgttatatgtatgaagggtaccatgattgcacagaatattgttttctgtatagtacagagaaatcaagggtgacaacttcaaatgccttttactttacagggttgtgcagacatgccctcagtctgtctcttggggatttgctctacagaggcccctgtctcagttcagccagtagatatattccaggctcaggttgtggtggtgcaggagaaatcaagagttgggcttctcctaggtaggacaaaaagagaggaagagagcacacaaaagacaatagtagtagttctacaaaaatcttactcttcctttattaaaacagtgtaaaattacaaagtacacattagcatttgcataataaattttaggacaaacatctataacttacagtgaaagaatttaaagaaatggcaacatttagttaaaaacctttatctttgttaatcatttctttaattctcttcttcttatttttttctctcactcagtatcttcggccgttaattgaatgagtggaggacagttaaagccacaggttttcatatgtggagaggctgctccttaatgtctttgctggtctcttgccgttctctcctgctgctaacattaattactttgctgatggctctaattgacccagtaaaagaatcttatctgtgttcagcccttcccaggtcctgaagtctttgcagcttctgcttgctttcagcctttataaatagccttccaagttctgagttctggttctagagttccctttcctttgaaagtcctaccccttgcttaagcctgtggatcactgtttctaaacccaccttttcaacactattgccccatatcactgatgccccagctcaactggacttttagcttttccctgaataggcctctttgccttttcctgtttcatggatttgtacacagtggtccctgtctataggatcttctctttcctgcccatatttccctgtccaaattgtatcgtagagactgcctaagccctgcttcttcactaaagggttccctgatcatattaattgaaattaattttctccttgagggctgcttgatgctttgtttgttatttatggtagtaggctaactgctgccttggcttattttagcaatgagattataatcaccttgacggtgagaggcattttgtttctctttttgtctttacctactcccaccagctgatattcagggaacatctgtctcattgagtttaggggatgtagggaaagcctggtcagctgctgctccctgcatggtaggtggtggtattgtgaatgtctgtggttcctggtgtttcctggactcgaaattagtccttaattaaataattcctttattaaaggaactatgcttcttttcctttaaaaatatagcttgtattgtggtttcgtcttaaaatggcagtatacattcattgtaaaaattttgggtaatacagttaagcaaaagaaagaaaataaaaactcttgaaagttctgcaggaaacagtagctcactgctacatttggtatacaccttttcagacatttttctatatgtgaatgtatgtatataaacatacttctaaaaagttgccaagcatagtattcttttatttttcttttcactgaatgatgttgtgaacatctttctaagtgtgaaagccttgaaagctgctctcacctacatcatgcatgtattgttttttgtctagtcatttcctcaggaaacccttatgagtggaacttgtggattatagggtgaacatgctttcagggcttttgatacctattgccaaattgccctctgcatgccagttttcctacatccttgccagcagtggctactgtcattcatttttattttctaaagtgatgggggaaaacgatctctttcattattttaattcacaggtattttattgctagtgcagctgtaggttggtgtatgattgatcaccatgaatatttcttgttttctttttttcatgagttgcatgttgtatacataattcttcatgtttatttaaatccaagtttattcataggttatatatatgtatgtaaatatatatgtatgtatattcatatatatatatctctgtgtacattatacatatataaataaattcaactatatttgtacacatataaaatttgttgttgttagtagaaacttttccccctagattatttttagatgttttttgttggttgtacatctagaaatgtgttttgtttttgcatatttatcttgtaaccagtcaccttacttaactgttattatttctgatagtttttctgttggtttcttttttattcttttggctattttatatatacctaggaagaatagaacaccatataaacagatgtgcagtttttctgtatagaatgaaaaatgaaaaaagtaaagaaaaaagtaaaaaaatgaaaagagttcttttcctagaatgtggcaaaaactggacttggaagagagtagtttcttctgtacaaggttaccagaaggcaaagctgatcatggatcctcttctgttctctgcaatttctctatgtgtgatgcttgctttatagttatgttaataaatattggatgtatcagaaaagaagctggattagcaatagtcaccaactacattcattattagctttgaaatttgttcatcatagcatttcagtgatgtgtaactatgtgcagaagataggccttttttatttggatccagttttccttgtgtttaatttttttttttttggttttatgacatacgggggtaaaactagattgtgaaagtaaccatgattctgtcataaaggaatctcaaaattactggaaacttggagagacactggtagccacaactagaaatgtgttatccacttcatatggtcgagctttaagttaaggggaagaaacgaaacatctttcatcttttatttaaagatttttcttctgataccaccctcctcagaagggaactctcactggcttttaggctgatcaagccagctgagtgagggttctcagcttttatatcacctcaagtctcctaactctttgtttctccactctacaattagcttgcaggcctgcctatgtttcctgtcctcattatactagggttttctaaactttattatggctaatgggaccattacctgagatgcaggagtacctacacatttacatttccactgcaatctctcatatggtttaggagatcattaaatttctcttgttaccccaaagaaaaacctctataacctattcatgctaggaacattctctgcctgcagttctgttcctatgaaatgtgcccacacttaccagcccttgccgggcatgccatctttgtctgacttaacgcaaagcctctatgcaacctataattattttcacccacttaatatatcattgctacatgcttaaatcccagcctctccatgtcctcgatcttttaacgtagcttaaaattcttactgtattgtttacactcaaaggagtgtatattttttagctgaaacaacttttggtatgaaaactattttaggtggtatgagtctattttttttttaaaactttagaaaagtaatggttgaaaaattgttatacttttaaagtcttctgttacaaaaagaaaagaaatataagagcaagcataattgtaggatacaagcttatgtttatatgaatgtattgagtttaaattttgtgtctgcattaccacttacagtaattatctagtgaatttaaaatatcttatgtgtataaaaggacaaaacagagaagcttctaatggaaagagggagcgggcacgatgcttcactgtggcttcatggagccttgggcataacaatgtcactacgctcgaggctccatgaagttgagagtctccgcagtgacagcattggttgtcattaaatgaatgaaatgtgtacctggaaggaaggggtggtaggagacttcttggatgaatgtcagcgctcatttaggtgtgattagggctcccagtactgagaacttaagtactttcaagcagcagataatcagatgactgactttgcatgagaaatatgggcatttgtggtactccttttctagatatcatttaatttttctactgtttgtttaacttctgttccagtcccaatttgaacacatatggaagtaacttacatgttttactactgagaattgaattagggtatttgtgctactgtttacttaggaacaaagatgtatggcaaggtgcatggctagtcaccacctgacaagttcagtgtcttgcagtgaatgtgatctcatagcttcctgacttccacaacttacactgctgactcctcttgcccagatccacctactgatgttatgcactgagagagcctaaggcacctactcaaggctttcctaaaacagtggctgtattagtccattttcactctgctaataaagacattcccaagactgggtaatttataaagaaaaagaggtttaatggactcacagttccacctggctggggaggccccacaatcatggtggaaggtgaagggtatgtcttacatggtggcagacaagagagaatgcgagtcaagtgaaaggggtttccccttataaaacatcagatctcgtgagacttactcactaccatgagaacagtatcagggaaactgcctcccatgaatcagtgatctcccactgggtccctcccacaacacgtgggaattatgggagctacaattcaagatgagatttgggtgaggacacagccaaactgtatcagtggccatgtgaagtatgatgacagaacccaaaagcaactggaggagaggacatactcacagactgtttgcttactagaatctcagcttttgagtattttccaccttgtagaccaacctgaccttccatgtagaactcgatgtgtataccttaaatttggcctttaggtagggtgaccatatgccccagttttcccaggatagcccttcctggtttatgtatgtctgttgtcctggcacaattattaatatgcctcttttcatttccacaaatgccctagtttggatgataaattatatggccatccagttgttaggccttggtgcttgctactattcatctagacttttttttacctagttctgctggtgaagaaatgctgtgtgggcctctaggttccttcagacaagcttgttctcagcaactcactcaatttcctagttagaaataaactgagtgcttaatacaaaatttcagagaatacagattttaaaactagaaaggacttccagagactggtagttcaaccactttttacaatgaagtaaatgattttaagtcatgtagaaaaaatgatttcctttgtggtccaatgtatatcttttctagtagccttcctcatagcccaaggcccagttagccacgtcgtcttgttctgaacaattgttttctttgatcagcctgcccttaaacttttctgaccagaattactccaaagagaagcatatttttgtttgtttgtttgtttgttttgttttattctgagacagagtcttgctctgtcgctcaggctggaatgcagtggtgtgatctcggctcactgcaacctctgcctcacaggttcaagcaattctcctgcctcagcctcctgagtagctgggattacagacgctcaccaccacacctggctaatttttgtatttttagtacagatggggtttcagcatgttggccaggctggtctcaaactcctgaccctgtgatccgcctgcctcagtctcccaaaatgctgagattataggcatgagccaccgcgtctggctggttctttgtttaaagtaaggggttcaagttattttccaaaaaaactggatctactcttcttggttaatagctttcctagatactagggaatcttggtacctaacttttccaattattagaatccttggcttctccatatggaacttccttgtaatggaagatataaacttttgggagttttgaccacatggctgtttatgtgtctacttacattagaaacatgaatctcatattcaaggattccaacaaatacacacacacacacacacacacacacacacacacacagacacacacagacacacgtctatacacatacatataaaactttcctgaggtaaatctctttttgtgaatttccaattcctaaatataatagcagctctgcttgtatagttgctgatgattgtgaaattctttgaacatagatttctaaaagatatttgtgataaatcctgaaattaggacagtttagacaatgtttcagtgacaaacatgaaatctgagacttcagcactgtaaaatgttatctcttccccacactgcgatatagtgcaagttgagtagctcttttagacagttcttctccaaatcatgatgaaagggtctaggctgcattcatatttctgttatgccatctggagcatgtggcttccagggttgccatggaagagagggcttagataatcctgcagggattttagtggtcacactagaggggcagacatcacttccttcatgtctcattagccatgatccattgtcttggccctaacctaactgcagcagaacctgcaaaatgtggtcttatcaggatgccaggaaggggaaaatgaaatagcatttggtggacacacagcattatttctgccacagttcccttcattgacctgattcttggctcatttgtcatgtttcaatagttttatattctcctgctcttacatgttcttcatattttgagtaaaatcatatttagtctcattctagagttcctagagttttcaccactttagtggtgcagattcaccatgaagggcagagtgagtgggttcaagagtttccttgttctagttcttccactttctttcactggcttgaacttccatcctacgtttattcatttacttataaaggtcactcctctttcaacagataacctgcatgagaagcatgggagtagccagagaatacagcttttctgtagcttcagtgattgaaaaaagatgtttattttagaatttaggatgttcagagtttgcccacaagttgttagcatcttcagaaccaaacatccaattggctgatcaacaaagtaaaatgccagtttatatttgggtccgcaattgctaaatagatgagtattagcatttcagaacattctgtttccaacaggaaattgtattaggactacagaaagcagaggtggaggaaaggacaactcatcttcaggcatgtggagacatagattaccggttccttcctggctgggtggggctggagacaccactgcacaatcaactattcccttctccctttttagtgtttcttgtccatcatcaaaaattacatttcactattatttcaagacttttataattaattaggttacatttcagttgatgtaattcactctcaaggagattacaaaataatatttttgagtgaggtgatcaatcttgcacatttgtgctgattttgcttagtttcaatttgaaagttgcatttttcaccctgtttccaagcccctatagcaggtgttggtagatgtttgctcactcagcagatattgattaagggcctactatgcattaggcattatgccaggtgctagggatactgtgatgagtggaataattagtttcaagggaggctggctgtggtcagacagaaggaaagaatggagtaaatggggatgtgtgctatttacaggaagtagaagagtggactggcatggtgaggaggggcatatggtggtgtatttctctcagtatttgccatagacctcctgaaaagtagctgtttttcttctttaagattctaaaatgccagagatactagaaacaggtatgttcatgagaagaagagacccttaaaaagagggaaataggataattaaagtgacctttatgagatttgggaattcatggttagaatgcccttgtaattacaggcaaaattaagataacgttgtttccaactcttagatgtgctccaatgattgtgtggttgaaaatgttgaaaatagtaaattacctgtagagagacacagttggaatgtagttagggagacctctctgcctcctggtgttgcagaagctttctgcagaagaatgataccatcaccagcttcatctatgtatatcatagtgctggtagccaacttaattaactagcagtgaaataagtttctgcaccctgtgagatattccccatgtatacagagttcagtaattgtcattacttttactatctgagatttttaaaaaggaatgagtagacataccacaatttagtttcaagtgtagaattatccttcagtacacatttggtttgtgattttaatgggaaacatgtctaaagtttaagcattggcttcctttctgtgttggaaaggttgtccttcatcacacacaggacatacgcaggacatacccaggaggcccccagttactctgttgactggtgctcaacacccctttccagccctcttcactggattatttttagaatgcatcagatgcagctctcaaaatgatgcaaaatcattgagtcctcccatttttcagctaaagaagtagtgtcacggtttcctaacaagaaaacctactatgaggcaaaattatagaaaatcagaatagcagaatagggcatgagctgaggaatcttctgctttagcccttcatttttgcataagaagaaataaagacccaagtttagagcatacagctggcttagagtgggacctactcttgtccttcagttcccattaggattaaatgagttaataccattatagtccttataacagtacctgtgccatagtaagtggtcagcaaatgcgagttatcacttgtcattattcctagtgatagagcccaaacaggaacctagatgccctaataatccagtgctcttcaggaggcacatattttgtatttccacattgtatagggagaaatatgttttaagaagttgagttaaaataaaaatagtgactgccacaatgccaattaatgtgtacctaatcagcatactcagtactctgtactgaataagtactaggctaagaaatgcagtacttagcctagtactgcatagtctgagttaaatactgcatattcatggtttcctttaatcctcacaatgttctatgagattcacatccttgaccatctccatttgacatacaagttggggaacttgcctatttaaaaaataggttttaaacactatttgacttcaatgactttcttaacctttgttatttatttatttattttaaatttctttttctttcttttgagacagggtctcactctgtcacccaggctagagtgcagtggtgcaatcgtagctcactgcagcctcgatcttctgggctcaagcaatccttccacctcaggctccctagtagttgggaccacaggtgcatgccaccacacctggctaatgttttaaatattttggaaatgggggtcttgctatgttgccaggctggttctcaaactcctggcctcaaacaattctttgccttggccttccaaagctgagattacaagtgtgagccactgtgcctgaccccttacccttccttttatcccaggaattggcaaactattgcacacaagcaatctctggccattcttaacttgtacagtctgcaagttaagaatgtttatatgtgtgtgtgtgtgtatatatacattttttttttgagatggagtctcactctgtctctcaggatggagtgcagtggcatgatctcggctcactgcaacctccgcctcctgagttcaagcgattcttctgcctcagcctcctgtgtagctgcgattacaggtgcgtgccaccacgcgcggctaatttttgtatttttgtagagatggggtttcaccatattagccaggatggtcttgatctcttgacctcgtgatccacccgcctcagcctcccagagtgctgggattacaggcatgagtcaccatgcccggctttgttttatgtattttttaatggttgaaaaaaatcaaaagaaggataatattccataacacataaaaattatgtgaaattccaatttcagtgtccatacagttttattggaatacagccatgctcatttgtttacatactgcccgtggctgcttttgcaatataatggctgagctgagtagttgtagtggagcccgcatggcccacaaaacctaaaatatctactccctggcctttatagaaaacccttgctgacctttgctttatactcttccttggtgattacattttatgacattccaactgtttagggcataattgtggaatttttataggatctgtctcctcaagttacttgccttttggtttgttctgtattaattaacatatcaatcagatcctgaataatgtgaataaaaagagttcaccgtccgggaggcggagcttgcagtgagccgagatcgcactactgcactccagcctgggcgacagggcgagactcagtctcaaaaagaaaaaaaaaaaaaaaaagagttcaccgttggattgtctgtgtcttgtcttttttttttttttttttttttctgcagattggggagtaatttattcctggatactgtgtgaaactcgatgataacctgtttttgtttctgtactaaccatggactgcagctatttctggtttgcatgcccctcacgttcatttattgagccgattgtttttaaacctccaagtgtcttagatgcagaaatcactctattttctttcctttgtagtggtttgttgtcttctgattatgtggagattcactacgaaaatgggaaaccacagtactctaaggtacggttaccggcgtcggcaagtactctagtataagtgtgcttatcatagagttgatcagtgcacactgcgttgttttgacgtctgtctcagtaaaatcacctgtgctcttttacaatgatactatttttagtgaggagaaatttattaaaatatacaaatgtttgaggtaacgttaggtattcaggacaaaaaatgtttattgttttgattatacatgcagtaccttttgtgatagtataaagagctatacagttccatatcagcacctgaaagtagttagtaaagaaggatgaggctcatggccatcgaatctggattagaagactggatgggctgttagaacggttctttagtgcaaatgattttgctgcccaagaagggcagaggacaggtgggggaagtgagatttaggtagtactttttctctaaccttcataacaattctatgaggtggatgttattattcctgctgtactatggaagaaattaaggcagagagagggcaaataagcctgcttaaggccacgggacattgaatatgagggtacttggatatctgattccttcatttggagatgaactttcttgtcttcagggaggattaataaagagcaagtggatttggattaaagcaagagagagagagagatgatttgtatgtaagaaacagtgacctccgtcagtcagggtgaagatccccagaatggctacagaaagaaactctgacttctagggaatcaacaagtgccactgaacctgagcagtgtcccagttactggggacaccagaaaggaaacaaagtggggaaacctcactggatttttgtttgtctttttcctagattgctaacacatgtcagcataaaagtagcacctttcccgtatgtggacttgtgccatataggtaactgggattttcaatctgatggcttctcagcaaatgtttataggtgtccttcattataaatactgctcaggaggccctggcatgtctcaggatttataacatttcaatttgtaattggacgtgttttccagcctttgagttttgtgccacagattaagaactttcatgtatcattcttattagttgtcagttcttgccttaggttgcatttgggggttgttgagtctccctaaaagttagtgctgtggaaagtgagcagaaaagctaaatcaagcgcgggaacaagcttcctggcatttgtacaaactgaagcttctgtcagctgtgccagggccctgagcactgcagatgctgaatcatgagcctggagtagacaagattgcagggaactttatagactcagcaaacgagccacatttgcaggacacagaaacctgatccagacttctcactaaggcacttagttactttttttttttttttaaagaaacagaatagctaattggcctccagaggtcatttgaggtcccaaaaggagaccttatcattaataagacactccaaatctgatatcagttgtaactaaaacttaaaaggtatttcaactctagcaaaagaaattgtgttcactgcagtttgtttttgtgttcactgcttttctctctttcatgacccattttcttcaaacagctcatatacccaaacttacgtgcttcatagataatgaactaacagtctgttttttatgtgtctgtatttatgtacatcagaaaaacccaagatgatatggtgcacactattttatatcaagattttttaaatgtagcaaaattttaaatattttagcatatattaagtaatcttctaaacctttaatttttaaaaatttcataatattatttctaattcatttgttataatatgtttaaaaatgccatggtgatagacattttgactctttccaatctttcactatccgaataacttcaagggaaggccttccagatacgttttgaatacatcccttataattgcttcagaattaattctgagaaaggaattttctgggtcaaagagttggtacaattttttaacactcttcatatatattaacaatttttatttctgaaagtttgtataaattcatattcccaccaccattacatatatatatatatttttaaagcatttgtaaataaacttcatgaagattgtcttttatgctgcttcagaaaatctttgtacagagtaccagaaaaggaaattaatatgtaagaatggctaggttaaacttattttcacataatgcagccttttttcccctaaagatctcaaattgttttttttatttttatttttttgagatggagttttgcttttactgcccaggctagagtgcagtggtgcaatctcggctcactgcaacctccaccttctggtttcaagcgattctcctgcctcagtctcccaagtcgctgggattacaggcacctgccaccatgcccaaataattttttttgtatttttagtagagacggggtttcaccatgttggtcaggctggtctcgaactgctgacctcgtgatccacccgcctcagcctcccaaagtgctgggattataggcgtgagccaccgtgcccggctcaaagatctcaaattgtttagagaaaagtacatgcacacattgtacacacacatgtagacacacaatattttccacgtaactaaagaacagtctatttggctatgaagttaaatgtgaatgtggatattgacagcatcccaggaattagttgcaaccatactttgcaaagagggttgtctaggttttcccatttcaccactaacaagcccctctctcattcttacttctcactaagaaaagattaatgtcttggcttttacttttattgcatggacatgggttaaaagtgcttctttccatgtgaagcaaatataggagctcgagaggtcaaaaagaagcgtgtaatatgaatgctaggtatcagtccaagaataaggaagaacttttgttctgcacttgatggagcaatagcttttgtttaagttcctaccagtgctttgcacataatatataataaaactattttgttgatttttttacaactttaaaaagtaatttatttacttttcttatttaaacaaatttattgggatataacttatgtatcataaagcatataattgtttttagtatatctacagaattgtgcatccatcaacataatctaattttagaatattttcatcactgcataaagaaaccacaccacctgttaacagttgctccccagtctctcttttaccaaccataggtaaccactaatctattaatactttctatctcaatagatttgcctattctggacataaatgaaataatataataggtgggcctttgtgactagtttcctttttcgtccctagttttaatgagatataattgaaaaatagaaattacatatatttaaggtatgtaacttaaattgtatatataggaattgtatgtattattcaaaacatcaggttgatatgttggtacattgtgaaatggtcaccacactcaagctaatgaacacacccatcacctcacatagttatcttttttttttttgtagtgagaacatttaagatccaccctcttagcatgtttcaagtactatatatttgttgaccaactttgctgatgagcctatttaaataagttaatttttagcatttcagttcttataaaataataagcatcaacaaaacactatgaaagtacttttcaaaattaacatatttctattaagtcttttttggtgagctgctaatacatatttgtaagtgcttactaatactttgatttctcttctgcttacgtcagcagtcatgatgaataaatagatgaagtgcctccatcccaacttccctctaccttattactatcattattaggtggggaaggcttcttttcctaggtctatttcctcaccctggcttcttcctattccgttgctcattcttgctcagggaaggaagagcggcttgactgctgggaaagtatgtctgtgcagccagttcctccctccctttttttttcttttttttttgtaggatctaccttcctacaagaagagtacattctctccacctttctcttctctgaattgtactgtggccacccacatgtgtgtatgtggctggggttaggttgtcccacattgtctctgcctgggtgggtaaggctagctactcctgggtgcagcattagcaggcctattagattctcaactaatcctctcctccagtatagctctataataaatgaaggtgacattttgatgtttcaattctatgtcactctctcatttagttttaaacttgggtgggcaccaattcatacctatgaggatggctataatgaaaatgatggacaataacaagtgctgtcgagattgtggagagattggaaccctcatacacagcttgtgggaatgtaaaatgttgtgtggctgcttggcagaacagtttggcagttcctcaaaaagttcaacaaagagttaccatatcacccagcagttctactcctaggcatatactcaagtgaattaaatacatatgtccacaaagaaacttgtacataaatgttcataacattattcatagtagccaaaaggtggaaacaccctaaatgtccttcaattgttgaaggaataagggaaatatggcatatccacatagtggaattactattcagtcataaaagaaatgaagcactgatacatactacaccaaaagataaatcttgtaaacattatgctaagtaaaataagccatacacgaaggggcacatatgatacgattctgtttatttgacatgtccagaataggcaaattcataggaactgaaagtaggttcatgattgccagggcctggtggagtggaggggaggagaaatggaaactgattgctaatggttacaggacttttttctgaggtgatgagactattctggaactacatagtggggatagttatacaactctgtgaatatgcgaagaaaaacactgaattttatacttaaaaaggtaaactttatgatttctgaattatatctaaataacaacaacaataaaaaacccaggtggggaataagagtttatttacccaccctcttcatcaaacaagaatcctttaggattggtcttgtcacatatgctcatgaataagccattcctgttcattcattaaacaaatatggttttactgtatagcataatgtcctttaggtctacccatatttggcaaatgccaggatctccttctttaaggccgaatgctattccattgcgtgtgtgtttgtgtgtgtgtgtgtgttgaaataagccagacacagaaagaaaaatattctgtgacctcacttatgtgtagaatctaaaaaagtcgaatatgtatttatgttggtgcaaaagcaattgcggtgttcgccattgaaagtaatgtcaaaaaccacaaatacttttgcaccaaccttatagaacagtggttaccaggggcaggaggtggaggggtgggagtggggtggtgggttggagagatgtaggtcagatggtacaaagttgcagttatataggctctaagtctaaagatggaatggatagcataagggctatggtcagtcatattgtatgatgggaatttgctaagagagtagattttaggtggtcacgccacacgcttaaaacgtaactgtgaggtagaaataagacatgttaatttgattgactatagtaataatttcactatgtatatcaaaatatcatgttgtatattttagatatacacaacttttttttttgagacagtgtctcactctgttgttcaggctggagtgcagtggtgcaatcttagctcactgcaacctctatttcctgggttcaagagattctcctgtctcagcctcccgagtagctgggattacaggcacgtgccaccacgcttggctaattttcgtatttttagtagagacggggtgtcaccgtgttggccaggctggtctcgaactcctgacctcaagtgatccacccacctcagcctcccaaagtgctgggattacaggcatgagccactgtgcctggcctgatatatacaacttttagaaaacaaaaaagcagaaaaaatattgatttaccttgtactgtgacctttttgaggtcatagttcctgttctaggtactagatatgtatcagtgaaccaaacagataaagatccctgcccttatgggtcctgtgttctcttctcacctttattcttttctttatcagtataaccacatcacccttttagaatgttctttgtgctttccttatcaaatcatcatcacagctcagttcaagctcgcttctaagagtgaagggtttttggcagcaggagagcatggattgtgatcaggtggagtaggtctctgtgcgcgtggctcctggctgggaggtagggttgatgcagagtggaagagattggaggagtgcgtgttctgaagaccctgtccagtgtatgagtaagggagggtgggccctgcagaagtcagtcagagtctggccgaggtgctgtattggagtcagggtattttcagacacacgggtctgcctgtcttcccttttctgagtgtttccccacctctttctgcttcctttcctttatttttctcattccctcttcttttagtaatattttaatgaagttttcagactattttttaaatctattttcccttcttttttactgcctctcagcttgccataattgggtttaaaaattcgtgtttgtattgtttctaaccagagataacttaaagtttgtatttccactcctatactaaaaatgactcttttacttgcgtgtacactagaattttttccctagtctttgaattaatagccagttttttaaaaagtttcttaccactgcataaataataatttaagcaataacaaggaaaacagaactatccacactaaatcacttaaattagatccaggattatcagttatttgaattttgagtataaagttgaaattattattaatcattcaaaatattgaccttcctggcaacattcggagtacattatagaatatgaaaggagcacggggttaaaaaatgccccaagaaatcaagatagcagatgacactagtcctcacaaagctattttaagtttgaatagtataatttatgtgaactattaaaaatttacatagcattggtacagccaaactgttctaatactttattaaactactgcaagaacattttccccattaaatttaatgaaggtaaataattaaattatttaataatttgtgtgttgggagtctcaagttccccaagtctccaaaattattgttttttatttccttattctgcagtactcaaaatcaggtatacatgtcccattatagatatctttttctatttctcatttgttatcagctcactgatttttaaaatagtttagcatatcctagtagttgataagcttgaagaatttaaagatatgtatatagaataatcatttgagtatagtgtcagtagtttttattattatattcagaacctagatatcataatatacacattttctagttaaggactgtgtagtttcttttcaaatgtttatccagacctgcaggaatagattgaaaatatcagtgtatggtcactatcaatgtccaggtttttgggagtttcataagcagtaaagaactggctgatggaactttaccatgcagatggaataattagacacaaagttggggtgcttttaaaaaccaaattaaaactattggttctatttccactaaaatgagtagaatcaaacagttcctgttgttattactattattattattatcattattattttttatagaggcagggtctttctacattgcccaggctggtctcaaactcctcctgggcttaagcaatcctccctccttggcctcccaaagtgctaggattacaggcatgagccatgatgcctgtccagttcctgttattagattagtaataccagagaactggatctttttttccctacaagttgtaatcactagactcacaaagttattatccccagccatttctggttaggaagtattttaaaagatggacatggcttcaatgtgtcagtatatgaagaggaagcctggtaggttccaatgggattctgagcttggaaaccttgtggagcagagttattatttgagcatgatatggcttgtggagtgttcagctatgtgcaagtagcaggctgagaaaggtagggagcatactaggatttttaatttcctgtgactagccaataacttccacttatcagatgctccatttctgttgaatttaattaactgacagttttggatccgaaaatgctgatgtctgtatgggtgcacagagacttgtgtcatgggctgaatcgagccctttttggttgtccctgctgccatttgccacgtcacaggtctgtgacccactcctaggtggtcagggccagccctctttaattgtctgaggtcttcctaactggagaaagaaacatggacttgagaacctgaagatgtgggaatcagtttgtctttttgttatttttagaagagccttttgcactttgtttctgtccccatatgggtacatggagacagcagtcactgtgaggtaatggttgttgaagatggccagatccctgggtggaaggcacccctggagctgactgtccaaagtcatgattgccagtgcccttaagaagtgggctccctgtactggcccacttctgttatgcttggcacccaagatggattgctctttctctctcaggatttattttatatgagataactcaagatcttactttgcagtggtctgaagtgttaccaaataatatttttccatagtactctttaaaaacttggtattaatttagtaataaaaaaatcagaaaatcctctaatactgctagtactaatattaaattggaagctaccaaattgtttataatgtttaatataactacacaatttagctattaaaactttcttatgatgataaacatcagagattggatgttgcctgaagtctcatttaagtttaaaaaaatacagtgattcaaggccaggcacgatggtgcatgcctgtaatcccagctactcaggaggctgaagcacaagaattgcttgaacctgggaggtagaggttgcagtgagctgagatcatgccactgcactccagcctgggcgacagagtgagactgtctttaaaaaagaaaagaaaagaaaagcagcccttcactgtacacacacacacacacacacacacacacacacacacacacacacacacacacagttgtccttgaactgcacgggtccacttatatgtagacttttttcaaccaaacacagtatttgtgggatgcaaaacctgtgcatatagagggctgactttccatatatgtggtttccacagggccgactgtgagacttgagtatgtgcagatttgggaaatatgtaggagttctagaaccaatccctgactttataaatatatatttatctctgttttctcccgataacccacctaaataacagttaggggataaaaaaggatatgaacccaccaatacaaagacaggagaagagaaaacaagcaggtgagatgtagccataaaatttcaggagatggaaagtggatgaggagtgactcttagctttgagcttttcatgctctgctaagttcgtatggggggaaaccaagaagaaacaagtcaacttatgtcacttatcccagaaaggcagaaataaaagcatctgaaaaaagaaaaattggttgaaagtagatgtagagcggttaagtccccaattcactgcctgccctgtggagccagataagcagataggaagtcggggacttccctagtctggtaggagctcatgtatggaaaaaaatggataggagagaattctcagctatattttataaataataaaaattattatttttattattataaaattcttttataaatattatttataaatattatttttataataataaaaatttattattatttattttaaaaagctgcccagaactgaagtgcatagttttcttgattaaaaggtgtcacagcaggaggctgaggcaggagaatctcttgaacccaggaggcggaggttgtagtgagctgagatcacgccattgcactccagcctgggcagcagggtaagaccccgtctccaagaaaaaaataaaaataaaagtgtcacagagtacccagtacaacaaaggagcaaaaattctaaaaataaataaataaataaaaatggagcaagaatgaaaatacaataattatagtggcagagctgtgaacaatatttgtgtacacataaacaatgaatatagatttaactaaaactggtgatatgaattagaatgtactgggggtgagagaggttttcgagatcctatattaggtagataatttctaaaatggaattagtcagaacataaaaagtataaacattcaaaaatatatagccaaacaccagaagaaacagcttaaaacattaaaaatggttgccttggaggtggaggggaaagagggacaaaggaaactgctgtgtttttttaaaaataaaacttgtagttattatttgactttgaaaactacattcatatattgcttctaaaatgtttttaaagttaatttttaaaggtaagaaaacaaataagatattgtataattttccattaaaaatgattataaacaaacttttggagtctctcttcagtcaagtggaagtccttattctataacaacatctgaaaagtacctgtactcctacaatacatacttaagaaatgtatgttttattaattaccttggtgtcattgttttttaaagccttttctccttcattcaatttaacacacacatgcttgttataaaaaagttgaaaaattgcctagtcttatttgcaactttatataggaggagtttctagggttattaatacagtgcacatatatgcccatccttgcatttctttttgctttatggaagcacccaaagaattaatcataatgcataaaatacaaccaatcaatgaaacctgctttccagggtggagagcactgttactaccatggaagcatcagaggcgtcaaagactccaaggtggctctgtcaacctgcaatggacttcagtaagtgggaatctcattggcattttattcattgaccctttccagtttcccttttatggatatatatattttagtgactcttccgtgccagtgctgtgttagggactgcatgtggagtggtgcacaaggagggcaatgtccctgtcctcttgaacacttagtgtttgcaggagattcagagattaaccaaatgattacatagatgaatgtttaatcaccattgtgttaagagctgtaaaggggaaggacagatgcttgtggagtggcaaaacctagtccaggaaggtttcccagcggcatattccagaggacatatcagttagacctacagctagacttgagagtcagtaggccttagatctaagaaacttagacctaacagtaagttggagttagccaggcaagggtggggtgacaaagagaggggttcgcacattgacctaggggtgggctctaacaaaaccatgtgttggcaccttttagacctggacacagtagcacctcatataaagacttagtttcggccatgtgacgacaaagaatcttgaaacttttcgcccttttataaaaaaccttatgtccctgaaaattaaatgtaatttgtatgacatagagtcatactgcttgatggcagttcagaatttataagcgtaaagataccactgtttgcttcttcagaaccagatggttttagattattctcatatataaagaatctgttttcttacagatgatattgaatttgcataattagaaatttgtatagttgtacatggttctggaataattactttagagactgccactgagtgaatagtcctatctcagagtaattttctaatctgtctgttgaatttcaaacatcagttatatcaggtataatttgcatgcatttgatgtatacttttataatttttatagcctccatgctgcctaatagagtgctggggccacactgggactccatgcagatatgtgaattaaacttgtgacagtgtaaagggatttgttcagttatactctttattttgaagacacaataatgaagctcacttgctatttcttgccatttcctgtgtttgtttattccctcctttgtgtggtttcttttgtgctagtggcatgtttgaagatgataccttcgtgtatatgatagagccactagagctggttcatgatgaggtgagtctatgccatcagttgcctgatggcgttctactcctccagcaactttgtctttgagaagaaaagagaaaagagtgtagatttcaaagtgcctttgtacatgttaacttatttcaaacttagagtagtaccctgagttttgaagttttaagttgcacatgccaggcccatgtacccgtaaaggatagtaaaagacatcaaacataggttttctgaagcaaatcctagtccttcccagtctatgaaaagagcagagaggatattttgttttgtattagccagcctccttactttaaactagctttcatagaagtcattatatgaaaaagatacttgcacacacacatttatagcagcacaatttgcaattgcagaaatatggaaccagcctaaatgtccatcaatcagcaagtagataagtaaaatgtgatacacacacacacacacacacgcacacgcaccatggaatactactcagccataaaaaggaatgaaataatggcattcacagcaacctggatggaattggagactattactataagtgaagtaactcaggagtggaaaaccaaacattgtgtgttctcattcatatgtggaagctaagccatgaggacacaaaggcataagaatgatacattggactttggaggctcgggaaagtggaaggtggtgagtgataaaacacattgggtacagtgtacactacttgggtgatgggtgcacctaaatctcagaaatcaccactaaagaacttattcatgtaacccaacaccacctgttccccaaaaacctattgaaattagaaaaaaaaacagctttcattcttactgtcatctttagacaattgtgtgactataagaatgtacttaacttttatgaacctgaaaatctttagtggggaaatctgtgggctgaactatgattatattataaaatacttagttttctttacagatagggaagaaaataatgtttagagtcatgcacaaaccagtgatttagacaagaaatcacatgctctaatagtgttgcttgctaatagaatgcaatcaaatttaaaatttgacatatattcagtaaatattgtattgagggcttactacaagctgggtattattttaggttctggggatactttggtgacaaaatagacagagattgagccaaatggggcttacagtctacagaggcagatagagatacacagaatgaataagtaattacatgtggtatgttagatagtgatacatggtaaggagaaaaagtgaagccaggagagtggagagttaaatttttttttttttttttttgagatagtctcgctctttcgcctaggctggagtgcagtggcactatcttggctcactgcaagctccgcctgctgggttcacgccattctcctgcctcagcctcccaagtagctgggactacaggtgcccgccaccgcacccagctaattttttgtatttttagtagagacgggatttcaccgtgttagccaggatggagttaaattttttatacatacacagttccgggaagtccaccaagagaagacaagtggtgaatgaagcacttaaggaaattagagagctggaagaacattctagaagatgagcaaatacaaaggccttgaggcaggagtgtgcctagggtgttcgaggagctttgaggaacctgacagggttggagaggagtgaacaaggggaagaatgggaggagattaaggcactgagaggtaacagtacagaagtcagatcagtgaaaagaactgtagcgggaaaataatattttgtgagtgatagagttagattattgcagttatttgatggggaacagaaaacattttttatctttagggatttcaaatttagataaaattgggctgggcgtggtagctcacgcctataatcctagcactttgggaggctgaggtgcgcagatcacgaggtcaggagtttgagaccagcccagccaatatggtgaaaccctgtctccactaaaaatacaaaaattagctgggcgtggtgacgggagcctgtaatcccagctagtggggaggctgaggcagaagaatcgcttgaacctgggaggcagaggttacagcgagccaagattgcacctttgcactccagcctgggcgacagagcgagactccatctcaataaataaattaattaattaattaattttgaaacagctaacagttagataggctactgataataaaagctgaacagacaaacttttattgtcttggttatggcgatgtatgtatgaatatggggtaaatttcaaagttgatgcagaaaagttttaaagggttggtgtttgaataaacctctgtcattttcaactagtaactataaaaattatcaggtaatgaagacagcccacttagataaagacattttgattaagtaaaatgttatttatctcactccagtaaggaaagataatctgtgtacagcaaaattattcgactcattcagcaaaaactctgactttgatttctggctttgattaatggccctggtaccctaacaaaatccacaaagaacaaaacacagattcccaaataataactatttaagccttagagttttttaaatgtataaaatgagataatttttaatgcattcatagtagggcaattttgtagatttgatgaattaataaatgtaggtgacaatgtctattaaactgtcataaggatttataaatataaactattgttataatgtttaaagcattggttttgcattgtttacttgtgatcatattattcagggcctgattgttacatgcaaattgccttctctttgccttccttcctgttgcctaccttttggttatgtaatgatttgtcctcatccacactatgggtagaggaaaggaatagtgctttaaactttagtcgattttttaaattgtgttgctgatcccattgttaatttcattactatcttttcaccttttaccagaatttagagcttactgtaattaattttagatattttgatgtttgttgttagatattattgattttagtatgctttgcgataagtcaagtaatacgcatgggatatttctaatgagaattcatgttatctctcaagtaataaatgaatagcaaaactgttataagttttatgtaacctattaagaagtttcttttttataactttttctgattataaaactaatataggaaatttggaaaagcaaaacaaatacttaaatagtaattttccattatcctgtcccccaaagataacttcttgtcatgtttcagaatatgttcttccagttttcaatgatatagtcccatatatttttaaaaatagattggatcattattttataagataattttaagacaatgatgtatctccctgagcctcaatatctttatttgtaaaatagggataaaccatgcactatatggcgtctttgtcaggactaaattaaataatgtgtacattaacagtacctgatacatactatgcactcagtaatggaagctaataggaataagaataatggtaatagacattcctaaaagcataatttctagggcaaaaaatgtaaatgttttcacgtttgttgatataccttactaaatttctctctcaaactatgctaccaatttcctcttgccagcaaggtgtgagagtgcttttggccttacaatggtaattaactatggatatcgtaatttttaaaacttcatcagttttatggcaaaagttggtgcttcattaaaaaaaatgcatgttgaaggaatatgaaagcattcggcatgtttttacatgtttattgactttttgtgtttcttgtgaatttcccatttatagctttaaagaaagctaagatttaagagtaaccagtaacactatgtttttatctaaactggggcaattagatgatactcttttatttaaaattaagatttcaataagacatacttttcacttttgatagctaaaaaactgacatataaatattcccattttaggaaggacattagagaaagttccaacactgtttcatagaggcttgttcacatcttgctttctaaattgcctacaattgttttgtttcagaaaagcacaggtcgaccacatataatccagaaaaccttggcaggacagtattctaagcaaatgaagaatctcagtaagttttaactaaaaatagcgattatattttatgtagtatgagcttttatctggtggagctcagtagatatgcaggcttgttggaagtggaattggtctgatatcaggggtgaacatcgtggatcagcactggaatgagtggtggctcttgtgtaaagaggcatggagagtcatttccagtgcagactaaaacatgaagactttgagtaaagctgccttgggaaccagaaagtgtggtcaaatttagtacagtgatttacagtgaggttcatcctgaaatcttcctggcagtttgctgctcttgagccagcttggattgcctccctctcatgctctgctccagacacatcttaagtgtgctaatgttggaagaagcttctttttgattgttggggcatgtgattttatttctgtatattactgctaaaagtctttaataatttatgcaaaagctaatgccatacattattttgaatgctaaaatgaattagacatagtagaactctgtcaaattttcagatattgtcaagtggttttatatcaaatatgcatcttctaatgaatcttgaacattatgttttcttgatgtttgggacaaaattacatttgaactatctttgtggtcatgagagtgtgaaatatataatgatcagtgtgctttttttcaccttagtttgacatatattatcagtgccactgtttcttcatgtaatattttaaaacatactcccattgaaataagcataaaattttgatactaatttttcctttctgcagctatggaaagaggtgaccagtggccctttctctctgaattacagtggttgaaaagaaggaagagagcagtgaatgtgagtgtggcattgagccttgggtgggcctattttactcaatgaagtcatgtgcctatcaccccacattatctaagtgtacctaaaacagttcagattttggggactgttgtttaaaaatgaaaacaataaacaaaaaaccctatgatttgagccttaacacactgctttttattgatctctttctgttagtgattcaaactgattacggtagtctctgaaccctgacgtcatctaaagaacgtgttgttttagctctgttttctacgtgttttctgatgataattgcagtgcgttttattttctatttaaagtacagcagacttttctttctatatggcttatatagtgtcatataaaacatttctgttaataaaaaatctagagagaggagttaggttttgaaatgttggctaatcatacatatttatattactttcagattaaaaactctgttacaccaaactttaaagctgtatgtgtttttcagaacacaatgaatttatttgactattagcaatataacagtttctaaataaaaatcatgtaattgtataatcaactactgttatatacttcacatgtattgataaacgtataggggctttgtaattgaaattatgtttctggtcttttcataataggctagaaagctgtaatgatggggactgtttagtaattacatggtgaatgctatgtaactgagaattaattccacagcttatacattacatggtaatttactagataacttaatgagtaactatagtagaaattgcacattttagataatgttttgctgagtgtattttttttgtgaaaaaaatagaccaccagccatcaaaaacttagttccagtttaaattttcctcccttttatgaaactcttatgataattatggatacatttattatatattatataaattattattagatctcttttagctcattcataaagatgtggttggtaataatatgttttacaatggctgctgttctttccctacagtccacctcatcaaatataaagtgatcaatgactatgtacataaagaaaaaagagccactattataattttccaactatgaaaaagaaataaaagtccaaatgaaggctaaaatacttactcttaaagaattatctagttaatttagaagactttagactgtaataattgccaatattttttcctttgagaaattgagcagttaagaattagcatattatttttagaatttcactcgagtgagttaatgtttctatttaactacattgatatctgtatcagatatatctggaagtaattataacttatgctattcttattaaatgagttttacatagattttcattgacgttttaagtaaatatgaatattttatcacattttaatgtgaaattgagatttatttattttaacataattatgctataatttttctctagaatatttttacatataaaaaccatatacaacaacatggactgttttctatgttgataagtaagtaccttaataataataaaatacagttattttctaaatacttgaatatgtacccatattttatgatcactttttaaaatttgcctgaccaactttcttctaaggtgtttataaagtaggcagcagagagttgttctgaaattcaaagtcttatctacaacttaacagtgagcactagagagattttatgtcaatcactattctgaccatatatttttattttccgtagccatcacgtggtatatttgaagaaatgaaatatttggaacttatgattgttaatgatcacaaaacggtaagaatatagagtcagtgggttttagaacagatagcttacttaagaaagaatacattttactttatagttaatcattattttttacttattaaccccaagatattcagacatattaagtgacttgatttatttgtcggtgtttggagactctgagttttatagaattttcacaactctaaactttccttacatttaataattataattaatagatttagctatctggcatcttttgtcttcatttaaaattcttattctctacttttcttcatctatgtatttggtcactgctttctaattttattccgtgcttttgtcctgctaatatgttattttttcttactagttaattatgcttatggtagatacaattgtaggaggcaaacatataaaataaaggtttatctaaagtgaatatctttgatgacttatcgtcttttttttttttttttttgtgagacggagtctcgctctgtcgcccagcctggagtacagtggcgcgatctcggctcactgcaagctccgcctcccgggttcacgctattctcctgcctcagcctcccgagtagctgggactacaggcgcccgccactacgcccggctaattttttgtatttttagtagagacggggtttcaccgccttagcgaggatggtctcgatctcctgacctcgtgatccgcctgcctcggcctcccaaagtgctgggattacaggcgtgagccaccgcgcccggcgacttatcgtctttaaatattggaaagatgaataatctcgtgttaacttctgtggcagtaaaatgtgattgaatatgtcatttcagtaacacttaaaagatatatgaaaaacattcattgttcctcattttcccctcttgaagatacaatagaaactccgttaactatacttaaccgtttcctttataaaattacttgcctgaagcccagaagagtcttggtcagtaggctatatactagtacacccaatactagtggtgtgctggtaaattttaatacctagctctcttgatttataatgtttgctgatatctgtggtgtaaatattgccaccatagctgatttcaagctatcaaagtgagatcactgatgaggagttaggagaggatgtatctagttggctctcgggatctgatgggagctggctccagcaaccactgccacactccccagactgtttaggccaattgtaatctctgttgtagttatgtgattgaactttaaaagttgtaaactctaaggcaaaaagtacttgttttatcaaaacaaagttgcacttctgaaaagactttatatagatgagaatcttttaaaaaatgcatagaaatcaggtattggtgacaaacttatgaaagattggaacaaaaattgaaattgctttggaattatctttaagtctttgttttactttaaggaaaccaaaattagattagtacatggtatgataaggttgtgcttcatgctaaaatgatgtgaaattctaattagctggccctactcagagaatgccttgaaactagaaatttaaaaaaatagtgacttaatttatatttaaacttttaagtttctactttaatggatgttttccattaactatcagtttaattgtgttgaatatcaatagaatacctcttacttttgtatacacatttattttctgttccagttgcctttaaatatattgcttgagatgttagtaagaagcaaaatttatcagaacacatataatttaagagaggtcctttttggtggaaaggaaagccagatgtgtaggcagtcattttagacagtaaaggctaaaatatgagtttctgaaggactttaatttgcttgaaaccccaagatagtttttttatctgaattatttttgttgattggaacattgagattttttttcccagctgattctcaatcttgagcattgtggcatgttgtgaaattatggcttttgaagcctaagcttttttcaacatccattatataaatacttttagagtagtagaaataataattaagatatattcaatgtctttgaatgcacaaagtgcattctcaaatagctgttaatctatagaatctgttctcaaacctttacttgcaattccaaatctcttgttctaccataatatatcaggaaagtacatgaagctatcaatcaaaagagcaaatctcagtaactgtgcaaaataggaaacagttactactaagtgttaattacaattaaacagttatagttttttggtaattgttaaaacagcatattttttgaatttattttttaacccttctcaatggtaaacatttaaataaccttattcttatgaataataaaatagcatacttcttaaaatattattttatatgtagaaaatttctacacaccatgtcacatgttctgtgatagagttccttatttaggctatcaaatcttttaagggtaaattttaataattcattttattattgttgttagtattattattattattgttattattttgagataggttctcactctgtcacccaggctggagtacagtgatccaatctcatctcggcgcaacctgcgcctccgcagctcaagtgatcctcccatttcagcctcccgagtagctgggactataggtgcatatgaccatgcctggctattttttgtatttttttttttgtagaaactgggtttcgccatattgcctaggctggtgttgagctcctggactcaagtgatctgtctgcttcaacctccgaaagtgctggaattgctggcgtgaaccaccatgcctggcctattattactattattaaaatgggtgagaagtaggtatgatatggtcatcagtttttgaaacaaggaaaaagaattgtaatttgtactgataaatttagagggaatcgatgtttaaaaaggaaaaaaaggccgcgtgtggtggctcacgcctataatcgcagcactttgggagtccaaggcgtgtggatcacttgaggtaaggagttcgagaccagcctggccaacatggtgaaaccccatttctactaaaatataaatatatatatacacacacacacatatacatacacatatacatatacaaaaaaaattaaaaaattagccggaggtggtgacatttacctgtaatctcagctacttgggaggctgagacaggagaattgattgaacccgggaggtggaggttgcactgagccaagattgcaccactgcactccagcctgggcgacagagtgagactccgtctcaaaaaagaggaaagcttttatttttgagtggtaataatgcctaaaatagaaattgcctaagatttctactatttaaagaaatagtacttcttggctaatagaactaaatatattccttttgctttaagacagagttacattctaatccataatagtcccaaatacgtatgacattttataagaattttttttttgagagctgaaaaaaattttttgaggtatgctttctatgagatgaaggttgtttttaaatttgattgccacttcagtagtatatcagaacttactggatcaaagtacttaaattcacatgttgaaagtcaaactgaactagaataattaatacatttatttctgaatatgtggggatttgctgctgggctttaggataatcatctcactgagagtactcatcttacaatctttatactatacgatccagaatagttattttgataattctcaccttcgggttgaaaaaccaaattctaatcttattttttttcaaaagacagttttcttaaggattgcatgtgttcaggaaggaaaagcaaccattttaaataaagattgttttaaactgatcagaaatgtgaaagtaagttttgttataaatggtgattgcatatttttctttatatgcaaaattagttctaattcatgcaggaaatagaaacattctgcctacatttgcattcaagcttatccctttaattcagagtgatttaacgttggctgcctgaaaaaaatgcagatatcttattttcaataggtatcacattatcagtggctttccattagaaaagaaaaatccctcaatttggtaaaaagtatcttagtacctggctggtggaacctcatttgcaagccaattatagccttgataagagtctgcaaacatgtctttgagctgcttaagttaaaaataaatattaaaaatcttattctaatagaaaattggttgagattttttaaagtgcataaagtgcatgaaaagcaaatgttttgcgtacgtgttttgctacatacttaactatgcgtcaataaatgtaaatatgtgaggataatttaaatatttttcaatttaaacctcacttggttttccttacttaaaaaccactacattttatatacacctaacaaattttgagttttcattaataatcatgatttgttaggaatatatataaactatttaataggaattgttaactgaaccagcttacctcctccctcaacctagagactagaaggatttaaattctagctgtgtgatcttgagtaagttatttggggataataaaacccacctcatagagttgtgaggagcaaatatttgttttaggcgaaacacttacagtttctactaaaccctaggtgtccaattaaatggcacttcaagttaacaaatctagtggtcattgttctgtccttgtcttactctctcagcaatattggacacagttgattaccctctttttttgaaaattttatttcatctcttggcttctatgacgtggtagctctctcacctcactggctatttcttcctagtctttaaaatctgacctctggaattatgtgagtgccgcagggcttggttcagggctcttttctctttgtatactctctacctaagtaacaacttgcagcctcaagtctttaagtgggatcatgactttaaactcgttattccctacttttagctctagccccttaagttctgtgctcatatacagaactgcctatttgatatctctattttagtgttgatttgaatagaacttctgaatcagaactcttagttccctagtcctaaacttctcttcttctagtctctcttattattttaagtggcaccacaatcccccatccattcaagttcaaaacctaggagttatcttttaattcttctctttcctcaccttccacatcctatacatcatccagtcgtgggagctctaccctcgtagtggtacttgaattcacttctctctacagttgtttagcctccattatctcttacctggactattgcagtagcttcccaacaggtatctctgtttccattcttggcactctctaatttacataacaatgacaggcaaaataatttttctaaaaagaaaatcagaggattgaaaattacaaatatgaaataaatttaaaacattacattttgatagacttttaaaatacctcattttattaatttttaaaacttgaaatgttttaaaacttgtcatgttttccgtgatcattatgctataaaaagaaatctcaataaaataacaaattaatactcagaagcaaactaaaattcatcttaataggtgtgtaacaccactgcattagaagaatagatatcagctaatgttttctctttcaatccacaattcagtggaactagaacattttcatcatcccagaggaacttaatgttaatatttttccttttactcttaagtgtatcttggaaagttttcagcttgtggaatttgctaggcaacttaaaatgctgagctatctatagaaacttctttatgccaagtttacaaaatgtgttataatgcctgaataatttcagattaataggatgttttatgacccagttatatgcacacattacagtttactttaaaagaacacaaatatagacagtttgggtcagattatgatgtacagtagtggcaataacatgaacagtaatagtaatattataccaacagttatgtattcatgaatactataataatagcagaatattaatttatttagcatttattatgggtaatcagtgtttttgttgttataaaaaataaacattagatatgtaaacattgagatatatattctttgtttaaaaaacatagtcacagatagaatgaaatgaagggaatctgacaaaagttatatatagggtgcgaatgggcaaaggacaaataaaagaattttctaatgtagaaatattttgaatctttatgaaagatgcattattttcataattataattgaaggtaaatttcaaagacttgtgcaaatctgagtctgtggttttaagtaggttttgttttccttagtgttgtagaaataataacctcatggaccagtagagggcatgattttcctatggtagaccagttttcaaatgtcctcttgaagacattaagcaaagcgtactactccttgctaaaaacgtagccctccagatgtcattgtagaattactctattaatttacttttctttatttcttaaataaacataaacaatcataaactctcagcacacttcatttttactttttgtcttctctttgttttgactttgagcagtcaaaagcaaatggcttcatttggaggaggcattcctctgaaaggatatactaaatgcctggcaaatgctgtccatatcatggacagtatctaaagcactgacaaagacattttcttgatctgtgcgtggccttgaatttaaagtgagacaagtgggttaagccgtttgtataagctacaaaatgtcatttcaatgaaaacaaaaggattgaatttgtagacattaagactaaatttaaaacttactttttaggtataaagcttctcatatcgatttctataggtccttactattattcagaacatcgtaggtttttttgtttttttttgaaaaaaattttgtaaagacaggatctcactgtgttgcttaggctggtctcaaatccctggcctcaagcagtcctccagcctccacctgccaaagtgttgggattacagttgtgagccatgctgcccagctaacatcatgttttagatagtcagagttttgccacctaacagagaagtaacaccaccaaatccagtataccacaaactaaattatatatttttaaatccatatttctactattactgagatatttctgcttttacagcattttgaaatttattattcacttatgatttggcagtgactggtatgtatttcccccctagtataagaagcatcgctcttctcatgcacataccaacaactttgcaaagtccgtggtcaaccttgtggattctgtaagtatcctggttttcttgaatttgtgtgccaagatggaatggtttatctctatttgcttacttgtactttaggtatttcttgaacaaatttaaaaacacaatcctgaagctcatctggctaaggaattataggatggtccgcttcacagagtagtgctctgagagtttcagatgactgagttattcccggaatcccaaagatacattagtgttgcttctaagttgcgtctatacattattgcccccagtctgtggaggacaaaaacagtggagaaatagctaccaaaatctatttgctattatactggcaaatgagactttttaaagaaacaactgggcttttcttaaatatatggtggtaacagagaagaaaaaatggattgaagcagagtatgtttggagaatataggtaataccaaaaaaaatttttttaaggacacaaatatattttcttagtgttcccattggtgtgatatttcatacttgatttctagatgatggaaataagtgcagtccccaaataaaactaatttggaagaataaaatatgtatctccttacaaagacttctaactgtacaaatcttcaatattgatatgttttcctcacttattttgtgaattacagaaaatgcttaagattttctgcctttttcctgccttaggttagaactctatagatatgaacattatatattatgttccaatgaatatttaagttgactagtcagaaattaaatatagaatattactccatatgttgtaatgtaaagtgctattttgcttagctaaatatatttttatcgggtattttattgtgtgttccttcttaaatgcgaaaaaaaccccaccattttttataagttgccaaatatctaaatgatacttatttactccaaagagctgccttcttttctgccttttaagcagtccacaaacctccaatcatgtaaatattcataacatatgtatgttatgtacctggtgggcacagctgcacaaaactataacatgagtggatgtgcgtcgagtatctcatatagagttaggatagcatctcagtgccaatttacacctggtttattaattttctttaatttcagctcttgtttatcttctcagaggaaaaccacaagtgaatgtggaaaagagaatcttaaccacatcttttcctctgcaaaagctgtttacttggtagcatctctgaattagtcatttcaacatgattgaatagagttacatcatgcaaagtgtaatttttattttgggttaccacataaggttctgaagctgaccactaatttttaaaagacattacatttaacttgtttttgttgtaaagtcattatataatagcttcaatttgatttaggcataatggtgttccccttcttcagtgtgttcaaagatcatccattggtgtttgtttgtttgtttgtttgtttgtttgtttgtttttctttgagacagagtcttgctctgttgcccaggctggagtgcagtggcacgatctcagctcactgcaagctccgcctcccaggttcacgccattctcctgcctcagcctcccgagtagctgggactacaggcgcccaccatcacacttggctaattttttgtatttttagtagagacggggtttcaccgtgttagccaggatggtcttgatctcctgaccctgtgaagcacccgcctcggccttccaaagtgctgggattacaggcgtgagctaccgcgcctggcccattgttttcttaattagtttgaaaacagggcaaaatgacagcattcattgaagttgcttaattgtgtgaattgtttagctactgggccaaaaatagagagagagcagaaagggaacaatttaaatattgtgggtgatgccacccagtggtgaggatgagatgagtgatagggatctgctcttttttagcctcagatccttgagtctctctctctcccaatgttattttacttttcatataatatgacctccaagggtaagccagctatattgtttggtgcttatctggagatttagtgattcattccaatccagcaggaataaattgttgcactgcggttactcagaactggtatatcaggctccaacctgttacctgctatgagatttgaaagggtgattttactgaacgatgttttaaatttatgccctggctttggaatccttactgtctctccctaggacagtgaatgtattgctctgggatcgaaataaccctataggagagttgaaaccaaattgtgtgattgttctttctttatttttgctcttggaaaaaagaaaggaaaagaagattctctataatgggctaattatgaccccgtgttctctcacctcccccttcctgtccttccactgactctgactcactgatcgtgcatgtttgacccagtgttttcctcctgcacctgtcctgttgtataccctcagatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgtacgtactcatttcagcctttagtgtagtctttggtctgacatttatccttatcccttttttggttcagttaagttaaatatcagaaaatagtgacttgaacaagatttctgtgggttcctttgtctgttagataagaagcatggagttaggatatcccatgctgggatgctgatggttctgtagtcacaatatctacctttagagcccataacttccatcctcaagatcaactcacaatctaggatgcctgctggccctccagccttcattactggcagcgggcatgacatgtggggagaagggcaaaagggtactccttccagccgagctgactgctgtaaagcaggtttcctgaaagcttgcacatgtatgtttcatgaacaaatcatttgctaggtgttagtcacatgggccacacctagctacaagagaggctagcaaaatgtagtccttttagatgaactattcagttgagtttctactactaaggaaaaagggttctatactttctttttaatataataagctattctcttccccagtcatggcaaagctattttcagatagtcctctaaggttctgtcctggaatcaaaccaaccaaaccactccttcttttcctcccaccattaccgttgacttcctgttttttcagtctttaatcagcaatttttaataatcagcaatattaattctttttaatcactgctagatattctctactagaaaaaagtcaagagctgtgtctgtttatcttggtgttttcaattcctgtgctagtacatgatgcttagtaggtacttggtgcttgctcaattgaaattacgtaacataacaaatttaaaggtaattatgtcataaattttaaggtagttgaaataaagtttttgatttcttggaggaggatggtttgggggtgttccatgtaggagggtagacatattttgggagagtatgaaatgatggtccaccacgttggttttctgatagcactgctttttcttaaggcgggtgacatttcactataagagaagcagtctgagttactttggaggtgtctgttctcgcacaagaggagttggtgtgaatgaggtaaattttaccaattagagtttcatctttgcatctgttctcttttttccctatggcccagtttacatcctttctcgtgcttgtttagaatgatgacatggcaaatgtagcatgagtggcttatgttattaataaatagaacccaacgtggtccttttggttcatagtgacatattttggtgtcataatgacaatttttcgtatatatcaggcaaatgcagctgaagattggcctggagacttttaggcctctatagataagatgttaagcttttataagcttattaatccttctctgactttttttttgttataatgctcctctgtctatgttaaatttaactcattaaaatcaaaggatttctgatatcagtactgtatgtttttttctccctatgtatatattttcattttcatgccttctacctacctatctgtagaatgaactcaaacacctatttccttaatctcattgttcagattttaatactttcagttttataaaggaaattcttaattggtaacagcacccaaaaagcataaccaattatatctaaactcttgtcaatactgaaatatattataccaggttatctcaatagcctacaattagcctggaataatattggagtatattataccaggttatcccagttgcccatttagtaggtacctctcttgacatattttagtaagttaaatttattcttagtttggtataagttgaattggagcacagccttttgtgacttgtattttatgtttcaatgtgagagcttcaaattctgagagatatcacatagtaagaggggctttctgcttcttgggcccagttgtaaagaggaggtgagaagtagcatatgccatcttaagatactgacaggctctacttagggaactgagaagatttgtggtaacaattaagaaataataactagctttgtgcactctctcaaatgtctcccacacactttcaactctgaaaaacagtatggtcttccaatggcagtggcacaagtattatcgcagagcctggctcaaaaccttggaatccaatgggaaccttctagcagaaagccaagtatgtacactgaccttcttactcattttcatgtgccattctgtctgtataatgcatgtccagtcaataaataaatatttttcattccagtcattatagtttaattgtagtatatctccttcctctaaaatatttagaaaataagcaacttaaggtaatttttaatctgtttaggttgtaaaaatttccctttcaaaatccataaaatcatacccagtttctccgggaatgagtcagctctttctcacactgcagaatgtggggctgggggcagggaatactctcacactcagggttctagcagctgagcagacgtacaaggtgctagataaagcctccatcacaagcttagtgagatcacagttggattgggaaatagcttagatctagagtcaaagagagctcatctttaaactctaatgaaatttacccacctagtctcatcagaaaagttggagaaaaaggctttgcaagggaagaccctgccccagggccttttaagcatgggaacaggtggtagaggataggattctcctctagtggcccaggcaggtccaaaaaggagaaccaatagggccacacatcccatcagtaaaaaacatagccagtgactgttaggcgtcattttttcgttaatcagatgagaggtagatagaaagacagggctaattttctagtgggcaaagggtctagggctcacagtaatctgaagggtccatgaaaaatgttaatttcttttaaaatcagaataaaagtcaacccagattgtgtttatctttatacaaacccagtggtaaaatataatttttaatacatttttatgacagtgggcaacgacctaatgcaatccggtggaaagagagaccaaagtgttcattcatattattcacttaactagaaattagatgaaagtgccttcctattttttgaaaatatgagacactgggagtaaaggtctcacttaccaccccaacctccctagagaagaaaaggaaaaatctaccttaatatcattctatattttatattctttttttcattaatgcataatattgtggaaaattgaaacaaattatatttacacaggcttctcaattccctttatgggtacattaagatagtcatcacaagtgtctggtggcatttcacaaacctccgcaaacttccattgattatcttgctcagagtgtttgctctcccaggaaacacctagtacacattaaaggaagtgtttagagtttcaccatctggcataaacaccttaaaaccagaaaggtgtatgaccaggtttatgcccttgtttagaaatcttgaatctgggaggaggccagtgctagagtcagctgagaggtgttactgagttgcatgatggaatagggtgagaagtagacttcattactaatgcctgccatcgttccctccttcctaaaattctttttttttttttgagaatgagtctcactctgtctcccaggctggagtgcagtggcacgatctcggctcactgcaacctccacctcctgggttcatgccattctcctgcctcagcctcccgagtagccaggactacaggtgcccaccaccacacccggctaatttttttgtatttttagtagagatggggtttcactgtgttagccagtatggtctcgatctcctgacctcatgatctgcccacctcggcctcccatagtgctgggattacaggtgtgagccactgcgcccggcctaaaattctttatttctttgtgacttgtttgtttaggtagctatttcattggttctaaactttgagtttaaaaaatccatttggaagtctatctttgcatatacctctctctctctatataggtatatatagatagatgtatacctctctctatatatatacgttgatatatattgctctctctatcgatatatcgatagagagagaggcatagaaaagagaaacaggaaaaaattaatgaagagaagagcccatcacaatatcaatatgtcagtttctggtatcgaagttaagttgtaattgtttttaagtgattatgtacacttctgttttagattgctctctttcactaaaccttttagcatagtgttcattcaagtctcttgctcatcctcacttcaactctaacaaattgaattctcttctctaacttcgagcattctctgttagaaaacttcagtgatgatatgttgtgtttgtgcaacagagctttaaaattcacagcacataggtacaccgtctagtgtgaaccccacaaccactctgggagatagacaaaaaggtgttattcccatttagaggtagaaacactgagacccaggaaatgctaagttacttgcctatgggactctctcatatgacagatcttggactagaactcaggctgtctgatttgtagaccagggtacttttcactaaacattagaactaggaaccaaattgagttgtcagagttacaaaaataatgaagagaggcacaatattacttcttgccagctgttttcttaggaattaacctataattctggaaaggataaggaactattgatttaaaagaaattttgttctgtaagacttcacattccgtgtctatttgactgacatggaattggtaataaagaattattgtaggagttgtaataccaaaaaaatatgtgactttctttgtttcctttttcttctgttgcttttattgttttattggaccagaatgtgactgcacagaatcctggggtggctgcatcatggaggaaacagggtaaattttcattatgcgtgcatttgatatatgccttttgctaaaattgctgtgtagagttagaaacaaggtctctcgggtattggtcttttaggctaagcacaatataaaatgaataattaattgtctgatatttttaaactgaaagatctaatttactttgtattttaattttttatttaaggttggtgataaaagtaaaatgtattaccttctacttcttattaacccttaaaggaagcacatgattaaaggcttctaagtttagtggaggcattaattttttagtacacttagattaaaagttggttatctacctgaagcagtcagtgaaaatcaatttagtcatcaatttacattttaaggaactcgtaaatatatatgtttacggtaataaaaattaaactttactgtttataaatcaataaagctttttaaaaattaagacagacttattgtatctaaatcaggtagtcttctagtgatagacatttgaacattccctcacttttcttttgtgaatactttgggaactagagcagcttccccagagctgctgttgcttcagtgaaccaaggcctggaaatattgccctctttcacagggacccctgcctcatgggagccactgcccccagaccccctaagccataacccactcctagtagaggggagaggtttcctcacccatgtgcctcttttgctttctttgccatgccagacacctgctcaacacaccaaccatttctggtcctacctccgtccctctggttgccagaggccctgacctacttggacagagctcctttgttttcttccaccagccctcctaggagtccaactcctggggaggagtgtgggcatgaaggtttgcacagtaggccattatccctgctactttagaacgcatttctagaaatagagtttaaaacgtgaaacccttagcttccacggttccctattactccatagcttagtaatttatggcttaaccaggctttttgaggactactataagaagataacacctataatattggttctatagggagatgtcttctgtcttctaaattaatctctgaagtttttacaatgactcttcataatatatataacatataatatctttaatatattttatataataaaatatataaaatgttttaaataagataaaatgttttaaagttaacatgtattttctcaagaatacatttctatatatttttctaagaggttcctatcaacagtggcaggtttcacctacttctgtaaactaccttcatacatcagaatgcataaaattattgaattacttcctagaataagtggcctgtcactcgcaagtcaagcactgttataatcacgcactgtattcctgaggaataggtgtgcgtgtgtgtgattcagtttaactaaccatgtgtataatattcccctgtgttctgacatagagatattatatttgattaagtaattcacagaaaggctcattttctattcctgattaataatgaatatcaccaaatagtatttgaaattgagaataaagagccattattcatggaagcgtaccccaattctattgtcactgtgcatatacatactaaaaacatacgtgcatatacatatatgatctaacacacctctttaaggtttccttgtttacctgaatgcattgttggcctgcatgatatagtctttaatatactggccctcacaactctctcctccaatgtaaaatctagtacgttcatgagctccttttattcagaaaacagaggcaaaaaaaaaaatgcttgactttaatgagatatagcaaataaaaattaacaaactttaaaatacagcctatttgaagaggttttgtaatgagctttttaaaaaacatttcaagcctggtcacaaaagggcttgactgctgaggaggttgtaatgtagcccccaaatctttgattttctttgaaattccatctctgcaaactccaccacaggtacttaagtggcaatttgaacataagtcccttgtcaaaatttgtgtagattcatttggattcaaagtgaacattttgttctaatttaggggttttaattttcttctctgatgattgcttttggtaaattatttacatagttgattctttgtttcctcagggtgtcccattctcgaaaattttcaaagtgcagcattttggagtatagagactttttacagagaggaggtggagcctgccttttcaacaggccaacaaaggttagtaacttagaaagcatactaagaaagtatattatttctccagtgttttacagtgcaacagtgctggatatcagacgcctgtcttggaaagcaggtttcttgtcaatcagattaatatttagttataaaagtccttatcatgttaaagattgagtcctgtttaaatgaatgacaaaaccatagattcagcattctcagtctctggtgtttcagtgctagctagaactcccaaatcctcccttccaaagagcaaacaatccttcaattaaaatatctttgagattttcatgttaagatttttaccctgctgctaagagatggtgggttaaattaagataaaatattattttaactaatttctctgataaaaattccatttctccttgacattctttctagggacaagtattagtccattttcacactgctataaagatactacctcagactgggtaatttatagacaaaagagttttaattgactcacatttccacatggctagggaggcctcaggaaacttataatcatggtagaaggtaaaggggaagcaggcatcttcttcacaaggtggcaggagagagagaaagagtgcgaggaagtgccacagtttaaaactatcagctctagtgagactcactcactatcatgaggactgtatggggaaaccgcccccatgattcagtcaccttccaccaggtaggtccctccctcaacagtggagagtagaactcaagatgagatttgggtggggacacagagccaaaccatgcagggcctgactaatttcttgacttttgtttttttttgagtggtttgtcctcttgggacattagttccttatgaatatcagcgagccaaaaaatcacccaaggtatttatggataccataaatacacatacgtgtttataatgcattgtctctttacctggagagggccacattgtcaattggcatctcgtcaaactttgtgtatatagtgtcacaatcccttattcgtgtattcttaattcagaaaactgaaaattttcagaagtgttttttatgtttgtggaaaacacatttgacagtaaaacttgtcctaaactgaaaatatttatacctcataaggtaaatattcataagtcttgttgcagaaatattaactgattatagggtgtgtcccaggcccctcaggactattatatagaatatggtaaatgcatcgtacttctctaaacttcagcaaagctggaagtctcaaactcaccagcttcaaagcttttgcataaatcggggctgtagacctgcagtagcatgtttggaaatgaagttgctcagcaggcaaaagataggatcaatgctaattagcagatggtatggaaattctaacatggcaaatttcgtatttctttttaaaatactacttcatgagtcaaatatagctcattgctatgcaaaatgtttaatactttgcaaactgagagagcagcgaaataatgttaacctttttttttaaatcagtaactaatgtggtaactaacaggataatttattcctaaacccataattaagtgacactacgtagtcaggagatggtggcttgatgcctgacatctgtgtagaatcttagtatggctgtggaaaaaagaaacaggactttcaaagtgaccttgcgtcgtgaaagtcagttgcctgcctttcataacgttgatttcaatgcaacagaaatccaaaagcttcaaagtgttcaaaatgggtgaaataagtaataatgaactaatgtgagctgctggcatttttgaattgtaatgtacatggctaattttacccaccttgtagcttaggagctaattataagcatcatgcctgaggaaacaactctcacttgtttggaaaggttaaggtttctagcatatgcataaagatccatcaatggatttctgaaattgtctatgagttaggagaaaattattctaataacttggaaatgaaataaaaataactataaatcatctattttttaaaaagttagtaaatatggaattatgtctttttaaactacgtagtacaatggttaataaacaactatggatgccagtggaatagtttatatgtatgtatcaaagaagtgactttttcccccaagcgttttgaatgtatgtatatgcatgtgttgtgtgtgtattatttttacattatatgtgtgcatattttctgtgctttaggaatcttccccactgccatgttttccacactgttggagatagtgacccgtctcaggatggaggcagagtcctaagaaggaaagaagggggagcctggtataaagtgcaggccatgttctagtcagcccttcccttttccagtttctcctgcctcctgatcaaaataacacagagatgtgcaatgctgattttgctcataggacttttccacagggggagtcccacccaagtagcctggaaacctttgcttttcgtaatagttttgccttcctggaagtggaaggaggatcagttctttctcaggtgaatttagtggaaggcagcgcttccttgaggtgtgttcagctgctggagatggagtcagtttctccctctcatatttagggctcagagcatttgggttggagtgtgctgctccagccttcatttaaggtgtagtgattatgcccagagaaatcctgcccccctccccactgcccctggaatgggaagcaggcatgtttctcataaacagtcaactacctttacagttgctctataatatagtttatctggcaagcaagttcatggcaccagtagactagattattctagaaattatactcttctattgccctaggaatgactgagagatttctgtatatccatacatgtgtcttatgcttgcagacacttgagatttcttttcagtgagaatgatggtcttggatttctagcaacattttttcccctaagtttacttgcatttacttgattgtacatatcacatttggctatgactgaagcatatttatctttttgacagtttttatggcttctcagctgtcttgagacaagttagcaaattagatatctgtgagtcttattagcaatgcattttagctccattagcaaatatgaaaagtgatctattcctcttgacagcttgtctccatgaaaagtaactctaatgctagagttcatctgtggagcccacagccagagaatcccccaagagatattgccccatttcagatatatttttaagtactattaataagtgaacagtatttcccatacagtcatcatttataagatgccacaacaacagatcaaagaagaatatcacatgatagctgattatacggccattgtatgtggcccagttgatgtgctgattttctgtgataaattgaaacatttttcccttctgtccctaatctctttagctatttgagcccacggaatgtggaaatggatacgtggaagctggggaggagtgtgattgtggttttcatgtggtaggtataagaaaccttctatacttacagcacagatcttacttggtgcaaacaggtatagcatttgtgagaggccagcacattgattgtggtcttactgcctttctttctcatctctctgattagtgcttaattcaactcagacctgttggaatcagtcatgtccttatggccttgtctgagcaaacctaatagattcttctaattaaattccctacctcttaaaaatttatagctcatattcatctcagataagttttaccaaatcgtaaaacattctttccgtgttgtatattatttttatctttataaaatagattgggtattagaatgtagtggagctaattggaggagaattgcctgctaaaaattaagctttctcggccgggcgcggtggctgacgcctgtaatcccagcactttgggaggccgaggcgggcagatcacgaggtcaggagatagagaccatcctggctaacacggtgaaaccccgtctttactaaaaatacaaaaaattagccgggcgcggtggcgggcgcctgtagtcccagctactcgggaggctgaggcaggagaatggcatgaacccgggaggcggaggttgcagtgagccaagatagtgccactgcagtccggcctgtgtgaaagagcaagactccgtctcaaaaaaacaaaaaggaaaaaaaaaataaagctttctatttgctattgaagtcctttcatagaagatcttactttggtgacaagtatggcaggaaggaatctatccttgtttaaagtaattaattctttcccagaatatttgcttactgttgtataaatgttctcatttggaatatgcatgccacgtgtggagagaatatgaatgaccagcaggtaaggctcttcgcttactcacgtgaagtgttttctctaggaatgctatggattatgctgtaagaaatgttccctctccaacggggctcactgcagcgacgggccctgctgtaacaatacctcatgtcttgtgagttttctgacagtttcatctttcttttaattgacagattagccagatatctcagtgtgtacactgagcatttgtgtagcttgtcacaaatttcttgggtacagtgtacatattagcctggcagttttctaggatcgataaatctcaaattctgtgggccgcaacatttatctctactattattcactaccaaccatcttatcctccaatgcctcattaggaaaatatacctaaactgcttccaaaagagttgccctactaacatagatgaaatccaaattaaattgttgaatagaggggagacaatttctgtggtctttttaataatatgacctacttataacatttttcttcaaaacttaccctaatttattttagacctgaacataaaagctagtgctcatattttcccattgggcttttaaaatcccctgtaaaggcaagaaagtgagataggaaagtaacatatgaatgcacactcatatgtgtatatacatggtttgtgtgtgtgtgtggacagacacagtcttccatctacagagaccaccagttatttttgaaaactcattttaatcttcccttttctcatatatataacctctaatatttcttataaccatagaattacataattttatgattttgtttcaatattagggggtattatgcattatggtatttagaagtttctagcttatttctccttgcttcatgtccccaaccagattataaattgcttgagggcaatgggctctttccttcaccttttacccacaccctcctcaaataaaatgctttgtatacaaaaggcattccctggcattactaaaggtaattcgtatgaatttattaaaatttgattgtctgtgtttagcaaaagaaagtttaatatctatgctaataggtaattcagtgaaggttgggtatatatgtgaattcttcagagagatcttaaatgtttatattatagtgttttgctattttgtcttaagccaaaccagaatttcttctttaggtgatttccgtcacattgttttctgaaaatagtactctgaaacagtgggttttgaaatctgaacatttaaagctttggttgatgattcatctttagtgtagagggtagcatctgggtcttgtttctattctgcaataggatattctgtcttgctaattcttaaaaagagtttggtgttagttatgcgagagtataggcattgtcggtgagtctaagaatgttataataactctgaaatattatgtaatgctaactcttaatattgaattttgatttgcagtttcagccacgagggtatgaatgccgggatgctgtgaacgagtgtgatattactgaatattgtactggagactctggtcaggtatggcgcactgagtttttggtaatacattttacttgtacaggttgagtattccttaccacagtgcttggggccagaagtgtttcagatttaagattttttggattttggaatatttgcatattcataatgagatatcttggggatgggactcaagtctgaccatgaaagtcatggatgtttcatatacactttatacacatcgcctgaaggtaattttatgtaatattttaagtaattttgtgcattaaacaaagtttctgtacattgaaccattgaaccctcagaaagcaaagatatcactatctcagccacccatgtggacaatcagtggttgtttggcatcaccatcattcctgactctgaatctgtatgctaccaataggcaattactttcttgtacttattcacacctaattacttaacagtaaaaaaaaaaaaattggacatgcattaagacattgaaaaaataatatgttcaccaagcagcacagtaacatcacccagataactgtatcagctgttgaaaaatagcaacaatgaaaatggcaggctttcagtcaccacttatgatgccgtgttttaaacctttgaaaaggttactgtaggatgtattttactttttttttttttaagaaacatcagaagcagtagagggaccaggaagtgggtcctctacggataagggggcattctgctggatggctttttaaaatgtttcctccagagtcatctgcctcattaacagagtttttgcttagaagtctctctttgattttattaggttggtgcaaaagtaattgcggtttttgccattgcttttgatggcaaaatcaataattacttttgcaccaaccaaatataaactggcatgatttcttgttatgaatgcacactggctctcgttcttcacaaagcccgtcacacactttcaccatatgtccagaggcacttctgcagtgttaacaacgtcatcttcatcatcatgtcaacgttcaaaaagtttcagattttggagcatttctgatcttagatttttggattagggaagctccctcaacctggctcaacctgtacatattttaaagctttcagtatagattgcacatgtgaatatgctttgttttatgttttattttgcttggttttctggttatttctagctctttaccatacctttattttaggaaagtttggtgtggttttcttttttttttttttggcaggaggggcctaaatctttttttcttcctaatttctccttcataattagttatctttatatgatttatacccaactaattgagttttcttttctggtccttatatcttaaacagtacactcacattgatgaagcactaatgtgctgttttcaaacattttaaagccacgaaactatttattagacaaaatttggatggatgcccaatgtagaaaataaggaataagcagcactactctggttaaagtgggattgggagcagaagtccacctttcttaattctccattgccgtgtctgtcccacagatgtagccctggcttcatggcctatgtggtttggcatgatcttcttcccattaagcttattgccacataattaatattgccctctaaaattccttctttacataatgtttatgtttttaatttacctattttatgtgtttaatttatacatattatgtctttatttgtcattcaaatgagtatttgttgagggcctactgtgttaagcactgctgtaaatgctgggacatggccttgctcttgtggaacctacattctgctgggtatagaaaggcaagtaaataaaaaatcagatggtggtaagtacaaagcataaaataaggcaaagtggaaagagtatagggtaggatgtgatagatagggtgatcaaatatttctttctggaggacatggcatggaagcagagacacaaataagaaggagcttgtcagtaaatagtgagtacagaagcttaacttctccatgaaatggaatgaaagcaaggatagctggagaatagtagaaacaaaaaggaagtcaagaatcagggcaggtagggacatgtaggccatggaaagaattttagatttcattctaccttcattttaattctgacattattttaaaagcatttccccatactgttacacagtttttatagttaattcttttcacgattgtatgagagtctgtcatgtggatttatcagttgatttatacccagtatgggtatttagattttggcagtttattattagtagtatagaagtgaacatctttgtgcatttttaaaagagtgtttcttgttcagggttagctcctcaggacaagctcctaaaaatggggttacctgttgctaggcattgtgctttccaagaggctcccaatagagtacacttggcagtcaaaatatcacttttattattgaaaatggccaagttgaaggctgtagcttaatgtgagggctaaaagttatctttaagatcccagttcaggctatagcaacaggttactgacaaaattgggtccagaaggacaatgtatggcacggggagcaatggaaaatgcatggtttatgtgggtaggcttgcttataaaagaatggcagaactgtggcggaatgcctagttcttcttcccaagcttatcattggtcagtcactccacctcccaatgatggaagtgagtaaggagtaggggagctggggttacactgagttccttaaccagaagaaaaaatgaggagagagaaagaagggttcctaagtaacatttttgtaaaggtgttgatatatattatttgaaattcaattcagatggaccctcttaaagaaatggtacagtgaaatatgttcaggccgtgttttcatgatttttatgcatatctgtttcttacatttcaatatataaataggtttttttgcaattttctgtaatataatgacaaagtatgagaattgtaggttctgtgtttaatgacgtgtattgacaatactgatacactgtttcagagttatatttttagctttgtagaatactactgtttttatgtttaccatatatggttttagttctgtgtattcagcccttttagaggtatagttttttcatttcaatctttaactctttaagtgccatagaatttactagaaataagatttttatgatgagaactctttgtttaacctaatattctattgtctaagtaaaacattttttctttttatagcatgtgtctaagctgaaaattatactgttaaattaatttctcagtacatattagaatagaatatttttgctaatatttttctagcatgatcaggatgaacctaaaatagaagtagagggagttaaaaccccccaaaattcttctttttctccttaagaaataatgagctttgaatttaattaatactactaataattaagaaaatggaatctctacaactctgagaatcagtatttacaggcaacattatgactttatctcttttacctcataatgtgtttttcttaatttttatattagcatttactgatgcctcagagctacttattaaacttacggtttataatagaataaacaatacttacgtaattaagagaaatccttgacaaacaatactggtggatgtaatacagatatttgaaagataggagaaataggagaaatgttttttgttagtgctatgaaatatgtcatctaagtgggtagtataacataatttaaaataaacacttctaaatgctattgcactattgaagcctgcctgcctcaagtgaaccatcctgtatagcataatgtacaaggaaggttctggaatgacatttagagactgaatccaatgctccactcataagcagaataaagtgcacagatttatggttttcctgttttaaatgtccccagagaacatagtacattccctaatttccctcgttaaacattcccatgataagcaactgtcttttattagcctaaactaaaaccaaatagattagaaatctcacatgtggctatgccaatttagaataagggcattttttcttttttttttttcttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtctgatgttccccttcctgtgtccatgtgatctcattgttcagttcccacctatgagtgagaatatgcagtgtttggttttttgttcttgcgatagtttactgagaatgatgatttccagtttcatccatgtccctacaaaggacatgaactcatcatttttcatggctgcatagtattccatggtgtatatgtgccacattttcttaatccagtctatcattgttggacatttgggttggttcccaagtctttgctattgtgaatagtgccacaataaacatacgtgtgcatgtgtctttatagcagcatgatttatagtcctttgggtatatacccagtaatgggatggcttggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaggtttttttctaactgaaacatcacaaaagtaaaatctgataaattaattttagatcctgatgtgctttttctaatagcaatattgcttttgcattactgttgactgtggttgtgttagttttatttattttttaacattacaaatctatttatttatttttccataagtgtttggggtacaggtggtatttggttacatgagtaggttctttagtggtgatttgtgagattttggtgcatccatcacccgagcagtatacactgcaccatatttgtagtcttttatccctcacccccctccccaattccccccaagtccccaaagtccattgtatcattatcatgtctttgcgtcactacttagctaccacatatcagtgagaacatatgatgcttggttttccattcctgagtgacatcacttagaataatagtctccactctcatccaggtcactgcaaatgctgtaaatccattcctttttatgactatgtagcattccatcatatatatatatgtatgtatgtacatacacacacactacagtttctttatccactcattgattgatgggcatttgggttggttgatggtcatttggggtggttccatgattttgcagttgtgaattgtgctactataaacatctgtgcgcaagtatcttttttgaataatgacgtcttttcctcggggtagatacccagtagtgggattcctggatcaaatagatctatttttagctgtttaaggaatctccacactgttttccatagtggcggtactagtttacattcccaccagcagtgtagaagtgttccctgttcactgcatccacgccagtgtctactgtttttttatttttttattatggccattcttgcaggagtaaggtggtattgcattgtgattttgatttgcatttccctgatcattagtgatgttgagcatcttttcatatgtttgttggccatttgtatatcttcttttgagaattgtctatccttagcccactttttgatgggattgttttttttcttactgatttgtttgagttcattgtagattctggatattatttctttgttagatgcatagattatgaagattttctcccattctttgggttgtctctttactctgctgacttttccttttgccatgcaaaagttctttagtttaattaggtcccaactatttatctttgtttttattgcatttccttttgggttcttggtcatgaaatctttgcctataagccaatgtctagaagggtttttcaatgttttcttctagaatttttatagtttcaggtcttaggtttaagtccttaatccatcttgagttgatttttctttaaggtgagagatgaagatccagtttcattctcctacatgtggctagccatttatcccagcaccatttattgaaaagggtgtccttttccccactttatgttttgtttgctttatcaaagatcagttggctgtaagtatttgggtttatttctgggttctatatgccattggtctatatgcctatttttataccagtgccatgctgttttggtgactatggccttacagtatagtttgaaatcaggtaatgcaatgcctccagatttgttcttttgcttagtcttgctttggctatgtgggctcttttttggttccatattagttttagaattgtttttgctaattctgtgaagaatgatggtggtattctgatggggattgtgttgaatttgtagattgcttttggcagtatgctcgtcttcaaatattgattctacccatctgtgagcatgggatgtatttccatttgtttgtgtcatccatgatttctttcagcagtgttttagtatagaggttttttgaccctttgttaggtatattcctaagtattttttttttttgcagctattgtaaaaggggttgagttcttgatttgattctctgattgatcgctgttggtgtatagaagagctactgatttgtttacattaatcttgtatctggaaactttgctgaattcttttatcagttctaggagctttctagaggagtccttagggttttcaaggtaaacaatcatatcatcagcaaacagtgacagtctgacttcctctttactgacttggatgccctttctttctttctcttgtctgattgctctggctaggactttcagtactatgttgaagaagagtggtgagagtgggcatccttgtcttgttccaattctcagagggaatgctttcaacttttccccattcagtattatgctggctgtgggtttgtcacagatggcttttattacattgaggtatgtcccttgtatgccgattttgctgagagttttaatgataaagggatgctggattttgtcaaatgctttttctgcacctattgagatgatcatgtgatttttgtttttaattctgtttatgtggtgtattgcatttattagcttgtgtatgttaaaccattcctgcatccctggtacgaaacccacttgatcatggtggattatctttttgatatgttgttggattcagttagctagtattttgctaaggattttagcatctgtgttcatcaaggatatcggtgtgtagttttcttttttggtaatgtcctttcctggttttggtattaggttgatgctggcttcatagaatgaattagggaggattccttctttctctatcttgtggaatagtgtcataaggattggtaccaattctttgaatgtctggtagaattctgctgtaaatccatctggtcctagaccttttttggctggtaatttttaaattatcatttcaatctcactgcttgttattggtctattcagggtatctaattcttcctgatttaagctaggagggtttcatttttccaggaatttatccatcccttctagattttctagtgtatgtgtgtaaaggtgttcatagtagcttgaatgatcttttgatttcagtggtgtcagttgtaatatctcctgtttcatttcttagtgaggtttttttggattttctctcttcttttcttggttaatcttgctaatggtctatcaattttatttatcttttcaaagaaccagctttttgtttcatttatcttatgtattttgttgttgttgttgttatttcaatttcatttagttctgtgctgatctcggctgttttctttcttccgctgggtttaggtttggtttgttcttgtttgtctagttccttgaggtatgacctcagattgtctgtctgtgctctttcagaccttttgatgtaggcatttagggctatgaactttcctgttagcaccacctttgctgtatcccagaggttttgataggttgtggcatcattgtcattcagttcgaagaatgttttaatttccatcttggttttgtttttgacccaatgctcattcagcaggttatttaatttccacgtatttgcatggttttgaaggttccttttggagtcaatttccagttttattccactgtgatctgagagagtgcttgatgtaatttcagttttcttaaatttattgaggcttgttttatggcctatcatatggtctatcttggagaaagttccatgcactgttgaatagaatgtgtattctgcagttgttggatgaaatgttctgtatatatctgttaagtccatttgttccaaggtatggtgtaaatccattgtttctttgttgactttctgtcttgatgacctgtctagtgctgtcagtggagtattgaagtcccccactattattgtgttgctgtctatgtcctttctcttccttccttccttcctttctttttttttgagatggagtttcgctcttgttgcccaggctggagtgcagtggtgcgatctcggctcactgcaacctctgcctcccaggttcaagtgattctcctgcctcagcctcccaagtagctgggattacaggcaggtgccaccatgcctggctaatttttgtatttttagtagagacagagtttcactatgttggtcaggctggtctcgaattcttgaccccaggtgatccacccgccttggcctcccaaagtgctgggattacaggcgtgagccaccacgcccggccaacatttcttaggtcattagtaattgtttggtaagtgtggtagctccagtgttaggtgcatatatgtttaggattgtgatattttcctgttggacaaggccttttaccattatatactgtccctctttgtctcttagccactgttgctttaaagtttgttttgtctgatataagaatagctactcctgcttgcttttggtgtccatttgcttggaatgccttttccacccctttactttaagtttatgtgagtgtttatgtgtcaggtgagtctcctgaaggcagcagatggttggtgagttcttatccattctgtgcttctgtatcttttaagtggaacatttaggccattacattcaatgttagtgttgaaatgtgaggtaccattgctttcatcatgctctttgttgcctgtgtgctttggttttgtttttttgtttttgctttctaacttgtatttttgttttatagatcctgtgtgatttatgctttaaagaggttctgttttgatgtgtttccaggatttgtttcaagatttagagctccttttagcagttcttgtagtggtggtttggtagtggaaaattctctcagcatttgtttgtctgaaaacgattgtatctttctttcatatatgatgcttactttggctgaatacaaaattcttggctaataactgtttgaggaggctgaagataggtccccaatcccttttagcttgtagagtttctgctgagaaatctgctgttaatatgataggttttcctttatagtttacctggtgcttctgtctcacagctctaaagattctttcctttgtcttaactctggataacctgatgacaatgtgcctaggtgatctttttgcaatgaatttctcaggtgttctttgtgcttcctgtattttcatgtctaggtctctcacaaggccaaggaagtttgcctcgattattccctcgaatatgttttccaagcttttagaattctcttcctccggccgggcacagtggctcatgcttgtaatcccagcactttgggaggccaaggcgggcggatcacgaggtcaggagatcgagaccatcctggctgacgcagtgaaaccccgtctctactaaaaatacaaaaaattagccgggcgtggtaacgagcgcctatagtcccagctactcaggaggctgaggcaggagaatggcgtgaacccgggaggcggaggttgcagtgagccgagatagtgccactgcactctggcctgggcgaaagagcgagactccgtctcaaaaaaaaaaaaaaaagaattctcttcttcctcaggtacaccaattattctttggtttgattgtttaacatatcaaaccttcttggaggttttgttcatattttcttattcttttttctttttctttgttggatggggttaattcgaagactttgtctttgaactcttaatttctttcttctacttgttcatttctattgctgagactttccagagcatttcacattctaaaaatgtgtccaaagtttcctgaatttttgatcgttttttctttaagttactatttccatgaatatttctcccttcttccatcattttttggatttccttgcttttggctttgcctttctctggtctctccctgattagctttataactaacctcctgaaattctttttcaggtaaatcaggaatttcttcttggtttggatcccttgctggtgaactagtgtgattttttggggggtgttgaagagccttgttttgtcatattaccagagttggtttttttggttccttctcatttgggtaggctctgtcagagggaaggtctaggggtgaaggctgttgttcagattcttttgtcccacgggtgttcccttgatgtagtactctcccccttttcctatgggtatggcttcctgtgagctgaaccacagtgattgttgtctcccttctgtgtctagccatccagtgagtctacccggctccaggctggtactgggggttgtctgcacagagttctgttatgtgaactgtctgcgagtctctcagctgtggataccagtgcctgttctgttggaggtggcagagggtgtaatggactccatgagggtccttagctttggtggtctaatgatctatttttgtgctggttggcctcctgccacaaggtcgtgctttccagaaagcatcagctgtagtagtgtggagagggaccggtagtgggcagggccctagaactcccaagattatatgccctttgtcttccactataatcagctcttcagtttgtgtgggagctgggtgaggcctgtgactcctggcttcccccactttcctgacaacctgcatgactcagcagaggcagccataatcctcctaggtagagacctgggagtctcacccccatcccccacagcaaccacagcaagacccacccaaggagagtctgagctcagacacgcctagtcctgtccttacccgatggtcccagcttcaagaaaaaagggctttagttcttccccggcctgtgaagtctgcacacccgattggtgccctcccccaagttatggccaggaggcttctcgcccagttcaaattgttaaaaagttcagctagagaattccttctccctgtggagttttaccccctgctcctctggccaccttcccgttggatccctatggtgctaggcaggaatgggctgctcggggacccagtgaactctcagggcctttttgttgcttcctctacccctgtatttggcttggctctctagcttgactcagttccaggtaaagtcggaaacttttcctgcaaacagaccttcagcttctccagcgggggtgtgtgttcccacttccacaattggggcactcacagtatttgggtgtctcctgggtcctgcaggagcagtctgcttccttcagagggtctgtaggtcctcttgggattgctagtttgttcttgcagtccatctggagctaaaattcacagtgcaggcctccgcatgctgccctgtccggagctgcaatctagtcctgcctcctgtccgccatgatcccgatcactggttgcataaggttaagagtgagtgaatgattaatgatagttgattaatgagataatgattgcattttgagtggctctggatggattaaagaaaccacagggatttctgctcttgtgtagttgtgtatttctgctttttactgctgatcccttgaatactcaccagattgaaaagctgtggcgaatgaaacatttatgagagtcagttattctttagaaaggtgtagaaccaaagcatttgccttggaatgtttgttaggaaattactgcttcttaggaatgctaaattagttctgttatctttctgtggtgaacttgataaatggctcaatatgtgcagcatagaataacatagtcgtatctggttattgagtcattcatttattttctctgtgagctcacagtacttgcacacctgccacatgcctggtgttgttgtaggtactagggcagcagtaaggaacaaaacatagaatcctgcttgcatggagctcacattatgatggggcaacaatgaacaaacaagtaagtaaaacttatgaattgtcagttggtgataagtgctttggaaaagaaaaaaaaacaaagaaaaaaacttgtagacttctctaaaaataaataaataaataaaaagcccttaaagcccttatcctaaattggcacagccccagagagtgccagcattggaggggctgcagctttgaagagcataggttctataaaggcctctttgggatgatgatatttgagcaaagctctaacaaaggtgagggaatgagccatgccgaaatccagagcgacaacgggaaagcaaaggcaaaggctgtgggtggcagcatgactggtgtgtccacgtggactcacatcagccatgggtgaacagaaaatgatgtcacagagatgacggggtgagaaagtataggagcagatcatgttgagcttggaaggtcattgagtaagctgggaaacagaagatcgatgtgatttggtatttacctttttaaagagatcactctgatagcaatgtaaactctaaggtgactaggatagaagcaagggactcaggtgggaggctattacagtaatccaggtgagaggtggtggtggcttggacagggtgtgagcagtggaggtggagaaaaggggtcagattggaattatattttgaagatagaactagcaggatttatggacagactagatggaggaagagtgagagaggaggggaatagaagatgactatggcctttggcttgaacaattggaaggatggaacatcatttactgagaaggtgaagactgagggaggacctcagtgcacactgctgtttcttatttatttgccatgcctgcatatttttttctttttgtatttgttttaaactctgtagcagggcctttgacttgatctttttccattctcttaaatgtagtcaataaaatgtacagagagtaactttggggggaaatgaagtatttctttaaaaaatgatttgataaatagacctataaaaagaaataaccatcacatcacagactgttctagtaacatgtctgcagtttgaagaggtcagaactattaatataatggagatatagcacttactttgtgttgaaaggcagagtatttcttctgtttcactaaagtagcctataggtaaaatgtcatgatgtcaaatgcagatttgacattttcagagagctgagcaacttcttgtaaattagtttcttgaatgtgaccgttctatgtaccaagctgattcatttccttcattgtccattttaatctcttctacttttaactctgtaggcaagtgaatgtgacttgttattctggtccatctcaccataaacagaggaaacatataaaatgcatgcactgtgtggcccttacttacttattttaccaataataggataaataatttgaattaataacgtatttaaggagttgcatgtgtttttctcaatgtttctagttatatatatccaccatgcttgcattatatatagtatgtacattatctgaaggtacctagcatgctgaatattaactaaaaagataatattttgcagtgcccaccaaatcttcataagcaagacggatatgcatgcaatcaaaatcaggtatgctgggctataaattttaagtgtaatttaaaaaggattcattggaaagttttttttccttttttgataaatattaatataactttgaagggaattttactcaagtaaattattatagtgggattctaatttagagttgcttcatgttatgccaaatattaaatatatttacctctggtgacaaattgtccagattaagagaaaaaaaaaaagaatgtaatggctgaagaactgggagtctcatttattgagttgtgaccatctttcagtaatttcagcctgcctggtgtgtgaaagaaaatatgacaatctgtcatgagttttttttcccctgaagccatattataacctacaggtgagtatcatgatgtcaaatgcagatttgatgtttcctaaccatccatacacaaaagaagctaaaaatcattttggtgtctctcacagaaatgtaccaatttttgtttgctgtaaaatttcaaattgtagatgtttagtttacatttagagagctgtacaatgagttctgtttagagttttaaagttttaactcttattcttgagatatttgtgatccttactggtcactataaaaatattagggtatgaaatgaaaaaactttatccaagtgaaccagaaggagacattgtagtaaaaacattggggaagacaaactgactctgtgtgcctcacatgtgtgctcctgtccccagggccgctgctacaatggcgagtgcaagaccagagacaaccagtgtcagtacatctggggaacaagtaggtcgcacctccttgcttggcggttacacataccattttctcttaatagtgttcttctctgccagtcttgctgagagagatgcacagcttggagtgatgttttaaaaaaatctagaaaggatgagaataaagagaactgtgaatcttagtcacaaaaactatagaaaacaactgcttaagttgggtacttgtcagaactgagcagtgccatttaatggctgtggctctcagagaaggggtgttgcattcatttgcaaagattgggttgagtacagtgtgattatccagccacttgtgtgatttattttgtaccttggttttaacatttgaccccctttttttccattaacacacacacaagttagctttctggtttttaccgcaggaaaataccagacttattttttaaattttgtcatttactgtctcacttcaaagtgaagagatgcatgtacttcctgagatgcagataggtacatggctgtgattcttagtacattccgtaaaagttcacgtgcatatcctcttcctgacatttacagtgcctctccaataatatcagttcatgagggccagacggggggaagaatgagaaatgcgtctgcctttctagccaaggctgggttcaccccaaaggaaaagaaagcacacagaatgagaacagggctctggcatgagtgattttagagtttggcaaatatcatttatttgactgatttacattcagtgctttagttttgacagagaaaagataatagacatatttgtattttgaaaggtttaattatcaaaactcaggtgccaacataaaatctcaataggctacgactttataattatctcctaatattgatataaaacaagattaagaatgttagtttcctgtgtgtcagtcacttcaccaattcctgctgataatcattcgcaccttccatcctcaaactcaccaacaaggattggagagaaatttatttctcaggctaaaaacagtgttgttttggagcttttttgtattagcttgcaagagccaattgttaaattttcaggaattttggaagcccatggatatcacattgagtgtgaaatcagccatggagaatttataccatggaaacttgcaaatgctacaaatcaggatgttctttttccttgctctggagaatcgggtgttaaacacttactggcacactactggttatggataacaaagaaaatgaaaattaattttcttctcttgcctatctccaaaagaggctgcagggtctgacaagttctgctatgaaaagctgaatacagaaggcactgagaagggaaactgcgggaaggatggagaccggtggattcagtgcagcaaacagtgagtggtcagctctaagggcatagtcactggacttggaagcccttcttatgcaagtgcaaaatgagcacaaaataaatgctaatgatttttttctaagtgttcaccattccaaaatttaaagtatttatttttaataggtattattatatctagaggcaaatggctatagattaaactgttactatgctacagattcatgccattttcacaaaattcagaaaatttctcaggtgccacattttacttcatttttgttctgacgagatactttgccagagcattacaaattaatactagcttttaattttctacttttactagaatatatggcctatgagtgtagtagtatacatgtagtttaaatgcaaactatatagaccgtatatatttttgcgaccaacgtgaaatcttactgtgttttttatcatttcacaagtgtagtaacatttgatttaatcagatatctaatatctacaccagagattttttttcccttccaaaaagcatctagttagtacatattaaagccatctttactcaggaaatgagatgctttcagagcacattgatatttctttctccctttcttttttttttcgagactgagtctcgctttatcacccaggctggagtacagtggcatgatctcagctcactgcgacctccacctcctgggttcaaatgattctcgtgcctcaacctcctgagtagctgggattacaggcatctgccaccatgcccggctactttttgtatttttagtagagatagggtttcaccatgttggccaggctggtattgaactcctggcctcaagtgatccgccctcctcagcctctcaaagtgctgggattatgggcgtgagtcaccacgtccagcctgatatttatttgattagttgaggaaagttagaattctcattaattaggttattaaggttaattgaattactgtggaacaatggaatcattaaggaatagcccaaacctctttccttttccttctaaagcaatgaaaattctcctaattttgaagcagagcaagaatttaagggaagctttattctcagttaatgatctctgctatattttacaaaactttgcatttccatttagtctttgatgatggatgaggccacagtaggcaacaaatctttgactataatttttaaaaaattaaaccaaaataatagagaacagagcttcttatctgatgtctcataagtgaagcacagatgttccaaggtgttgatcctcagtcctcgaggtgtcaggggataggagcaaggggagcctgaagtagtcaaaatccatgggattggacatcttgaatttgattagctttattcattcactccatgtcctagagaatctgattatctctctgtgtctcatgacctcaaaaagtttgagaggcattggattagattattgtaaaggatagcttttgagtatctggtaatagaatacccaatccccaataagttaagggaaattaatgtgtttgaaacttgaaaaaatcatgaaatatatgaccagacacgatggcttatgcctgtaatcccagcacttagggaggctgaggcgagtggatcgcttgagtccaggagttcaagaccagtctggacaacatagtgagtcctcatctctattttttttttaagttgtgaaatgtataaacataaaaataaataacaaataaatatacattttaccaaataattatgaagtgaactcccatgtcactcctacatgggtcaagaaataaaacattgcagcatcccagaaatagtgcagataccttcatcctgacttttgtggcagtcactttcttgcttttctttagagttttactgcctgttttcatccctaatgcttcatgtattattttgtattttgcttctcaagtccagcattttaagagttttctgtggtgtgtatagctgtctgttgttcatttttattatttatttgtttcacttttataaatgcacaaatgaatgaatatactatactttagttctccattctgtgttgatgaacatttagtttgttttcattttttggctgttaggaaccatgctgctatgaatattcttgtatatgtaacctagtgcacatttgtacctctttctgtaaggcctgtacataagtagaaaatttgctaagtcataggggatcttatcattgttaccaaataatgtcagactgttttctaaaatggctgaactagtaaattctaccatcagtattatgtatataagaattttattgtaccatatttcaccaacacttggtattatcagactttttgcttttatctgttctggtgggtgtgacctgctatattagcatggttttaatttgcatttccccagattacaagtggaatctagcacatttttgtacatttgttggacatggatttcctttttttgtgatgtgccacttcaattctttgcccattttttaggagtcattgtttacttaacagatagactggaggtagaggtcctcatggtgcatgaatttaacaaggtcaccaaagacccagataatttctgcccctccatcctgtaacccttagcatgttgattttttgtccttatgctttgtgaactcatgattgtaaagtggatacaaaagctacacattcaaaggtaggaagtaaggataggagcaaaaggtcttctccctgtcagtctctaaccttttatccagaaaacaaaatcctcccagccactccctagccagcttctcctcacatcttcacagcccaggggccacttttaactctaggaagacgagaagggggaatggataggaaagtgggcgtcgagaatgggagtaccaagaatagatgagacagcagtcatgatccacctttcagggctgggcactttgctgttccaaacaaaactgtgatcctcttagcaaagaaggaggaggttatcacctaccaatgatatatgatcaaatgtttttgtttagaaagaaagataatattttaaaaatttgaatcaatgtggaccgaatcgttttgattttttgagcttgattcctcctgtctggtctgtttgttttctttacacatgttcagtgatgtgttctgtggattcttactctgtaccaatcttactcgagctccacgtattggtcaacttcagggtgagatcattccaacttccttctaccatcaaggccgggtgattgactgcaggtaacatattaaatattagaagacctaataagccatgagaattacaaatttcacaaaatgaaatttcaaaaaaatcagaaatcaaagatttttctagtttttacaagaggaaagttaatttagattttattatcacctttcatattgacagtcacttaaaaagaaacaaagttgtatattgacttgcagcttacatttgctcaaaattatactagttagtagtaatatggccttctttgtcatcataattttaggagtagaattatggtgttcattctaacccattattaaagttttaagcattagagtatgccactattttgaacactgtgtgtgtatttattttgtgactgaaaagaaaaagaatttaagctatagtttatgaagtgtatgtctggtttggaagatggcttaacaagtacctaatcatatatagaaaatatttattaaaatagtatgtataccgataagcaaacatttgatatccagttgtctgtgagtacaaggcatgtagatatgaggcttatttttgtttagtcggggagtcatattatattccaaataggtattgttcccttcaaagtagttataattcgaagatactattctcttactcaatggtattgttgttgctcaaaacacttttgggcttccccctgcagaattgccttcagcgtctgcaaacttttacttttagtatccttagagtaccatatcttcaccttaagtgaggtaatataagatttgggattatccaaaagtaattttagtaaattcattgggtactaaattggctaatgctgtctcagtcaaatggttacttttttttttcttgcttttaaatggctctgaagacaattctaacagggtcttagtaagatccctcctggaataaatttgtagtctctaaagctagttactttgacgtatacaagctttatttgaatgtgtgttttcatgcctttagataaaatagccttgttaaattatattgttgtatatactaaactagcatatttgttaaatattcagcaagatattctattagtgactatagcattatcattcaaattcaaattatacctaactttgaaattttagaagtaagcactaaaacacatgaaataatcttatgaaaccactgtcatatatgtggtctgtcattgactgaaattttttacacaatggtaagtacttgcctatctgaacgtatctaaacatagaaaagtcatactgccccttttctatgtttagatacgtttagataggcaagtacttaccattgtgttataattgcccacagtttgcagtacagtataatatgctatacagaagtgtagcccaggagcaatagactagaccatctagcagtgtaggtgtatagtaggctataccatccaagtttgtgtaagctcattctatgacatttgcacaaagacaaaattgactaatgacacaattcttagaatattatccccatcattaagctaggcatgtctgtaaatatcaatagaaaataactgatttgtttatgtttttcaattatggataatcagatcttctgaagtaagaataataattttcaaaatatttttcatttgctgtttttgttcatcgtctgcttttttctaccatgctacatctgaaagccttggagagctaatgatatatttgcttcttttgttctcatatagatacttctctcctttagtcttaatgttgggtcttgaaaacacgtgaagatttagaatatactttgtgcaaatgacatttttcttgttgatgtgtactgtaataatgataatgaaagagtgtttctttttcatgctcttttattaaggaaaggtagggaaaggggaagaagaagaggagtaagaaaatgctaggagaaatccacatccactgacagcctcttcggttttgtgaagagcaagcctcattcatggaatgatgttctaagtgtggtgcaaatagttatatgggtatctttcttgttttagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtaagtaggtatcaatgtgacagctggaaccttcatggtctggcatggtcacagtgactggactttaatttcagccattctcctagccaacatggtgaaacaccatctctactaaaaatgcaaaaaatagctgggcgtggtggtgggcacctgtagtcccagctactcaggaggcttttgcagaagaatcgcttgaacccaggaggcagaggttgcagtgagccgagattgagccactgcactccagcctggcgacagagcgagactccatctcaacaacaacaacaacaaaaaaggccaaattcagccttgttaatcacaatcatggtattagaatatttcagattaaaaagcttccttgtttgattttatcatctctgaatgtgtttctcagggagataagggtttaaacactcctgtctctagtttgctcattgttatttatttcctctagattacagttccattccagcatgctggtgggtccctggagaaacagggaggagacagagatcactctggggtcctcagcttggctgactgagaaaagagggttaccaaggactaggggtgtgggggtgtggtgggggggaatccttgttgggcagggaaagtgccaccaagtgagtttggtgttggacgtggtaacggtgaggtcatacaaggcactggtgatttatgtctcctggccttttatctccagcagtgcttttgagcccactgtctattaatttattgaagtaagtgtatatgtttttaaagtgggttcctagaaacagttacttctgaacaaagtagaaaaaagtatcttatcagacatttgtatacttatgtaatatcatgattcaatttaatttaagaataacatgaataattcaatttaagaataataataaataataagataaataattgaagaatttcttccttttactctttttctttaattaatgggaaaaaatgttacacaatttgatctatgcattattaccttgtgtctagtgatcaagaccatgggaaactttaaaaagaaattccaaatagcttttaaagcttcctccctgcccccgtgtctcttttacatttatcactattattctacaaaatacagtgaaaatgccatatctgttcctttttcttcacaggtgtgtagtaatgaagccacctgcatttgtgatttcacctgggcagggacagattgcagtatccgggatccagttaggaaccttcacccccccaaggatgaaggacccaagggtttgtgtgattttggtttcaattcatggaatactgaattcgttgacactgttccaatgcaccagtataacattctaattgacttaagaggagacacataagaatatctgtttttgcctttaaagtatataatttatgttactgccaaattaaggattctgatatatcatatttttaaaatgtgtttgaattacttcttagtctagaactgagattgggaagaagtaaatatacacattttctttaatacagtattctttttctctttaaaccttattctctttctgtagtcacaaattattttgcagttcgtctaagctatgccatttttctaatagatcaaatctttttggctgacatgaggctctggttacttttcaatgttggaatctctccggaaggaagttgtcaccttacaagctctttttgaacattcttttgactaggaaggagttggaattcttcatagaactttcattcttcaaagaaaatgtgagagatctggacctttgttttaatcagtcattaagaggagagaaattagaattttgggattagaaagagactcaggggccacctaggaccactctctattttcgcagatgagaaggcccagaccctgaggtcaggtcacttactatagtcacccaggtagtgagagacaaggccaggatcaggacctaagtcctaagtgcctgatctcagactcttgttctcttcccatccattatatcatcttttttttttttttttttttttttgagacaggatcttgctctgtcacccaggtaagagtgtagtggcacaatcatggctcactgaagcctcaaactgcaaggcccaagaatcctgccaccatgcctggctaattttttattttttgtagagacaaggtgtcactatgttgtccaggctggtcttgaactcctggcctcaagtgatcctcccgccttggcctctcaaagttctgggattataggtgtgaaccactgcacccgcccctcttacatcatctttttttttttttttttttgagacagagtctgactctgtcgaccaggctggagtgcagcggtgtgatcttggctcatcgtaacctctgctgcctgggttcaagagattctcctgcctcagcctcctgagtagctgggattacaggcacctgccactgcgcctggctaatttttgtatttttagtggagatggggtttcatcatcttggccaggctggtcttgaactcatgacctcataatccacccaccttggctgggattacaggtgtgagctaccgcgcctggcctcttacatcatcttataatgtagtctgtgttatcaggagtatggtaatcatttttcattattctcccgattctcaacccctcatacaattttcaaagatctagaaaacccatcagtcacaaacaggcctactacagcatctgttacattgtacctaagaaaccaaggaaatactagaaccagtttttatatacagggatgacgttgtacatcagcttctttatcatggtactgctaacagtttttttgtaactgccgtgcttttctctgacaggtaggaaaatgcatataggattagtaccatttagatcagcttagttttggatgaaagtttattgaaactctctgaacttcagtatagtttatatgggaaaagatgatttcagatgcagatgaagctctgtagtcctcaattcctgaagagatttaggctgattcaggcgcatgtgaattgttcagtaatagtgggtgtgttaaaacacattttatgcatttgcttaatatgcccatgatattaaaattctgtaagaatcataatcacaccctcacagtctatttctgttctccttcttctatttctaaaagggaacgtattccacttttacacttagtcttttgttactttaaaactagaacaaaaaattcttggatccaccttctgaagttagatttagagaagatttaagctctaacaagagaagccaaggttcattctttccaaattttctctccacagtgtttctgtgattttttttttaagatctagatgctatttcctcaagtgatgtataaagatgcctcaacggatgagcagagctaaatttacttagactctgcctttttttctttaagtagagtagggggttattaattgtctggttctgtaatatctattccctgttccttcacccacccatgcctaaaaatctttggaggcattaagtaaagaaagtcacattctagagaaagagtactcacagctgccttttgttttgttttgctttactctctccatttaatgtggtagtatcccacactacctttaaaaaaaaataacttttttgatccttcaagtaatacatacttattgtagaaaaatttgaaaatacggaaaatattaaaactcagaggtgctcaagataagccttattgggcctggctcagtggttcgcgcctgtaatcccaagactttgggaggccgagggcaggtggatcatctgaggtcaggagttcgagaccagcctggccaacatggtgaaaccccatccctactaaaaatacaaaaattagccagacacgatggcacatgcctataatcccagctacttgggaggctgaggcacgagaattgcttgaacccaggagacagaggttgcagtgagccaagatcgtgccactgtactccagcctgggtgatagagtgagacactgagccccctactcatcccccaaaaaagaggccaggcacggtggcttacacctgttatcccagcactttgggaggcccaggcaggcggatcacctggggtcaggagtttgagaccagcctggccaacatggtgaaaccccatctctactaaaaatacaaaaattagccgggcatggtggtgcgtgcctgtagtaccagatactggggaggctgaggtaggagaatcgcttgaacccaggaggtggaggttacagtgagccgagatcgtgccattgtactccagcctgggtaacagagcgagattccatctcaaaaaaaaaaaaaaaaagagataagcattctggtatgcttctttcctgttgcatttttctttttccatttttaatgaagacaatggagtcattgcaaagttatctattggttctaaaattattaaaaaccttatgaatctctaataattttgattaaattgaaaatgtcattaaatgaaataaatgacctagttatttttataaatatttacatttccagaaaattcaagcaattttagtacaagtaaataatagcttttatctgtaatagctatctatatctttttaacctctatttaaaaaatctattaatatactggtaaaacagaaactaaaaaattttaaaactttgttgtagattttattattttgtttttgattgtcaggttaaaagaagattccaagtgagaaattatgtgcttttcgttttattcagttagcaaatatttattgactgtctactatttaaaagatagcgtatgcttggcacacagacactccataaatattacactcttctcttttgaaatatgcaaaggaaatgagatggtgcatgctagtgccacttttcagtttatccatattcatttgttttgttgccttgccgacgagtaataggtaatggactcaagttattaaaacaatcagtgttttacttactgtaggctcagcagtgtgtgagacactaagatttttctcaaaaaatgcatgttgtggccgggcacggtggctcacgcctgtaatcccagcactttgggaggccaaggcgggcggatcacaaggtcaggagatcgagaccatcctggctaacacagtgaagcctcgtctctactaaaaatacaaaaaaattagttgggcgtggtggcaggcacctgtagtcccagctactcgggaggctgaggcaggagaatggcgtgaacctgggaggcagagcttgcagtgagctgagatcgcgacactgcactccaacctgggcaacagagtgagacactgtctcaggaaaaaaaaccaaaaactgcatgttgtatcttttttctcatgatccaactggtttggttggcacctgcctgattgagcacagtgtttgggccctccccaaatgcttgccatttataatgggcaccacccacagtggccaatcatatccatagatgaaggttttctgtataggtgcagtaagagtattaaaaatacttagttttatttaatttcaatgtgcttccattatatagagaaaaaaattcaagaaacataatgaaaatatggcctttttaaaaatcatgaacatgggcataaaagataaattgtacccaactgccctttggatcaagaccaaattagtaaaaatgaaggcgaattctatgactccgtcttcactgatttgagaatgtcagaaatgaactgatgtgttttgtgtatttcttttattttaactataagttcctggaagaataggaaattcaacctctcctgtgtgaggactgaaagcatacctgaaagcattgccactgtagtcaccctgtacttactacagttgtccactatggacccataatttaaggcatgctagattattcacgccaacttctcaaaccaaactattgaaagacaagaaataagatctcaaagcacaaaccatgtgagcaaggattttttaaaaaagatttttgtcacattatttattttttctacgttgttcatttcacatgcaaaaaccctttcttaagtttatttttaattttttatattttttaagcctagtccttctctcaacttgtttccactgaaatcattatagaaaattattttgctttgttctacaaggacagaatgtattttaactctgtttaaaagacctagaattctctcctgttacagggagacccacatcaagtaccccaattattgtctgtatgtagacacattctcaaggtgcttactatagaatacagtggaacttttctcatttgatagtttacatcaccattgtaagaaggaagagaaactgggacataggtaatgttttcagtgatatgtatgggcagatattcctgggaagctttggtcagaccttttcatcacaaccacactcatcaaatcagaaatgaaaagggccttagaaagaattcagtctagaccccttgttttacaaatgaagaaactaagttagttttcagggttaacaaagagtgagaggcagagccaataatataacataatcaccttatcttgagccaaatgcttttttctgttattccatactcctgttttgaagttgaatagtgaggctaggcacagtggctcacgcctgtgatcccaacactttaggaagctgaggtgggcaaattgcctgagcccaggagttccagaccagcctgagcaacatggaaaaaccccgtctatataaaaaaataaaaaaattagccagttgtggtggcatgtgcccatagtcccagctacttgggaggctgaagtgggaggatcacctaatcccatgaggcagaggttgcagtgagccaagatcacaccactgcactccagcctgagcaagagagtaagacccttctcaaaaaaaaaaaaaaaaagctgaatattaagttattctgctagttctcatagcacaatagtaaacagaaagtgaaacaataaccaggtagtaatcaagcttattaactgatccattattgtcagtgatgctttttatggaattagataagaaaggaagtattatattattatcatttagtatttttaaaataatagttttgaagtcttattttctgaggtattaaccttgaggagtatttagtgtttacatttaccttttgcaatatatccttttggtgactgtcttcgtcagtgcacaaatctttgattttatagtttagatgattagatatgagaagttatccttatcatatatgattatgctcatgtataattatgtgctacctggatatttttctcaaataacaatggccttatcaataacccaaggatatatcaagtttaaaaattttttaataactgaatttattttgtttcagttcagaaaaaccctattttcattgacagcataaactgaaatatattcttacatgaaatcatttattttgcatccttttagacatttgtccatgtatctaaaaatgaacttgtttttttcttttatggaaaacagtaaggagatctgattgtatgtataatgtattgaaatatggagctacataccaatattatacactagtatataaagagtttatttagtatttacttttcttgtcttgaatggtagtggaataataaatccctgaagaaagcactttggtccatggaatacaaatgatgactttgatgcctcctgcctgtgaagtatcaaaagatacaggattttaaccccctttggaatcacttgggggaaataatgcatcttcttatttgagaaactctctaaaaataaggaaaaaaacccactcaatttcaaaacagcacattttcaaaatgtctgaagcatgacatgtctataaaggaattctacatataaaatagaaaatcttaagaaaaggagaaaatttatagtttttgatattttatacttaccaaaaattctgtcttttagcacaagtaaacctaggtagcagggaccaagactgaaaataataataaaccaacaagtaatggaaataagcaagtaaacaaaaatgaaaacattctgctaggtaataaacagattccacaaacacattatactgaaaagtaagtgtatcaaagagttagggagcaaagttaagttcctaataaaaggattgtgttgtcagctagaagctttaagcgttccatctccaggtttggtaggatgagaaggaaaataagatatatcatcgtgtgtccagcatagttccttgaacaaaaaaaaaggtatttagtaggtaatgaatgaattaatgaataaattacagaatagataaattagtgtagaagtagaatttttttcaatgagatgataaattctttgtagctatgaaaagcagctgcaacctttgttttcaaatatgtcccctataaaaatccacccacccgtgagctactcagttaatttatgtcaaggtgatgcacaagttcctacttgccaaaacaaagttcagcactctctaaaggaagagaacaaaagcaaagcagaatcgacaaaaagaaaatcttcacatctttaagagacaaccatgttcagtacaatgacaaagaatcaaatggcactttacatgtatttgcaggatactgtgtcactcaaagtaatgggagggagagagaacagggagggtagggatgcttttgaaaaagctttttttcccacttttaacttgctttagcgttaagagtacttaccagctaataatgtggaggaaattattctttctcattggagattacagaatatatctattcatcttgaatacccacttgaagcctctgtagaaatgtctcgtcctccggttgtatttctaaaacctacatgattttgtcttgtttctgcagtgagaaattacatccatagcaaagacaaaagtctttttaaattatttttatttatctttcatatagttcttacaatttctaaaaaattaacactcatttagtatcacaatttatgggagagggttttttgtatttttaagcatatgtggcttatataaaaattgcagaagtcataggactgtcatgtattgcagctctgagaaccaatgcctgaaacttaagccaaaaaaaaaaaaaaaaagttatgaccaggcacggtggcctcatgcctgtaatcccagcactttgggaggccgaggcaggcagaccacgaggtcaggagttcgagaccagcctggccaatatggtgaaaccctgtctctaactaaaaatacaaaaattagccgggtgtggtggtgcgcacctgtagtcccagctacttgggagggtgaggcagaagaattgcttgaacccgggaggcagaggttgcagtgagctgagatcatgccactgcactccagcctgggcgacagagcgagactccatctcaaaaaaaagaaaaaagaaaaaaaagttataaaataatgtatatcagttaatttagtattctgaaagcaagggttttctaaggtctttttaaaaatgaggcttcatattttgaatacctttcagtcccagtgtttgcctccataacttgaaaatcggagtagttcaggtggttttgagttctaatgtattgtcatagtggggaaacattgctgccaccttctgtgttggtcttcttcccttagccttcaacactctcgggggacttttctgttctctgttgtgtccccatctttttgtttgtttgttttttaagaaaccaggttgtgcttagtcaatgataaaactagaatttctccctcacattattatcttgtgataagataaagcagtatacagttaattaacagggttagaaatccaagattctttctcttcctctgggaaaatatttagctaaaaatgtcagtgagcccaattgtaagccttaaaaaatggtggctttgagtcgtggatctttgtttcgtttcactgtctcagagcacacaatacatgtgaagggcagccttgttgaagctaatctctgttttcatgggaaaggtaatttgaagccagtccttttgattcctatagaaatatgaaataaagtgtatgtatgtccacacacttgtgtgcacacaggcacagacacacaactgcaaacaatgtgtcttccaactttaacaccaaacttcattttgcctttgtagcgggaaccttggggacctccactcattccaggcccattttccaggattggaaagctgtacacagagaagcagtgacataaagttattcagattctcactctgatagtcatctaccacttggtggtctgaagcaattaatacggtttcccagagaccctaactttctataagtttatccacttgagactactaataaacaaaaaacaaaatgtctaaatactatgacagaaatccaaatattgcagacttatctgaaatacgcttttcaataacttcccaggtaaacatgtatttacttttaaagctattctgtcttgaatttgtaaggatctttgcaaaactgaatgatatattctgaattttgaaaagatgtagcttcttaggcatattttacagtttgagaattttataaacaattactaatggttcattacttttgtaattaaaatacagatttgctgttatgcaatttaaattactttttaattttacctcacatctggtaggaactataacaaattgaattatttatgtatttataagtacgtataagataattatgttttttaaaagtagggtgtgcagaatttgaaggtaaattcacagttatcctcaaatatcttcaatgtgtatgtagatcttaatttcaaatcttatagcaaaaaaattcaatatttagccaactttcaaagcatgtcctgaatagattattttgtatgttagtgaaattagtatgtaatttcctttgttaaaaaatctccattttccctccacacagtgaatatggccacaagcaggctaataggggccgtggccggcaccattctggccctgggggtgatttttggaggcacagggtggggaatagagtaagcatccttgccagtttcagagtgtttctgtgtggtgcctgatgtgtgaggcgatgcctgtacctgactccatgtctcgtcctgttgaccgtgtttcctgtggtagtgcaccttgtggtgtgacttggatgttgcttgtgtcctgtggttttcttgtgtcatgtagaaccttctcctgtctggaacaatgtggggcataacataacactgggtgtgcttccgatatcttcataattaaggcaatagtcccaacacttccattgctcctccactttgtagaagtaattttaaaatacagacttttttttaaaccatttattggcaaaaatgcttttatatgtgtgttttcttaggattcttgtaataaagttaatctgtgccagtcaaataaatttacatatataactagcaattatcaacagttataggaccttttaaaggtaataaaaatgatagctactaatgttttcttcatttatttagaatgatataggaggctgcagcttaattttttaaaaagaagatatttagcatactgccttcctatttttcctataaaataggttaataattcaaaattgaagtctacataaatatttggaagcaaggagcattaagaatgaaaaaatatttaatccaaacctgtataaccataagtgaacagctgcaaatcacctggtgggttcgtcttaaaagtagccagggtgtaaataaatatattgtgtgccacttgcccattaagctgtcacagaaatacagttctcctgatgctttgatttagggtgctctgtacttgatccacatcctcagaatagctgtcagttctccagggcacattgcttcctgagattgctaatctgtagattaaaatattatcatgatttttttcttctctctctaattagaaaaagaatatttaagaatggcagacataaccctttacacagtcttttctgtctactgtggtggtggtggtaacacttcaaagtggcccaggaatgaattactagtatcttcaggaatcactagatatctttgactcacccatcccaaatcatgggcttattgtgaatatcagatatgtttttctatagtcccattagttagaacaaatgggtgctcctcttacacactggaattgggagacccggggaccaaaatagcattaagagggaagcaggttcatagttcacaccttgtgttgaagatgacatgagccttctttctcctggattcaaggactttgaccagacttagatcttccaactcacatctcatctctatggactgtgaagctggttagcacaggggaagctagaaatactagaaaagagattttgtttctccttgtgtattagaaaacaaagaccataacagggataaaaatatttagagacaaaaactttgtcctgtaaaatttccccttggatctgttgactggattgtatacagaagaaacattcctttttcagggccagctccatgcatgcatttatgtgaaattcctccttgacaaatggtagttttctgaaaatcatcccaaatgcattttttaacattatacattggctgtaactttggtgtccttaaatgtactaattgaaaggatgaattttaataatccttccttgaagtcttagagataggtaaaaatcaaagaggcctttcttgtaaaacatagtccttgttatcagcatttgttttcatcaatcatttccagttttgttcgtttgtgactatttctaattgtgacaggtaagtctgtgtaagtgtatgtatattttttctaaagatagatttgttattattcctggtttatgagcactagttttctcttagcttactgatttttttccccatcaaattccaagttttagcataattgctcaagaaatatagttttttaaaaaataatgtagtacaatatagattgtctcaacatttcttagtttaattgatagagtaatgttcattcagtcactaagaattccatggacagttttttttttaatttctccttagtttataagtcaggaatcatttttcatgaattatgtgttgattctaatcctagcctatgttttctgaagcggacgaagtgcaaatcatatccaaagcatagagtatgtacatggttatatatttttttaatatttgttttgaaatttgattctctgttgaattgtggggaggaaatacatgtaagtagaataaagtttctctaaaacagaagttagcaaacttctgtaaaaggccagatggtaaatagttttagctttcagcctacagggttgtctgtaacaacttctcaacaatgctgtcttagcatgaaagcagccataaacaatatgtaaatgaatgtgcatggctatgttccgataaaacttttttgcaaaagcagacagtggggctagatttggtctgtgggctccagtttcctgacccttgacttataggatatgttttagggtcagacaaatctgtgttcacatcttgccgctatcactcacaaacttctagaagcctgtttcctcatccattaaacaaggatagtcatagttcccacctcatacgatttttgtaaagatcaaaagagatactatatgtcaagtgttcagtactgtgtccagcacatagtaagtgcacaatacggtagctgtttaaactatttttatggctctcattattattattattattattggtgtatctctaaaggcaactgagattcgttctctagacggtcagtggttagtcttaagagcatgtcacaagcccaggagcctaaagagacctgcaccccgagactgtattgcagctgtcctctacctgcccaccaagcactggatggtctccgaataaaaacacattatgcatgcaatttgtgtgctgccaaaagtggcatccatttatgtacacagttgagggcactgatgtgagcagaaaagagaattttttacacagaaatgaatgtttacacaaaactcaaggattttcgggaaactagcaacattggctttgtgattcctggagcagggatagataggactgaaagtattttgttgttaggggacactgtacctgcatgttagcatcctgaaggatgggatatgtaaagtaattattatactaggtttaacgttgcttagattttaaaatgctaagcttaaggagaggagtgagcgagtggacaggagttactaggatatggattagctcttacccttagcaattgatagaaatgccaccttgtcttttctttcttactgtcctttggctctctgcttttttatatctctaagcctgaaagttctgttagtaacaatgggaactttaaagctattctcagttgaatctaaggaatctttttaccatttccccaaaattacccaaatgagatttatgcttccttatatcttgcctttggaaccccattttggtctttaccactgtaaggatagtgaagaagtgtatctttgagagcaaggcttcaaaagtcagatctgtattgacttccttctgactgctaagttttaactgtttccaagtggggaattaaaaagttagcattcagaccacttttaggtgctttttggaagggcattgtagcagaatgtgtttcctttcctccatgcccccatttgtgagtcagatggagcttgtctgaatgcgatggtgttctctctgtgcttttacttatttgatacatgatactgggagaggggaagagaagaaggatgtgtaaagacagcaagtggggcctatttgcttcaaattctgtgaaaggtgaatttaatggaacttaattgtcaatggtgcagaaactttagatttaaaggcatataaatccaagcaacgctcaccgtagcatctaaaatgcaattaagctaagtaaataaaggcaatttaaatgtttagccgtcttttacacaggatatttacttcctgaaactgcttaactgcctttcccttgtggtaacgaaagtggttggttcatatgactctcttcccatgatcctttgtcacaggtcctagtgccaccaatctcataataggctccatcgctggtgccatcctggtagcagctattgtccttgggggcacaggctggggatttaagtaagcaacgccgcatgtcttcttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcaggcaagtggaaatgtagaaggaattcatatacactgatttttaaggagaacaacgaagttctttggtagaagacagtccagcttgtaagagcaggcactctgagatacattcatttctacacaggaaatcgaggaaaccatgtagttggaaataagtggatgtaaattgcttgtatctgtttaaaacttgtttgtagtccactgatattttgaaattttcacaacctaagtaattatgcaatcattacttgtatttttcatatgtaacatagtatatgtagctttgtgatttgaaaagctttatagtttaatgaaaacagattttaaaagtatttgtataatcctcgaccaactgaattggttttaaatcagaatttgaaaaatgtggctttgtgacacttagtattttctaatcaaggactaaatattgacctgacaggtaggcctggtgtgttttcatagtgaccttttagtttggattgcacactgcttactgaactaagattgtttaaatagacacactgggtattcacaaataaacttcaattgtgatcaaaatttttaaagctgatttatccaggctggctatttctacactccagaatcattggataattgctttttataccttttcatgctatagtgagttgatgattatgatttgtaggtaagccctcctgtgcctcctgtgataaattttcagccagattcacagaaacaaatttaagtgggaaataagaccattacccaaattcaaaacccactttgcctgcatctggttactcaaaagaggaagcttttgccctgaactatctgaataattgccttaattataaactttatatgttttatatttgggattttgaattcaatatgtttcagccagttaaagtgttatttttagaagctgattaaagaaaccaaagatgatttaaatacattcaacattttctgctaatttgttatcatattaagatttattgagtaagtctacagttttggagtgcctttaacttgaaatagtattataaaattatacgtcttttctctcggtatatttgtagagttgaacttgtttagtaatgtagtcttggcatcagtgtgttttcaaaaacacactcataaaatggacaactcatatttaaatttattgttttggtattaataaaatattgcccacatagtgagtcacgcatgtggcatctagtaagaaatatgttttcgtttgggcggacctaattcaagcaaaacttttcttagtgttccactgctacaaaaaagtcattgaacattatagtactgccatactcttattattttataatgcttccttgaactttttcattagtatgcctcaagaaaaataaatctggatcatgcccaggcttatgcctcatttggcgttaagaaatcccggtttcaaaggcctggaaaacagtctattacacgtctttgccgtctagccatatgcaatgccaaatttatcattgcagtgtttcgagagaagagcacactattctgtagcaggacctcaaaacagtggcctggcctagctcacagcttgaattgcatgtttctttggggaaaaatggaaaagcctttatcactgtgtatataagtggattaggccctgtaaagattctttatatctgagagagagagagatctcgttatcacaagaacagaaaacaaaaggtgggggatcagcacttagtgagatgagaaacagcctttgctgactgctgcctggttgttgctgtgtagggacctgtactgctgagctgagtcaaagccccttcctgtgccctgtaactctgataatcactttcagggagaactgtgtagaaagacacacaatagggtgaagtatttcatgccccgaagcaaagaaaacgatgaagactaagaataattccagaacatgtaacttcaggagtttaaatttggagaatgtgctactcctgggtgactgttggttgctacatgaggaccttaatttgctttagattttagtagtaactgtgtggtttgtgttcagctttaaataacacttctaccttgtaataaaaggcttttggtgctgaatgataatgtttagattttcccaccacttggacagttctggagattactagtctggagataattcgtaagtataattatttgctatttgaactgaaagcctttgggtttgagttcaatgtaaatgtttaaaaagaaattcctttagaatcagaagttgaaaatagtttgtacaaaagattgttctaaatgctgctattgggaatccctcctgataccaggtttttatttctagaagaaaagttggtaaggtaacctgaacaatttgagggcatgtcaactttttgattaaaggaaaatacagtaactactcagggaaaatactatattttcttaatgtcacatttctttaggtgtactagtgagtagtttagatgtagaagtatcatactatacgtgacctgcccaagtataaatgagaaatacagctatgctctaagccctgaccttgtctgccattctttaaagttctttccttaaactattatttcctctgaaataggtggtaaaaagcatgaaaatgtgtgcatgtatgtgaatgtgtgcacatttgtgtgtgtgaagtgataataaagatgtatcaagattattataatctgaaaataatactgatttaaattacatacttccttttagtagattagttgagtcagaccgctttggttaatgcaagcaagacttccacaagcaaggttgtggatttcctgaagaatttttaaatgttttatttggtagatttttaaaaaatattgtcacatattgtgtaatgttatgggtagtaactttgcttaatttctttttctttttttttgagacagagttttgcttttattgcccaggctggagtgcagtggcatgatctcagttcaccgcaacctccgcctcccaggttcaggcgattctcctgcctcagcctcctgagcagctgggattacaggcatgcgccaccacgcccagctaattttgtatttttagcagagatggggtttctccacgttggccaggcaggtctggaacttccaacctcaggtgatccgccagactcggcctcccaaagtgttgggattacaggcatgagccactgtgcccagccaactttgcttaatttcatactccagaagtatgaggttactaagggtatgattagtcgtagagtcccaggtattgagggtcttaggaatttctctatgaaatcctgtgaaaaacgaacataggcatgtggcacaccaatttgctctacttctatatctgcatttattttcattcaccccatgctcctgttcttccccatcacccacacacaagaataaagttatgagctgtggtgcagaggattgcaaacctctgtcctagttgactcatggagactcatgacacctacccaacattaaatgatgatactgcttgattcgactgttagagctgttgcttttactggacattagaaaaagcaggaccattttagtagcatcttccctaaagcttaggaaaggtgaaaagtatatgaaaagagaatttcatatctccatttaaaagtgaacaggattgtcttcagcaccttaggcgttgctatttatctgatattccctaaatttgaatgtagggttttacatgcacattagtaggtgatggtggtaggaaaagagaaattctaggtgatggtaggaaaagaaatgaaggtaatagtgacatggtttgttgaaaattgaaatcaaaaggactacaggatgaacactgagcttttccagtgataccgtaacacctcagtctgtagaacctcatcaccacgtcttactctcccgctacttgccctgtccatgggattcagtggcaaagtggatttcatcagtggccatactggcctggcatagctactccttacattaaaagtgttaatttaatattaataagtctgtgtaattatcatacgtgattccttctctctgagaagttatttgtgttaaaagctcttctgagcctgactctggatttaagagattctgtctggcctacgttccattttattggacatgttaaagaaaaggctgtttatgtactcacacaaaatgaaaaagagctatatctagactattaccagcaaagttaagagttatctgaagctgggcatggtggctcatgcctgtaatcccagcactttggtaggctgaggtggacagatcgcctgaggacaggagttcgagaccagactggccaacatggtgaaaccctgtctctactaaaaatacaaaaattaaccgggcatggtggtgcacgcctgtaatcccagctactcgggaggcagagacagaatcccttgaacccgggagacggaggttgcagtgagccgagactgcgccattgcactccagcctgggcaacaagaacaaaactctgtctcaaaaaaaaaaagagttatctgaatgtcaagtcagataaaatttgaaaggaacttaatattgttaattatattttctcaaaagagtaaacaccattttttgtgggggccttttgatttttattgaattaggaaattgaattaaatttggctagtctttccacgaggaggataaccagactgctgtttttttgaattccatgactgtatcccagttcaaaatgagaagcctgattcccttaatgcctgggactcctgggttaggcactttctctttcatggtaccaggctggccaggaagatcggtgcatttccctgccccagcgccccagggaagtgagctcagtgtatggtggcctaggaggggttgggctagggacacttcgtcagggggtgactcagcatagaatgataagaatgtgctaaccatggataaatatatgcccttgaaagaagaactaaaggctttacggctctgagacggttattgttactgaaagagtcttgctttaattttgtgtagatgttatgtgtataatgtatattgtagacaaaagtccagattatttcagaagtagtaaaaatggatgaaagctgtgaaaatgtaagctttatggattatgctagtgttttataatgatccagaaataccttacaggttatgagaaagttaattaccttcagaatcctagtgagcggagggtattcagaggaaaccgttatgaagaaagtcagcaaggacctgcccgcagtagttgtactttcacattaaaattgaactgaaagaatatttttttcatagagaaaattcagaccgttctcaacatacagtgactgtgatggttttacaatttatgtgtgaggcaccttcacagtccgcttgccacaggagtgttcatctctgtcctcatcgcagtgtggcctcccttgtagaggagctcactttccccctgctgggacatcagtggaagagctaaggtcctggaatgccccattggtgttcagagtccattttcatccagaaagatacagttctgcaggatggctcagcctctctgtctggcctgggaacccagtgatcctgtagagcaatatttctgcaaaaaggtgcaacctaagcttcaaaaaccagcttttaaaaagagcacaagcttttggacaccagcggttgtctgtgtgccaggctgaaatggaatttcctatctccatttaaaagtggactgcattgctgttatgaccttggacatggctacttatcggtcattcccgaatttgaataaaggaatttagatgtgggcaacatgcacagtgctagcttggtttgccctttcctctacatttggatttactgaggaaatttagtttaacatttatcttgagttctagcaatacatagctcacaagattggggcctcttgtccttcagggtcatttcacaaggtcaggcagtctctgtttttcctccctgactcacagagtatggctccttaaacctctaccttccagggatatgaacataggtggcagatggagaccctgtgctctgcagcaaactaacttggtggaggatgcattatgggatacttgccttttggtttcacattggtttcttgggcagcatcagcagtgcccgctttcaagaatgttgacttaaaagagggctgggtgggaatgatgaagaaaagtaaacagcattgttgcagatagtgttggctgcaatggttacctgctaggccaatgagtcacacacttaggtcactcatgaagacgttttaatgtaaactttaaaaagaaaagacaagttttctttaaagacttttatgttgatatttcaaaagagaagcatcaaagtgaccatcttgggaaaaataagaactttgcaggatgcctttatacctattttgagctttggtattgtttttattttgaattacttgtgggggaggaggaatatatcgcaatggctttgatacttagggcctgtaagggtatccagctggccctcagtcggtgggcaggggagtgagggctttggggactcctcagtctccagttttgcatgatgcctcggtggcagtagcgttgcacccgcccagtatgcagactaaatgcatgagccccttgcttgatgccccacataaagccagaccatggggaggttgcaaccaacttttactgttgccttgtagtgtcttgctggttctttcttttctctttaaacataggagccactttttaggagactggacactgtgagcaaagcattttaacttgccgattttcaactaagctaaattctgcatttgcttaactaacctgaacctgtgtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgcccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctt

SEQ ID NO: 17075 - DNA, 129778 bp, Human; identical to SEQ ID NO: 12191
  misc_feature (1)...(129778): n = A,T,C or G

SEQ ID NO: 17076 - DNA, 9562 bp, Human
cagcctcccaagtagctgggattacaggtgcccaccaccactcccagctaatttttgtatttttagtagagacagggttttaccatattggtcaggctggtcttgaactcctgacctaaggtgatccacccacctcggcctcccaaagtgctgggattacaggtgtgagccaccgtgcctgacccattatttttattcttattttttattttcctttgcatcattttgtttttctttttttagtatatttttaatttttgtgggcacatagtaggtatatttatgggtatatggaatattgtgatacaggtatacaatgtgtaataatcacatcagggtaagtggggcatctatcacctcaagcattgatcatctgtaatacaaactatgcaattatactcttatttttaatgtacaattaaattattgactatagtcaccctgttgtactatcaaatactagatctaattcactccacttttgtacccattaaccatcccatcttctcccccacacacagaccctccctattactcttcccagcctctggtaaccatctttctattatctaactccatgagttcaattgttttaatttttagcttctacaaatgagtgagaccatacaatgtttgtctttctgtgcctggcttatttcacctaacataatgacctccagttccattcatgttgttgtgaatgacaggatctcattatattttatgactgaacagtactccattgtgtatacataccacattttctttatccatatatctgttgatggactcttagattgcttccaaatcttggctgttgtgaaacgtgctgcagtaaacatggaagtgtggatatctctttgatatactgatttcctttctttggggtatatgctagcagtgggattgatggatcatatggtagctctatcttcagtattttgaagaacctccaaactgttctctgtagtgattgtactaatttaccttcccaccaacagcatatgagtgtacccttttctccacaccctcaccagcatttgttatagcctgtcttttggagaaaagacattttaactgagatgagattatatctcattgtagttttgatttgcatttttctgataatcaatgatgttgagcaactgttcatatgcctgtttgtcatttgtatgacttcttttgagaaatgtctgttcagatcttttgtccatttttgagtcagattattattttttttcctatagagttgtttgagctccttatatattctggttattcatcccttgtcagatggatagtttacaaatatttactccaattctgtgggctgtctcttcactttgtggattgtttcttttgctgtgcagcaccttttcaacatgatgtgatcccatttgtccaagtttgctttggctgcctgtgcttgtgggatatttgaaagaaatctttgccagtccaatgtcctagagagttttcccaatgttttcttgtaatagtttcatagtttgaggccttagatttaagtctttaatccattttgatttgatttctgtatacggtgagacataggagtgtagtttcattcttctgcatgtggatatccagttttcccagcagcatttattgaagagactgtcctttcctcactgtatgttcttggtagctttgttgaaaatgtgctcactgtggatgtacagatttgtttctgggttctttattctactggtctatgtgtctgtttttatgccagtaccatgctgtttgggttactttagctctacagtataatttgacgtcagatgatgtgattcctccagttttgttctttttgctcaggatagctttggctattctgagtcttttgtgattccatataaattttaggattgttttttcctatttttgtgaagaatgtcattggtattttgatagggattatgttgactttttgtttttcttacacagactttctcatattctcttttccctttcttcttctctcccagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggtgaggcctaagagacacctggtgagtgcttcgttttcagagcagggaatgggagaggaccacctctggattggaggggttagagaaaggaggggtttacctctctccatgtctaatgtaggaggagaattataagttaaacccaacctcattccccaggcgtaggagatatgcatgagaaaatgctgcaaggattaccccaccctattacttggtttgcatgggggacgaataagctgtctttctctgcaggagaagctccaggtggcattaggggaactgagaagaaagcaggagttggctgagaagttggaagtggaaattgcaataaagagagcagactggaaggtaagaatgacatcctgaaggagatcttaggctggaaggctgggcagggtccagagtcctcaactcacagccttaaccgtagctgtgcctctctgagcagtgatagagttggtccgtctcactctccagaaaccagctgctctctaggtttacaaatagaggggaataaaaatgatgcaggttcaaaggggagctccccatcaggcctgaagatcaagaatcctggaagaaggtgctgagaggatctagctataccctaaagtttcgagctcctctgagtctagtctcagaggtgtgatggcgtcagcacctggatgtgtgagacaaatatcctagtagaaacccaactgctagctaagcctttcaggaaatgacaagggctgtgaggaataaacttaaggaaaccatctgaccaggtggttacttgaccatgaccagatctctggtccaaaatataatgaagaatcaatgtttgttctgcactgatgatttcctaggagaggtggggcatgtcagggatgagaggggagaagaaggagcccatccccagtagatcacagaagaggaagatttgggattgaggtagggtgtgagttgggttgtggtgacaaaacagaccctcatgtgtcatcgagtgaccttccagttactaacaggagaggaaaagcaaagaatgtccccaagccccctttcccaggacttagaggtggtggcgtgagcctggctttgtgaggttgttggaggtgggaacaggtgatttttttctcagtaactcactgagacaggaagacacaggggcacatttgagtggtgactgggcttggaagagaggttggaaaaagtccccaatgccatatattcgtgtagctgtcgttgtaggccagctacagtgtgccctcaccaagtccattcccctcactgtcccagaaacctcaaccacctacctcccaagcaaaactgtgtgtgtgtgtgtgtgcgcgcgtgtgcgtgtgcatgtgtgtgtgttttcccagacagcacagagtggagtctcttggggataggaataggtaccaatacctccattcccaaagcttgggagattttcataaaaaccacctctccctttcccttgacactaaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggtgagacagggaggggttcccttctacaattcagggaataactgaaaaagaccagagctatctggaactgccatttgaataaatggacacctggtccctggaatgttcttaaatgaagtagaattcaaacccatgaaaggttcgcgttcaagacgcaaagtaaagatgaaaataagtacaggacctttttaaaaatcaatttatgttgcacttagaatcatcttgcatccaccaatgatatgtttgcctcactgtaggaaactatggactagatggtctcacaagtcccttctgttctaacattctacagctcttttcccacacctgttcagtgtcactcagagtggtcatgagccattgctttcaggtttgtgcagaaaacctaattgtattgggttgacttgacaggctctcttctgcccaacattgaaccaggctttctatttatttatttatttatttatttatgagacagagtttcactcttgttgcccaggctggagtgcaatggtgtgatcttggctcactgcaacctccgcctcccgggttcaagcgattctcctgcctcagcctcacatcaccacacctggctaattttgcatccctagtagagatgggatttctccatgttggtcaggctggtctcaaactcccaaccgtaggtgatctgcccccctcagcctcccaaagtgctgggattacaggagtgagccactacacctgtctgtaaaccaggctttccaacacacttttgactgagtctaggagcctgctagctcccatgtaatggcgcctaatccctacgacaaaaatattctcagtgatttggtttcacatacaggaagaggcaacattaagtacccaagggagctttaactaaccaacctttccttcccaaacaatgctagcccacaagtggaatagagtggtttctggacacctgaactcggccattctctgcctgtgattgtttctgggcttaagccaagctgggctatgtgccctctctgccctcctttctttctcccctggggaaaaaaaaaaaaaaactggtctttgagtcagagtcctgaaactgataacccttccctagccataggtcacatccatgctgggcttctggttacctcacaagcagccacacatcctttctgctttgagctggtcagaatcatctctggggcctaggaccagaggaaggagaggaacagtgccccagggaccaaagatggatcacatcacccacagggctgatgtctcagtggcgatccagcaatccagaacttactttctgtctcttttctcctcaggaggtgataattgtcctggaaaggtaaggaggagttttctttgttagaagaggggccagcagaaagcatatatgcctatgacaaaggtgattgaattagaagtacatgcactgaagttttccccatctggcttcctattctcaaaaacttcattctctataaaatattttctggtctcagaaagctaataaatggacatctcaattggtgattgcccacagtagttggatcataacatcttcacacagtaaagtcctgccaaacagggaaatcctgggaagttctgggtcttcccggaattcagactactgggacatggcctgctgggactccttttctcagtggaatctaaccagttacctcccaaaaagagccatgagtaagacccacagtgtgggcaagactccttgaggttccttgcagaagtgattcagcctgtctcagattgcttgcctataaaatgaaattgaatgcatttgccaggtgacctcaggcttagacaggagagacagactgtccacatgctgcagagcctcctataaccaggaactcctgggtagaaactaaatcctgcattgtttgcctctcacacccactcctggagacttgaacaccagaggtctttgtaaatttgagttgaattaaattatcggagtcctccacaatggaggttatagtgttagggtttgggataggagtaggagacaggagtctcaaactctctttcccccaggagtgagtcctggaacctgaaggacctggatattacctctccagaactcaggagtgtgtgccatgtgccagggctgaagaagatgctgaggacatgtgcaggtgaggcaagttctagttttgcgggggataatggggtgcagagtagatcccagggtcagggagcctggatggcaacttggaggagagatggcaggtcagagcagggggaacagagatggaggtaaggaagatggtttcttcagaggtcaggaccaaggccagaactggctgatggtcatttcctcacacagggaggttcacccctcatgcttaccctggagtttacacaaaatccccccaccacaggcacagacttagtgaactccccccatgcaaggcctgactgtggtcctctctctgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgcctccgtctatcccattcagtccttgttccttaatcctgaaatacttgagaactctgaatatgattaatagtgatgtgtctttaacactgcacgtgcttttcatgcctagactgtcccatttgaaatgtttgatcttggactgaagacccaggtcaagtcaagtcttctgtacttccccatcattgccttccccatcatagccgctgtggtgatagaaggccatttgggctctgatcgctgtccgaggggatattacctccttaccatgagggaacacctgcttttgaaatacaaagttctcctggggctggagtagctctgtgacctctgcatctctgaccctcacagacctgaagcaccttctgtccatgttctcagtaagtgacgagtgacaacatcaaagttcttggagctctctggggcttccctatgctttcagtgttctagacaactggccaattcctgtgccccttggaatatccagttttaatgttatttctctctggaatgcacctttcttgggcaaagttttcggacttttccagaagagtaaatgttacatccgctaagggataaagaaaaagggggtgtgtgctgtgggtgtgaccacatccccaatcatgaggaagggatttggagcctgaagaaatgtgtgtctgtgtcagcatgtgctcacattcggcaggtgaggccatgagtattaggaagaaagggaccatcttgtcttccagaagcttccactgcagacgatgaggtatcctttcaggcaaggtgaggagagactttgtgtggaggtaagaagagaacacagcagcaaagagtaagtgaagcatggcttcatcttcttcctgtctctatgaccaggctacctcccctaaaactcctgccccgggccccacgcctcctacttgaatggtttggacgaggaaagaagaggttgaaaggatatggaaagaaagccaaacaaaggagctgtctaagttcctggacacagccactaacaagccctctctaacatgtgcagctcaggcctgtgccccagggctggggctttgggatgggaagacagacagacagaagaggagcaggagctgtagcagggtcaaagatgcgtctctgggaagggaagggcccagcatctgacagcttctgcagacagatccaggagcgtgggggtggtctcaggtgtcgaagtaaaggatgagacatagactccctctagagtgtccccataagtgggtcgtggcaactttcttctcctaccttctttcaaactcagagcatctctcattgttgccacttccccctcggctctctctgacagaaaaagccattctccctgttcccatccctttccttccagatttagacttctcagccctggatgattctgcctcattccacccaccctaacccctcttcctttgaactactccccaacacacacacagacacgtgcatgcgcacatgacacatccctggctctcaacccaccttgttcttggcctcaactttgacctagatctcagagggctaccagtagatcctgtcaaggtcccaccatgggggtaaaggtcaaagcatagaagcctgtggagctggtctccctaagtctcttgcaggaattgtccaagcctggtgagggaccgcaggtggggaggttaaggtgtggaaggagctagagggagttagtgcctgcccaggggagtgtgggtcactactctttcattatcacattagcaaatatttagtcagatgataatactcaatactggcaagatggacacatttatccttgctggttgtgatgtaaatggatgcaaacatttctggaatcattttgtcaatatgtaataaaggcctcagagatttccatattatttaatttaataatcccacctctgggaatctatcctaaggaaataacttgacattgggaaatagccctatgcataaagatattcttcaatgaataacagtgaaaattgg

SEQ ID NO: 17077 - DNA, 10201 bp, Human
  misc_feature (1)...(10201): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcgcaggggggccgcgccccggctaggggtctgcggtggagcgtgccagggagcagagccagcggcgcggcggggtcggggcgttgcgtctgggaggacgagcctcctccctgggtccccgatccccgggcgccttgcgcgcgagcaactcttctttgcagccagtttgcagccgggattctagagtatcccgggagcagcactcggaaggcggggaggaggctgcttctgggaacgagaaggggtggagctcagcctttcggggtgctggggggtgggtggtccctgaggtgctcactctgggggcccgcaattgaagccgggcaggaggcgcagctggggcgcatcctcaaagcctgaattccgcgcccgcctgttgctggaaaaggcagcttccttcgctggagggggtgcgccgacccaccccttcccccttctgcctgggcatcacgccaggctggaggtgagcgagagcgggaggttcggcggctcccgcccgagctgggcgttggcaggggttgcggggcggtgtgggtcgcctcgcgcctccccgagtgatgggatcataggggacagagatgagggatggaggattcccatactggaagcgcccgctggcttattttggggaccacattcaggtgggaagtgcgcccgggcacctcggagcgtttctccggatccgcctggtagcagggcgctctcgggtccacgctgcccttgtatggcccgcagcggtgtcgcgtgtttctcttggctcccattccgccgtcccagccgctgtccggctggggaaggggagggctaggcaatacccagctcgctggcctcatgcccagtgccaaccatgtccctggggtattccaggctactgcctcccaggctgactttatttctggggaaagggctaaatcgggctccacagttgcagccggtccagctccaccctgccctgctcttctagctctgggaggagtcaggggtctgaggctctgggttggagaccccaccttccacctgccctccttgtccgagagccaaggtaacaacccaggcatcccagagcccaggcagatggtgtcgagtgacatcacctcctcacagggctggcagcacgctggcaccactgacgtcactcctgcccactgcctggcccttgccctgacccctgggggagactctgacctctccatccttaccagctacctagggtggggtccgcgggtgtgtgcggagtgttcatggaggtgctgctgagggagcatgagaccggaacttccgccagagttagcccgctggggagtgagggcagggattttggagggcagagggtagagcagtggtgtcttcccctggcggtggtgacacaaaagggcctgtgtgccccagcctggcacatgctttgcattcccacactctgagctcacccggagaggagggggcctggaaggaaaggggccttcctcttggccccgagcctaggttgcccctttctgcccctctaccagcctcagctggagctgttcggtgctcagtctctgctcaatctctgcttggctccaaggacctgggatctcctggacggggagagggctggcccaggtggggcgcgggtcggggtgggggtagagcgttcagaggacagggccctctgcagaccctctgagtggcaggaaaaacagctgcagcagcgctgcgaggggaggggcggacagcagccggagctgacacagctgcgggggccccgcctccctcccccaggtgtgcccggagaggctgagcagcctgcgcctgagctggtggaggtggaagtgggcagcacagcccttctgaagtgcggcctctcccagtcccaaggcaacctcagccatgtcgactggttttctgtgagtgcttgggctcctgcaagagcagcccggggagggagactctgcccctcttgtagcccaggacccttctcctcctctgtgtctcctcccattaggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacagtgcgtgaccctgtgtctgccagcagggtagtgagggtggtgggacgtggccagatgtccccctcatttctattttcttgtagaagctccggaggagccaaacatccaggtcaaccccctgggcatccctgtgaacagtaaggagcctgaggaggtgagatgtgtggcaggtgggctgggcagctggtgcgcagccgctgagatggggcttgaagggggctcggaggcagggagactcacaccctgtgctctttaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttcaggaccaccttggacaacatagggtgaccctgtctctacagaaaataaaaaaattagccaggcatggtggtgtgtgcctgtggtcccagatacttgggaggctgaggcaggaggatcatatgagcccaggaaatgaaggctgcagtgagctaggattgcaccaccacactccggcctgggtgacagagcgagaccccatctcttaaaaagagctgtccctatggtactacacaggaactgccttatattttcattaagcttttaacttaaaaaaattatacaaatggtacttgaaaatattttcatgagaatttaaactgacaaaaaatctagaagtttcttcttgcctgagaccccccctcccagaaataatctctgctatcagggtgtgttctttcaagcctatttctatgtatttgctcatatatagaaatatttctagaatgatataggcttctgtgttttattatctaaatcagtcattcttaaccaggggtgattttgtaccccctcctcctaggagatacttggcaatgtctggagatatttttggttgtcacacatagagggggtgctactgccatctagtaggtagagagaccaaggatgttgctaacatcctatagggcacaggacagcccccacaataaagaatcaacgtggcctaaaacatcagtagtgctggctgggctcacgcctgtaatcccagcacttttggaggccaaggtgggcggatcacctgaggtcgggagttcaagaccagcctgtccaacacggagaaaccccatctctactgaaaatacaaaagtagccgggcgtggtggcgcatgtctgtaatcccagctactcaggaggctgaggcaggagaatcacttgaagccgggagggaggtggaggttgcggtgagccgagattgtaccactgcactccagcctgggcaacaagagtgaaactctgtctgaaaaaaaaaaaaaaaaaattatcagtagtgctgagaaaccctggtctaagtggtggtgtatggtatacattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctgtgagtactaacctgactctctgcttactggggctggggctgctggaaactcctgctggctcccccttatccagcccagggttgactcatgggccaagagctaccccctttgcctatgcagacccgacagaaaaagtgtggctggaagtggagcccgtgggaatgctgaaggaaggggaccgcgtggaaatcaggtgtttggctgatggcaaccctccaccacacttcagcatcagcaagcaggtgtgggggctttgtgctgggtgcaggtggggatgcaagcagagacccaggtggagtggcgggaggtgcactctgctcacctccccaatcctccctagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactgtgaggggctggggacccaggacagggggaccaggctggggcaatagggaactggccccaccctgccctgggtgacatgattgctgtacccccagatgtgtctgacgtccgagtgagtcccgcagcccctgagagacaggaaggcagcagcctcaccctgacctgtgaggcagagagtagccaggacctcgagttccagtggctgagagaagaggtacccaggcgggtctggggcaaggggctgatggggtgggtggggctggcggtgacaagaatgtgctctttcccagaccctctgacccatctctcatcccagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggtgaggccctccctctgggtagagaccaggtcaccccaagtggggtggtttttaagctctttgacaaaaagccacctgctgccctggggagctctggtgcggagggggaggcaggctagctgggcttgccacctcacctctccctacctccccaaggccccccttggatggcattcaaggagaggaaggtgtgggtgaaagagaatatggtgttgaatctgtcttgtgaagcgtcagggcacccccggcccaccatctcctggaacgtcaacggcacggtgagcgggtgtctcatctgccacactctcctaatccctgcctgcgctttgtggccaggaccagagatcctccccatcccctgagctgcctccttcctttcctcgcaggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctgggtgagggctgcatccctgcaggggatggcaggggcaggcccaggcacgggcagtaacttgcgcttctcctaacacccctccctctgcctcctagtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctggggcaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatgtaagcccaacaccggcccctccgcccccgcccgttttgccacccagcctgctgcctgcccagcgcccgcctgccccttgacagcaggagtggggccctgggtcagggtgctgcctgctccactacccactgcccagcttccatcagccacatggtctcatgacctgcttccctgccctgggctggccctggagcaaggagccctcatccattccacatccttcacagcgggcccttctcttcctgtggccctgagataccaacctctcacctccctccctcctcccagcacgctgcccccgtctcgtaagagcgaacttgtagttgaagttaagtcagataagctcccagaagagatgggcctcctgcagggcagcagcggtgacaagagggctccgggagaccaggtaggaggcggttcctgtggccagagcctgccacatcctcagggaccgggggcagtagggactaacggttctctctatccttcatccctctttgtcagagatagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttcctctcggtgctcacaccttcaactcagcaccgtctccgtgttcccctcttctcctctacccacttttagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgtagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcatacattgctttttattcatcatgggtaccacaggaacctgggggcctgtgaaactacaaccaaaaggcacacaaaaccgtttccagttggcagcagagatcaggggttacctctgcttctgagcaaatggctcaagttctaccagagcagacagtcaccctacttttcagcagcaaaactgccctgatgacgcagcacgaagggcctggcaggctgttagcaggagctatgtccccttcctatgctttcctgccacttggaactgccctccagacagcagctcaggctcaccgccatgaggaagggggccttggcatttggtcctacggcaactcgagtattgcctcccaaccccctgaatgagcaagaactcaagtctgctacaacaaaagaaactttatttaaaaatatttttttacagacatgggtgcttgaaaaagctctttagttaactaactgtgtatggaaatgaaaaaaaattaataaataacattagtaaaacagacttctaaacattaatacactggcaaaataaaatggacttaaaatgaaaatgaatcttaaagctctgctattctctgtaagaatatttaccttctgtttttcttattctttacaggtgagaatgattaaatactgctaatataaattttttatattaatgacacatttttaaaatagtccacgaaaatctcacctatgtgtttgttttgttttcttcttaacactgatatacaaattgggactcttcattctggagaaagcatcaggttctctccagcactcccaggctaagaatttcaaaatcttgaataaggaggactttaaaatttctgtctcccaattctttattagttaaaggcaggggaaaactgaggaaagggtaaaagataagtaagatgtcattatatagaaaaacttttgctaaagctcactatagtcacattactgaggacaggcttctggtcccatgttccttgctgcccttccctggggaaaccaggccctgcagagggcactagctgcttaatgctttaagtctgaagccttcaaatgaaaggccagccacatctgatgggggctggggggtgggggcaggaggtctagaccagttcaggatccagcaaaaagaaaagacaaagccaccaacctccccttctcaggagagtccatcctatactcctcgacacaactaggtaattaatgtcatcagaaggctaggacacttggaatggtccagagtttacctgggaattgtgaaacattctgtcttttgcaggagacaaggcatgcaacctgataactaagcttgtgattggaaccaaccaaatgatcccagggtacaatgcttctctcctccactgaagtctcacagcaggggaaagggactccagacacactgcacctgcatgtcacctctccagtcacagagagcattctttcctgtctcctagacactaaggact

SEQ ID NO: 17078 - DNA, 123463 bp, Human
  misc_feature (1)...(123463): n = A,T,C or G
caacatcagaaatgactggtcttctttttaaaacctagaagcttgttaatacctgaaacccaccccagacctgatgaattcataggggcttaagaatctgcacattctataaactctctacatgattctgttgcaagcaaacgttagagagtgaaaaatccaaaccttttattttatagattagggaaacaaacaactaagctgtaaaagagaaccccctgcccaacaagtgagaccacatagtaggcatgattttacacattacaatttttttttctccaaaataaaattttttaaatccagcaatcagggtggatatataatcttttgtataattgcctatgaagccacaaacaagtaatacatgtgccagtaaagttggtacagctgacctacacctaaaaatagcccagaaattcaaagaccaagttttcattccaaaattttttattttggagaaaatagaacgcatatcctttgttcaaagagacagctaaggaacaacacaggacttcaatgaaaaatatgttgtttatgtgtgtagttactagtcagtatgccccacctagccacaaattagtgtggttactctaaattgctaacatgaaaatcttaacctcctacttctgaagttatttggttttagctactcaatttttttttctaggcttccaaggttgctgttttgggcatggttttagaaatataattataagtttgatttcaaacttctggaccatgtaatcaagcacagactggtcatagtggaaaatatacaatttttagctctgcctacattgacaaaaaaaaaatggctggatccacatcaattcaacttgagtgccatgtgtttacagtgacagtttctccccgaaaacgcaaaaaaaaaaaaaaaaaaaaaaagaagatccatgctgctgtagtatatgtacataggggtgtttaaagccagcccctccagcagcaccttaccaaccatgtctgtgcttttatttattgatccaataagatgacttaaatatctaactccttttccacgtaaaagtttttattatgtgcaatgcattgttaaacaggtgaagaatgaacaagtttagaaaaacaaagaagcttaacatggaaaattacccgcatggtgtccacttttcctgctcggttgcaatacccaatggattatttattaatttagatttgtgctgtccctgaatccaaacagcagcctctttagagtaacatctgctccagacattgctccaggaatataaatcccgactaaggggtggatatttaaagctgtaaatgattttttatttttacaatagctttgcaaaaggaacggaggtgtcatgtcatcatcagagttttcttaacaggatttaatcttaatgccaaactaaatcctttgtctaaagcatcagcagagttgtacttattttccccatagtattaaagaggagggctggtgcaggcacagccatatgacattgccttatctattttgtctgtttgttttctggaagaatctaggaatgtgcataaatacaattaaggacagtatctacaaattggaagaaagcatttctattctcttaaacctctaaatcaaagcacttaatgttctgatttccagcaagaccttctaataaatgaaaacccaacccttgggtttgtgttttgactcttgatacaattatgaaagacgcatcaggagatggcaagtggctgccagtacttccttttttctggaatattctctaattcttggtgtatcaagatggaaactggtaggcttggaatagatgtccctttaaaaggctccactaacaatacaagaatattttttccatacgcagtgacgtgggtgggtcatgggtgtctcaatgacagtaacgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtaagggcgctgccccctgacagccctgggggcatcccggaggggggcggcagagggtgggactggtggcggtgggggaaggagggagggatgggcccaggggtgcctcttggtaaaaggtatctaaggtggaaggtgggaagtggagggagggatggaaatggggaagaacccgacttagagcgccagtggcccaatttctgctttcccgtcccatccccccagcaccaatcccatctccccagaccttaggccaccctctagtaagtataggcttgggaggctggggtggcgggggatgggggggatagcaatacagaaaaaacaaatcctgacgcacgcaaccccagcggtcgctctcactttgctgtgtgaaaaacccaaaggaatgattgcgagtcccccgcaaggggggttggtcttccttgctgacaagagtagaaagataaggtgcagaaggcagtgattgagaggaaaggagaacgagggagaaagagtcatttatcatgttttctctaatttccagaggaccagtttattggctctgtgtacccatctctacctgtgtgtgtatacgtattaggtacactcgctgctgtggatgcttggggaatcttagggatattgccaatctggggtggtggtgtataaagatacgttggtgcccctcctcctaccagggtgaaaagtggtttctgacttttgaaaccagattttgaaactgcacaaggcctttccaaggaaaaaggagtattccattttctctgctataaccatttgagatgaatagtttgtgatggggtctttattccaactgatgttcccaaataaccatctgtattcgtctttcctaggagtatattaaagcaccttttggtttatgttaattgtgatgcatttagtattaataaagaggtatttaaaaatgttcttgggacttttttcgttatgtttctgcttaggaaataatttgggcctggtcttctgataatcaaggtacagctaaagtaatctgtgctaataatatcagcatgggatggatgcttaatttttgtttaatgacaaagcaagcaagaaaagtaggctaaaaattctcagtgcagggccagtatagttttataatgatacgtaagaaccaaactgagaagagattaaaataagtgatcaatagacattttgatcttcaaatatatagtaggtgggttgatcaagaataaatcttcaggaaatatttcttaccttcaaataatataagaaaaaaaggttcatgtaagtttgctgtcaaaattctaagatcagatcctagaaaacatttaatattaactactcttatctaccaggattcagcatgtaggattggacattttgaaacttagtttcatactgttatctgaagacagggaaaaatttaaaatgtgataactgattttcagctaaatccaataaccaaagccaagatatcctaggcacagttaaagctaatgtaagtatttgtgagtctcctgctgcttacttaatgagaaccctttgttactctattttgtagattgatcccagagttttttgcgttgttacttcaagagattatatgaaagctaatgtttaactttttgttgtttcaaatttggaaataaaattttaaagtgatattacagttagaatgtgatatgctttagaaaatgaaaacaatgatttctttgcttaagtatctggaatatatagttcatcaaggtttgcaaatccttcttttagattgcaagctgtatgaagtggggaccctgattccagcacccagctcatgtttggcacacagcgggcttgaatatacattatgaaataatctacattatggaaaaatactgaatatgcagtgtggaaaaaatgaatccatcaatagctgcataacacagtgtattaaaataaaatgttttattcttcatacattcaaaatacgttgattgaattcctcttacagagacaaactcggaagtgttgtacaatatgtactttacaattcctttttaaatgaaggagactctaagtctatggtattactaatagaatacaaaatgtctgtgtcccttatatttttaaaagtagaaataaactattataaaccaacactaacaaaagtacaaggtgatatccccctccatcaccttttatgagcgtcaaggaggttagagatcttcaggaaactagtaaatatagagatctgatcagtatacaagtttgatggtgcttgtgtgaattaactttaaggaagtttggaaaaaggaaaatgttcaccattcttaaatggcctttcagtttcttttaggttaaactattttaagaagtaaaaaggaatacttattctgaggtacaagtgggctcattcagtgttttttttgagcacctgtatactcaaggtggaccaggcgtctgtgagttgtgcctctgcacaaccgatagaagataacacagaagatagtcgcttgccctgagggcaatagagaattgggagcttgaagaacagcataaagggatgtgaggctgcaagatcggctttgggaggactggagaaaaagacagtaaggtcagcaggtcagggagactggattattgaagaattgatgacaaaagacagtaggtcagcaggtcagggagactggattattgaagaattgatgacaaaagacagtaggtcagcaggtcagggagactggattattgaagaattgatgacaaaagacaggaaatgtacagtttgttgacatttacaaattccaaaatagctggtatagatatctgtcttcactaggacccctgcttttgaaaaagggccaattgtctttactattttcaccttttaagtaccttattttttggtttgaaataacctttctgattcagctttaggaaataatattgaacttaagaaatgtgtttacttgactgaaattttgaggtgaaattgctcacttttgttttattttccagcaagagaggtgtcagatttgttgattagttttcttaatctagattcttttcctgaacattaaaaaaacagtggatttctaaggatttagttgtcgtaacagaagaactccaagaaaatacaacaacatacccacaaaaagccctttcttgtggtagaataagcaagctagaggtttactttgttagactagcagtttttggacagagatgtttgttgatacaattagctctcttcctgagcagaaagaagtgatctttatacatgcttggtacaggacatggggtgtagttgaggttatctcctgaaaatgactttctttgcaagatgttcaacttttgaattcatcaaaaggcaaagcaaattccattttgaattggtcattgaggaatagccaaacctattctgtgatgacatcttaggaatcagcttgattgttgaccagctgaatgttgggtctcagtcatcattttgtatcacttctgaggtctgcaaaaatctattgaaagagagttgcgagtagcagccaatttcaataagcagaatcacaaatggtcctgtcattggtctcatcttttcagacattgttaagtctggaccccagatgggtttcctctacactgggagttagtgtttgtggcccatttggaactgggatgaagaatgggcttagactaggctaggggctgattctaagtgctcaaatatgtccccattagatatcatacctgctaggcatgatcatttttcccgtttttctttccttttacttagattttatacttttttcttatttccatgcttaaggactcacgtattcaaacccaaacatatgccttcctaggcatgtatatccatcatcgaaatacagtactcataaaagaaacctttattaacttatgtctaagtaatggattctgtgttcccagaccactcgacccggagttaaatatgagttaagattaatttgcttaaaacactatttcttttacacgtagttcaagatagcttttgggaagtaaatctgatttatagctaaaacgctatctcaaaaacattctttagagcaggatttttctttctcaaaggctggaatgattattttggacgtattcctctctgaatctgttaaaatataaagtgtataaatgccagtatgaatttgccaaatattgtgatggaacatttaatgctggcaaagtttccacacaacttgaaaaaaataagtggggatttttattatttgtatggcgtctttttatagcagattagtatgtgttagtggcaaatggttacaactaagtaacaacttaaaattcgtgaagatagatgttagatcctagagaagaatctagacctaccacacatggtcaagagttatttttagacctgaatgagtcaacacagcttttgccagaagtgatgttcttgattgacttgtaattggttaatggaagagaaggcaagttgggcttgcccctacatgatagcctttgctcagacaaaagaggcagctttctgtgacaactgatttcagaggtggcagacgactcatttgctagtaactcccttaccgtcttaccacggggcgaaatcctatttctaaatattattaagaaatacaaaatagctcttgtaacgggtgacacattaacccagcttttctcaaaatatattccatagaacatatattcagcatggtttgataggcattatgtaaacaaagataaacaggtttgtatattgaaagacctaacagagctcttaataggctaatgtatgtttcaaatctccaagttagattcgtactgtataagatttcccaggcttttaccatgggatttcctcctctcccgctggctggtggctcacacctggttgaggcaggaggagtgcttaaggctaggagtttgagatctgcctaggcaacatcatgagatcctgtctctacaaaaaaataaaattagctgggcatggtagcatttgcctgtagtcccagctacttggggggcttaggagggcgcttgagcccaggaatttgaggctacagtgagccatgattgtaccactgcactccagcctgggcgacagagcgagaccctatctcagaaacaaaataacaacaacaacaataaaaaagggagcttatcttggaagtagtgttacacttccattagcccattatcattctttatcatagtattaaagattcatttgtcacatgagactggatgtagaacaaagaaaaaaatgattcagttggcaattctccagcagagggcctcatacagggagctcttcaggggtagggaacatatgttttccattttttccctccataaacagctagtgtagtggtttatgtagagtaggcttttaagttttgcttagaatcagagcatgattctgaggcaatgaggcagaggagaaataattttgtttgtttgcttttttctctctcttacagagctgaaaaggacacataattttgatgaaaatgattaaagttagacaaatgcaccacaattcttcttttattgttaaatagcttcatgctttttacttttgttcacctcttttccttgtgtatgacaagggaatacgttaagaacacagaactcacaggatcgctgtgaggccaaagtagtgtagtatatagaaacacatttaatgaagttgcttacatctggttattaaaaagaaatgctaatttgtaaatattctttttttactttcagttggtctggaaactgtgctccatggcctttacactcatttagagtaggcactcttggctgcatcgtcacgtgagatctgcctccaccaatcctgccaaatgctttcctcttaggatgctgttgcacaggcttagttgatagccctgaaggactttttccctcttcttactgttttatttttgttcacaaatgtttgcttttttttttttttttttgagatggggtcttgctgtgtcacccaggctggagtgaagtggcacgatcatggctcattgcagccttgaactctagggctcaaggtgtctccctcctcagcctcttgaatagctggactacagatgtgagccaccacaccctgcctgtttgccttttatcaattttaaaatgtgggacattcttgcttttcttcagtttgacatgatgatgaacaataatcatcaagcaagcttgaatcaagcaagcgtcactcaataggacactcaataggaacaaagtgtgcatcagtatttgagaatgtctttatggttgtttctttaggtagccaaataaatctacggcaatatcaacattttcattggcaatctgacttattttcctaaagaatttatgatgaaactgctccagtcctgactaacttagtcttttacagtctcagcagaagcaaaagctctttgaaacctcctttctccccgctccctaactttcttacccctgctggggctctttctttatgcttccatatttctttggagagctgtaaagaattacagtgtggactttgatgtcaggggacttgagctcaaatcctgaggcttcttatttttagctgagtgtccctgggcaagtcaattaacttctctctacctcccaaattcatcacctatgaaatgacaataatgtgatgattaaatgaggtggtaaatataaagttcttaattcaatatgtggcaacaattattattacctcattatggtatttcccactgttggtctacagataaatctatagacaaaatacaatcccggacaacaagaagctcctatagctcctgtagcttcttgtgctctaggattgtattttgtttatatatattttttaatcctgaatgtctagtattatgcttgggacatagtggccactcagtgaatatgtttgaataaatgaaatttctcaaataggcaaaaatgcatatcataaaacaaagccatgttggtcgatgttgacatcatgcatattagcatgccagtagtgtgataacaagaaaggatagagatggtacttttcttttgcatatgcttattttttgtgtgcactgaatccagttttgcataatggagaaatataccaatgtgaattacatgtcttttcaagtttcagtgctgaacttgctgtgtttgttgtctcatataactggactagtaaggggctgtcttccttttggaagagaagagtcttcagacatcttagaaagttaagctgctttttaagtgttaaataaacattttaaagataattggtaagcatttatttagtaaaattttgacctttaaaaactctgcatgagacctgagtgttgaaaactaagaactgtgtgcttgtttttaacacagaagatatgtatctccaggttttcattttcctttttctcatgaaatggtattcaaatcgtgcactttgaaatgccacagaggaggaggtttatccgagctacgtgatgggtcaaatgaacttaaatttgaaacatgtttaaatttgcccttttgtttccttctcattaattactggaattgccgtgagtccgttgctctgtgaacgtttctctttctttgaacattcaggatatggtgttttgtaagtgatctaacagccagctttttctaataaaacatggcctaagagaagagcctgtttgtgttactagtgtcttttatgattttcaaatgatttacccacttctttaactgtccctagatgagtaatctttgaagggtagggtggcacatgtggagtattaaagagatggctgttaagcaaagataaatgaattacttatgataatacaccgtggaacaactttccactactggtaaatattttgttttctacagaaatctctttactatcaaatcattgctaaacatcatagttctataataatcccctcatttgaagacatttcatttcaaacaaaggctcattattttaaaatggatgcaaattgtttattttctaaataagcctaaatataacttaaattcaggttgctaaaaaacctcttcctggccgggcgtggtgtctcacacctgtaatcctagcactttgggaggccaaggcgggcggatcacgaggtcgggagttcagaccagcctgaccaacatggtgaaaccccgtctctactaaaaatacaaaaattagccagccgtggtgcacatgcctgtaatcccagctactcaggaggctgaggcaggagaatcgcttgaacctgggaggcggaggttgtggtgagcgagatcgcaccactgcactccagcctgggcgcagagtgagactctgttaaaacaaaaagacctccatgttggtcaggcttgtcttgaacttctgacctcaggggatctgcccgcctcggtctcccaaagtgctgggattacaggcatgagccactgtgcccagccccccaaaatttcttgctgtggttatgcatgtcaaggtaattagaaggaacaataattatcgcatttatttgctcaatgtaggcaactcctcatatgttcagatcccaaagtgatgctgactgattggacctatccaatttctcttcctatacaggcgaaagtatttaaaatcataaaatctttccttcactatgcagctgctagtcactgccattgtgtaatgttttctccaagaaatagcttatttctagaactctgctcaaaatttgcacaaatcataacctttagccatgagttcagggtagtgaaacttcaatataaagatcagattgtcaccttcctgacccaggtcttgaataccctttttccttttctttttttagccaagtggtaatttctaaaacaacctttcttcatagctattataaaatattactgtgtggcattccacactgaaattaactttccaagatgaaaatataggccttttttaaatagaactaataatttcaatgtaatttagggactatttaatgaacacctactatgtccatgccattttactttacctgttggtcaccctttgaggcaatgccattgcgttccttgaaatgtgttatttcatttttttgctttggattcactctttcacacacgttgagcttatattgcatactgtataaccagtggatacattacttgattctgcgtaatgcctgctgcatatgatgcaggggttgaaggcttctctatcttattcttaatgtagcaaacacaaagacaatatctgtaggggaaactactgaaaatgttaaagacatttgcaaaatgaaatactttttgtcctttttgtgttttagttgcagtgctggacatctgattttaaagtacaacagtcctattcaaacattttcatttgtctcagatcttgacattgttcagcacagattttttttctttaagtttactagaggaaaccagtcttattcattgtgggaactcagtaaatgttaagccagattttcaacataaccagcatcaggggaattaatttaatgcacttttggaaactgcattaactccacaaaatcaacaagacctttatagagctcacacaaagagaaatcagctgctacatgtattttctcaagagtcaaattcagttttgagaaaatgctaaagccataaaaatatagagatagataaatctcatgtgaatactattacatagatatataatgaatgatactatgtagctaaatagactgaaatacgatctagacatataggttttatttagggttcgatgatggcaagataattgtgaatgcagaagtcgtctttgttttaaatttcaaattagtttaactatttatatttatagatttcactcctatctataaaatagcccttgtttttcttgtttttacttctacttatagctattgtcaggaattgagagttttttctttaatctgagaggttggttcttgtaaaaaatatgatttctcaagaatgtttttttcaggaagttttcttgggctattattgttctctgggtttttaaacagttgggctaactttgcctttgctttcaacagaatgctaaccggataccttctgagataggttacaacttcatggcttaaagtattggttgtgctggagttgtcttcctccctggagaacagtccttgagaactaatttcatagccaaacatgctaaaactgttagaaggttgaggtgacttaacggccatttataaattaagctctgtaaaattatttggcaaataaatattattaaatgccactagcataataaatgaacaagtccaaacatctagtgaaaattagaatttcaattagatttaggacatattttatattgtcagtgctttattttcacagttgccaaattataaagtgaaatgtcttctcatttcttaaggagtctttttcaaacttgtctgtcttctcctggaatcaagatagtgactgcacatttcagagtgaaccatctggtgcaggtctatagtaggttcttgatgtgttgttgaaagtggtgagtgagtgaacacttcagaatgaatgacacacatattagatctagttatacacactttgccaaaccattgacatgcatgcaagcacacctgcttctccagctgcaaggcaaatagttatatcaatccataattctgccttccttctagaatggtgaccttgaggagaggtggctatctttggcagattaattactgtatccacagtgcttggcatgtatattttgtcaccaactgggtcttatgttaatgttccaccctaggctggtcgtgtttcttgttctggtgttttctatattgagccctggttctgtgttgccttcagtctactcagtgagatgcaggtcctcattctgttcttgcatttaacattaatttctccatacaatgggtcagactcagtacttaaaatacggagacttcctcctctggaagaatttttgccgccatttcttgattccaaatgtatgagctgcagaaaactttagaggtgttgaacatgtgcaaaatacctgataaaaatgcttctatgtgttaatgcataggaagaattctataaactttcctcaaattagcctccttcaaattagaataacttttgggttgaatgttattaaatacttagaattgtctccccattgtccataatgggttagtttcagtattccactggtcagtgtagcattgggattagtagcatttttatattttcatatgtatgagtaacacacatttttactctacttgtcaaacccatttcaatttctaatttcctctccactagttaactatggagtgaacatgagaaacttcattagaagagtatattcattttactcatgtgtctaaattgttaggttgtatgttgaggacaactctaggtttctctccagcagtgggaaacatgaactatgtgatatttttaatatttttgagatccttttctattgtttcgagacttctgagtatgctttttaatatagattcagattactggatagatgagagtgagggcaccttatgctattttaacaaacattttcccttctcctttgagtctatttcagtttgcacaaactgtatcttaaaaaattacacctaattttcagggacatcaattcagtgtgaggtatttttcctgaatagttttaaaactgttattcttgttgctgttattattttaacattgaagctgaactcattggatactataattttgtgacctctgcatacagggaaagtgaatcaatgagaatgcatttcttaaatgaatgtacagaagagtgagacttgttaatattttttcaaaaattcattggacaaagctaatgcattcatgggctccataaagacagtagtacagggaaaacattcatacctctgccaacatttccaaaaggccaagaaggctctcattcatggaacatatttcattttccataatattctcagccctcagaccaaggtagtaagaatactttattatcaaaaaggccctactaacaacttgcagtgtaaatcatcctaattggacagatcactgagaaaaaacaaagacattcattcaccaggcatttggaaattccaggtagaaatgctttcaaaccaggccacatttggaaatcaaactctgagtagtagagggctgtaaacgaaatactgcatctttcatttctgtataggttattatatttgtagcgcgaatgtacttatttaacaataataactaagtgcctcctatatgagtgacattctgcagattgaagaggtatttcaaaagggaacaagaaacaacagtattttaccaagtactttgtatgaaggtattgactctaattcttcagggagttataagagagtggtctacagtggagggctttcagaaggaggtggagctttgagcaggacttaaaagatgcataaggtatggaaagtcaaagagaggactttattctaagctagtaaaaaatcattcacatttcttgtgtctttttcttcattgttctgaatgtgtgacatataagcattcaagatacattgtgccagataattatgttccattaacatgtgaaattttcatctacagaaaatttttgtttagagaatgcagttttgggggtgctgtgctttggggctgatttccctcatcaagacggtaaaactatttgggatggagcatatactaatagaaatataatatacttatatatatatagtatatgtatactagtatatatactaatatatagtgtatatataggtatataatatatatttatatatttacatataatagtatgtatctataatatatataatatatcatgtattgtaaatatatgatatatgtatatgtaatatgtaatatacatatatcatatatttacaatatatgtatatattatgcatacatattcggagctaatctttgggtattaatgagagtgggagtccagagcctagcatatatgtaatatgtaatatacatatatcatatatttacaatatatgatatattaaatatataatatatgtatatattatattaaatatatatttatatattataatggagcttatacttatatattatatttatattacattattccattactatagtataaatatactattataatgatattataaatataatgaaatgttatacatattttattatatttatatatcatatcataatggagcttatcgtagtataagctccatcccaaattgttttattgtcttggtgagggaaatcagcctcaaaggacaacaccccaaaactgcattctctaaaatgaacattttctctagatgaaaattttacatgttaatggaacataattatctggcacatatatagtctgttataatatatcacatatataaataatatatatataaatcaaacataatacagttatatagtatataattataagtagaattatattaagcatatactagattatattgtaattagcaacaattgattactaatacttttcctccctaggtagctattattgagcactctctagtaagccatggaatataaagatgttatgtaattttgattttgttaggctaatttccagcagttaagtatagttcaattagtgttctgttttgactatgtaattcaaaaactatgttttgtaaaaactcacaaaaataagaacaagaacaaaaaaagcaatgtcatttgagttattgaaggagaattcagcccatagattttctccatgctttggcagctgttttagagcattcatccagctgcatttgtctaacacttgaataatgatcatgcagtttgtcagatgcttttgggagagaaattcactatgcagaaatatttagtatttaactaatttttccaattataggtttttgattagggtaaatttattttgaattactcctgatgttaaacccaatcttcattagtgttccatagaattgtgaaacattagaattatagttttttcctagctagaaggagcactctcattttatagatgattaagttgagcttcagagagacattaaacaacctgcccaaggttttgaagcccaggaggcttggaactcattttctgatacacagttggacactcttcttaaagtatttcccataacaatgtacacagttggagaaatgaacataactatttcttactggtcatggagggtcatgagctgtttatgtgaactgaagtctgtgagggcattactggaatgtaacttatcagttatgttttcaaatccttagagcagaacttcttgacctgtgtgctgtaaatggctatgggtgtgccggaggcggatagacagggcctagggtggcaaaaaaccaggaaagcattgaaataaatcactccagcacactgtaagtacctacagaaaatgttatttttcttggcagtagaatccactctctaagaagaaacaagcttttgttggaagactgctctgataaactttttggagggctgggccttcaggaaggctgaggacctaaagtggataaaaaggagagggtatgtagagagtcagagggtatgtagagagtcagagagagagaagagaaagacttaagggctggtggctcaagagaaactttggggaaacagaaataatggatggggacatcagcagatctacagtgctccataatgatttgtggagtaaattactttgggagatgggatgaagtgctttaattttgctttgagttagggactggtaaaatccaagattgcccaaggaaggactgttccatataagttacaatacagttatgaaaacttattagcaaagatcagatacctactataccacagtgcttctgtgaatagattcaagtaattttttgaatttaagcccggcatctcccacatgactgaccatttaggaatcctggtcctaagagaacatgaccattgggagtgggcctctgggaagggtgttgtggtgtgcaagggcaaccctcagttgtgtgcaccacgcagaatgaatcatgtgttgtgtcgctggaagttaagggtgaataatataaataactaaaaatgggtgaggtttcctgttaaaaaaacatactcgtgttgatctgttcatgtgtctacattacatttcaatgtgattcagtagggaggatttcttgggcccagtagttcgagaccagcttgggcaaaatagcaagattctgcccctattaaaattttttttttatgtgaaaaatgttacttgtgctgaaggggatcacatatttgttgagaatgttttccaaaccaacaatcatcacacaatttctcaaaggactttatttccaggtttgtgaaagttttatgaaacatattaaaatgttataagaatcattgataatatattgcatgtttaatgaacagcctttattaaaaagaagaaatatataaaggaactatatctggaatgaagagcctccttaaatgattggacagaaaatagtggtatgaattactgtaggaatttaagaatatatgatatacgtgtgaatgatgtttttttgttttgatttttgtcctgtgacaaactctaccgaaatgattagttgatgaattctgttggtaatttatagtcaggatattagcaagcaaagtattccaaagtcttctggctgatgtttatgtgaaagggtgtgttctcatatgagcaggaaatgggctaataaggcaatgaaaagactggagataatttcacggttaatttggggtaaaatttatttttattataatattatttgtggtgaaagtattaagtctgaattattcagacaattgctttaattctccatttgacatttgacctgtgcatagagctaacctttgggtattaatgagagtgggagtccagagcctagtcaagtaagagattaggaagcagagatggaaagaaagttctacctatgccaagggtcaatgcacagtactggtaatgatttgattcggcagttttattagcagccatttctttgacagactaataaaaatgacttacagattcttttccaagttatcttatataaatggattatgatgaaaaatgtgtgaaccacatttcatcttctttcttgccttctgttaaatatgtgttcagcttagaaattaaatagcacaggatagaacttgaaatcataaattctgtgcatgatatgtagttcaaagggattacatgataattcacatgtagagaattgtacaggatagttgggaaatgtttctcaaccctcagagaatgctcactaggcacatgcataacatgtagatgcccaaagcatttcagaaatagaattacaaaaaacccccaaaacacttgtcatgaaaggtttgtgaacctaatctcgcctgtatagactgggctaattctgatagtaagaggagttctcccttctcttaagtaaacaaaaactattggctttcatccaatcggttattctaagaccactgcaacttttttctctcacaaaaaggagttgccctaaagaagtttcatttgctttgatcttttttttcctccctcctctaaaggaaaaaaggtatgtgtgtgttgaaatctaaaatatggcaaagtttccatttaaaaatactttttagataaccagatttgctcttcgcacaatgaggtctttggtccctgggagatattttatatcatattcctgaatttgttcctggagtcatctttaacggggctagggaacttattgggtgctgtaagaactgttggtatgacccaccatgctctctctgtctctctctgtaactcctacaacttgactttgagatagatctaaagaagtgagctatcaaatgttggaaatatcaggtaagaagttaagataggctggtcatggtggctcacacctgtaatcccagcactttaggaggccaaggcaggcaggtcacttgagaccaggagttcaagaccaggagtttgagaccagcctggccaacatggtgaaaccacatctctactaaaatacaaaaattagcagggtgtggtggcatatgcctgtaatcccagctactctggaggctgaggcaggagaattgcttgaacctgggaggtggaggttgcagtgagatgagattgtgccactgcactccagcctgggcaacagagccagattctgtctcaaaaaaaaaaaaagataagggagattattaaaaacaataagatagacggaaatataatatttaaggttagagaagaaggctgagtgtggtggctcactcctgtaatcccagcactttgggaggctgaggcaggacaatcacttgagctggggagtttgagaccactcagactcacttgagaccagcctgagcaacatggcgaaaccctgtcgccacaaaaaaaaaaaaaaattacaaaatgttagccaggtgtggtggtatgctcctgtagtcccagctactcaggaggctgaggcgggaggatggcttgagcccaggaggttgaggctgcagtgagccatgatcacagcactgaactccagcctgggtgatagaatgagaccttgtctcaacaaataataaaaattaaaataaaaataagaaagtgaagccaactgaaaacaaaaagtattaaaacacagagaaagttagaaaataaagtttaaagatgaaatagaaaggccaaggaaaaatgtttaaatgttgtggagagaatatgaatgtactatatattattgctcacccttaaataatgcttggtatatgccaagtgatgtttaaaggcacgacttacccacatatcccttatgggtttggtactataattatccccattctataaattaggaaactgaggcccaaagagattaaatgatttatttaacatcacaggtttgtaagtggcaaaaccaagattagaatatacatgtatatatagctacattcttaaatacgcaattcggtatattagacacctatttattttgtcttcctgccttctgatattagctcctctcttcccttcttggggaaatgttccttcttaccatgtgacttgagtggaagatgttgccatgttcttagacactctctttccatgctttcaaagtaagcatcctttctaccatcttatcttgattatacaacgtatttccaaatattattttagattctctgcattttcatcagataaaacaggattatctcccttttataggacaaataatcatttccacttaaaaatggagctgtattaaaaacaagcttttggccaggcatagtggctcatgcttgaaatttcagcactttgggaggccaacgtgggaggattgcttgaggccagaagtttgagaccagtctgggtgacatagcaagaccgtgtctctaccagaaaaaaaaaaaagaaagaaaaattagccaggcattgtggtacatgcctatagtcctggctactccagaggctgaggtgggaggattgcttgagcccaggagttggaggctgcagtgggctatgattgcatcactgtacacagcttgagcgacagagcaagtcctcatttctaaaaaaaaaaaaaaaaaaaacaaaaccccactaaggttttaatgttatcttgtacattcatactaaataatttagaggctggtaacaaaaagaatattgttctggtctcaattaattaattattctaattaatacataaacttattttattaattgcttatttacatcagatataatattagtaaaagattgataagagcatgtaccagtgacaattttctgagacattaagatttttctttatgtttaggactattagcctacaactgctaatatatacacatatatacacacacatatacacatgcatacacatatacacatatatgtatataggtgtatgaatacatataggtacatatatacatataggtacatatatacaaatgtgcatgtgtatacatatgcatacacacacatttaaatggagtatgtttatctagaaatcaggaaagttagaaactgagagtaaataaacatttaaaaatggagaggcaagtggcttttcaagatagccctgattttaggtcaatggaaaaaatctaagcagttattttaactaaagtatctggtgatcatagtttggaagatctggaattttaaggtgggtggctcacttgacttgaaaatccaatattttttctgaagtaggtgttgccatggtgacagaacggcttagcaactgaagacagatttcattggctggctgtctgcagacttgcttgttgagtggcattaatatgttgcctcctgctgttttttttctgaggagaccatctggcattagctgtatttaaaggtacagttctgttaaacaaagaataccaggtgatatacactgaggtgttaaaaatatgttttgcaggcattagttggtttaatcaatcaatgactaagaagttccacttcaaatcacaacctattataaccaattaattcactattctaggctttgacagtaggcattaaagggttttattgtggtacttacttatattataaaaatttaattgcctaaatgtactatactaaatgatcatattaatcttgatgtgcctaaaaattaatctacttgataaactgttctctcacattatatgttcataaaccagagatgtagttttaaaataatgtttactgaggatgtttaatatatcagagcataaacagctgtcagtttttcttttacttttgagggtgataaaaataatggattttcaagtaagatgtattaagatgtcaaatgcatctattctactaattataactgttgattctaaacaataaatacctgttgtacatctgtgaaaagacataccctcttttttattttttgagaaagagtctctgtcacccaggctggagtgcagtggcacgatctcggctcactgcaacctccacctcccaagttcaagcgattctcctgccctggcctcctgcctcctgagtagctgggactacaggcacacgctaacacacccagctaatttttgtatttttagtagagatggggtttcaccatgttggccaggctggttttgaactcttgacctcaggtgatccacatgccttggcctcccaaagtgctgggattacaggtgtgagccaccgtgcctggccacatatcctcttttaaaggagttccctatatactagggaggataagacacatgcatatgttatgataagatagaaaatgacaagtaccttaagagtaatacaaagcgaagtttgagattgaagaatggaggacacatttaataaggatactcaccgagacttctgattggcttaatcttgaccagtgtagaggagagaagagaattctaggagaaacagaagcaatcatcagtgttataatcccagcctctctaagagtgggttccaagataatgttcagaggataataacagagcactttgtgcttagaccttactgtacatgtagaggaagcaaaatctttacaagtaggtctttggccatatcatgaatatccttaaatgctagactgaggatttagacttcatttgtttgggagttaacagaaatagatcacttgtgcattgctaatttaagaaaaagatattgtatgcttttgacatatttagggaggtgttgtggacccaccacctggagagagatatatggccagcagtttgaaatgaaattcatttcatagcagaatttgaggacagaggaaaagatttaggaatcacttgcatgactggtgagggtgaaaatggtgattatggatgagatgactgagggagggagaataggcaaaggagagaaagtgtatcaggcagaaacttagaacacaccaacatttttaagattaaatgagcaagaagagagcagagagatgtagtcaaagaaagaggcagtaggtatgattcagagctgtagtctcaagataggactgggggcatatgacgatgcccagtgctgtggaagttaatgaagcagaggatacagtaaaggtcactcactcccagcactggttggaagtcgctggggacatttggggaagtagtttcagtagagtcaagaggaagaagtcaaacaaatggataaggagtaagtgaagggcagtttcacctctaacactcaccttttctctcacccattcatcaaaccaagcctttcttttttaaaggctagtcaagtgaagcagtgggagtaaagaaggaataaactaagttttttgaaagattacatactattttcaacacacattcattcctgaactcatatcattgtggcagtcactgcattactctcttcatatggttctcacaaagggccactactgacttcttaatagggtgaccttatgtctttgtttccaacatattcagtgttcctggggtatttgttaatagagccctctttcaccctcaaaactgtcctagtttggatgataaattatgagttatcccagctcttcatcaccagttctaatgagccgttttcaatctttatcttacttgaccttatttgattttttttttctttacacagctgactactcccctttagtgtgacttgaaaccccacttctttgatttgtactggataactcttctggttctcctgacaccttctcagtcttttctgcggccttctcttctgtacaccctgtaagtggtgccattgcttagagttctgttcttggtttcttctcttcgttacacgccttttccatagacaggctcactcataacaacaggtgcagttaactagaagccggtgaaggaaaaatataacccttgtttctccccagtgagctttggatttgcacatccacctgcctagtacacttttactataagtgatagtcaacatgtggataagaacttgagcattggagtgagacataaggctgccaggtctgccgtttaatagcttaatggccttaaagaagaaagtctttatgtggctcagcttccactctgtaaaatcatgaaacctgtcacgtaagatttatgtgcgggtaaaatgaaatagcacatgtaatgtgctgagcacagttaatggcacacaacatacacttaatgaataatagaaattattattatttcccaaactgtattctcctctcattatttcttgtcttgtggaacatctgccttcctgagtggaggagggtttatgtgtgggggaacatgaaatacttttggaaagattgagtgatgccacaatatatgaggccctggaagctggacagaggaatttagacacaatggtgggttacaggggcttctgcagtcttgtgagcatagaatgattctgtggaaagtggtgttgtaataaaattagttattttaatattaagccagatgtgtttaaagtaggggtcgggaggctgggcaaaaggctgatagagtaatactggcataatttgatgaggacctggaaaggtgtggtgacaatggaatgaagaggaaaggataattagggaaaggtgataaatggacagattattttattttttatatcagttctttcttcagaaggttgtgagatatttccatcaaaaatatatatttaataaaaatgtaataaagcttctttatggatcaagaagccactactgttttgtacctatttatttgtgaaagagaaggaaaatgtgctaataataatagtggccaacattttcagcctgattctctcagagtttgcttagatgatcatttacctcttcagatctttgaaagaatttcataaatgactggtcccatttgtaacctttattattctcatagttacacagaattgttgagatgcatacttcagtattaaaggatgttggtgtttctagtgattctggccggttacatgacaccatgtgatacagtttggatatctgtccctgaccaaatctcatgctgaaatgtaatgcccagtgttggagacggagcctgttgggaggtgtttggatcacaggggcagattcttcttgaatgacttgacactatctcctggtgagttctcgcgagatctgattaagtgtatggtacctcccccaccttactccctttctctccatgtgacgtgcatgctcctgcttctaccatgagtgagagctccctgagccctccccagaagccgtgtagacgcaagcaccatgcttgtacagcctgcagaaccgtgagccaattaaacttcttttctttataaattactcagtctccggtatttctttatagtaattcaagaatggcctaatgcaccatgtaaattaaaatatacacttgcaaatatgtcacaaaaagacttactctcccccgaagaggagtcaatacaaaaacctgaagaatgtggcaagtggaaaaacagaaatgagaaaactacctttgtttataaaaaatatttttaagatattttttctttggaaatagattgttcttttgaaatctggaatgtaaaatgccagactcttcttctgtttttctggatttgaaacaatcgaacactgggaaatatctgatcctgaactaaaatgcaggcacaccaaatttgaactcagattgaaaaagttaacactgggaatcaactagaaattaacggtgattatgaagaatattttgattgctatttgattctttcatagctctgtaaaacttatgtaagcaagctattaaaaaacaaaagctgaaggcgactgttttatgatgtgtgtatcataaaggaaaccatcaccacctgtcattgaaaccaggaaaggctcatgtcaactaaatgtgaaaagaaaacagtgtaagaaattaaaaaaaaaatcatattcttgaggccatgaaacacatgttccagaaaacagtttattagaattgcattaagtaaaaattaatgtctgcacactgatggggaagcagtgtggagtggtatggaaaatgttagagcagtctatttttgtaaaatctggaagttggaataaataatcattggggccccagctctaaaatcctactaccactattaatgtgacaatgatttaatttttgaatgaaatttaaattgtaacatatgccatggggaatgtgttttctggcttgctaacaacatgaaaagaggatgttgaaagcctcttgtaattcatgtttttaatttcattctttttttttttttttttacagagtttggtttttattgttatgtgtttgtctgggtgcagaattgccctcaccacccctggccaccctggcctcctgacaggaacaggcaaagagatggctccagatggctcttggctgccactctaggcctcagggcttatacaatgagcacagtgggttccaccttccaatagcgcaaactctaattcacagtcagatttcaccaggagggggagatgatcttggctgaaggcactttaatcagggagcaaacccaatgccggagtttgtcttccttctcgttactctgataaatctagatgccactctgttggagaaccagcactgccggcagctggggttagtgcactgactgagtgaggcatgaggcctgctcactgatgaaacttcttgttagggctgttagtgtggtcagctagcagctggcttggggtgaactcttttccataggcagcctcatacttcttgagccggtccactatcttctgggcttcatacagatccacaaagcagaaaggccctccaagacaaggtgggaagctgagcccgaagacggctccaatgtctccctctgcaggtgtggccaagatcccctcttgcgggcacgtgactgcctcattcacaaatcttgtcagcaggcggaactggatgtcttcatctgaggagacttcagacttaggaggcatcttcagacttgctaaaataccgttcatgtcagaattcaaattcttattcttcacactctcctgatagatggaaaagcccttcccagactggcgacctaggaagcccttggacaccatctatgtcagtagttctgggtttccacctccaaactgctccccaaaggctttgcccagatctttggccacatgtttcgctacatccacgccaacttcatccaccagtgtggcggcacccacaggaaggccaaggcttgtggtcagggaatccagcttctttgggtcaactccttcctggaggattcagatgacttcagacatcatgggtgcaagacacctggtggtatagaagccaggtccatccttaaccacaatgatgaccttcccctgcttgagaccgattgctacagttgaagcactggtgtctttggaagtcttcttggttgtgatcatctccagcagctgcatcttgtctgcgggagagaagtagtgcctgccaatcaccttctcaggtcttttgctgacagcagcgatttcactgactgggagaggagatgtgttactagcaaagacgtagtgatctggaatcactgcttctacttcctttagcactctgtgcttaaaactaaggaagttgtgatggatggacagcatccatcaccatgtctgtctttcaaaaccttggtaatcaagcttcccagtcaagttgctgaagatggaatccctttcaaatgacgttagagctttcttctttactttgtcattcaatcctttgaacacttgttgctgtcctcagcctaacccagtgagtgtggcatctttaagtatagtctttcgccccttatccacggagacttgggcaatgcctgctcccatcatccctgcaccaggaatagccagatgcttaacatccttctgtggagctccagatgtattcttcttgcacaggacctgaccatggtagagtcccatcaaggcctttgattctttggtcattgcaagctctccgaatttctgagattcagagagataaccagcatcgctcccttgctcaattccagtctttaccacatcaattattttcagaggtgtgggataaagggaaagccctttagtccgctttcacactttttcttccacttttttgtaaatctgttgcctgacaaatggaatagtcatggcatacgctgttaatttttccactaatcccttgtctctctttggagagatcttcttatcagctagtcctttgggaaagtaattgcaacttcttctaggtatttgattgtccattcctctggaagttttagtcctggtcgcagagattccaccaattggtcaaccagtcccattttctttgccctgtctgcacggatgtttctgccagtcagcatcatgtcaaaagcagcaggcacacccaccattttgggcagcctttgtgtgcctcctgctcctggtaagatccccagcaagacttcaggagcaccgaatactgtttttctgtcttttgttgctattttatattggcataaaatggcaggatccactgatggcagtcacaacaggctttatggacttttcaagtttctcaaatgttctctgtgcttcttgtggtatctgtgttacttcttgaggggtcttgcaagtggctaaaatgttgatatcagcacctacaataaagcagcctggctttggtgagataaggatggcacttctgatttgatcactagcccagatttcattcataacttccgtgaactctgaatgcagctgtttgtttattcagcgtatttatctttgaatggggagagttaatttaaataactatcacatcccctttgactccatagttaatatgggttctggtcagcaaagcaaaggaccctgtaaaattgcggcgtatataaccttgggagcggaggatcctgaaggcagagaagtggctgaggctgccaatcgcccggtagaccaccatgttgagctgaagagaacagcagtggagagcgcttctctttaatttcattcttatcttttgtattagctttttaaatgtattataaccaaggagaatacaaatgaactgacttcacagtttttccctcagatttcagaattgtactgttcttaagctccctcctaaaacttgtctcttttattaaatattttaatatttaatggctgaaaatctttgtggtcattattactttgttgcagctttattgagatggaattcacataccaaatagttcacacaattaaaagtaaaattcaatggtttatagtagatccacagtgttgtgcagccatcaccacaattttagaacatttatatcatcacctcaaaaagaaccccatacccattagcagttattcctcattttcccaattcctcccaatcctgctccaacaactctaggccaccagactaatcgactttttgtctctgtagatttgcttattctagacatttcatataaatcaaattgtgtgatatgtggtcttttgtggccgactcctttaacttagcataatgttttcaaggttcacccatgttgtagcatgtattagtactccattatgtggatttaccatattttgtttttccattcatcagttgatagacatctgggttgtttcaattttttgtctatcatgaacaaggctgctgctatggcacttatgtgcaagttttttttgtggatatgtgtgtttatttcttttaggtatgaacctagcagtggaattgctgggtcatattgcagttctttgtttaacattttcaggaactgccagactgttttccaaaatgactacaccatttacattcccatcggcagtgtacaaaggttccaatttctctatatcctcgccaacttgttttttgctgtagttttgattagagccattctactgggtgtgaagtgatattttgatgttgttttgatttgcatttccttgatggctaatgacattaagcatcttttcatgtgcttattgaccatatgtatatcttctttggagaaacttccattctttttttttttttgagatggggtccggctatgttgcccaggctggtttcaaattcctgggctcaagggattctcccacttcagcctcccaaataactcaagtggattgctgggattacaagcatcatgccgggcttcaattttttctttttttttttttgagatggagtctcactctgttgcccaggctggcgtgcagtggtgtgatcttggctcactgcaacctccacctccgaggttcaagcaattctcctgcctcagcctccagagtagctgggattacaggcatccaccaccacacctggctaattttttatttttttattttttagtagagacggggttttgccatgttggccaggctggtcttgaactcctgacctcaggtgatctgcctgcctcggcctcccaaaatgttgggattataggcatgagccaccgcgcccgacccaactttttttttttttttaaagagacggagttccgctgtgtctcaaactcctgggctctggggatcctctcacctcagcctcccaattagctgagacaacaggcatgtggcactgcacctggggctgtctattcattttaaaatgggcaatttatcttattattgttgagttgtaagagctccctacgtatcctggaaccaagccccttatcagatatacaatttgcaaaaatcttctcccattctgtgtgttgtctccttactttcttgatagtgtcctttcaagtacagaagttttacattttgatgtggtccaatttatgtattttttcttgtgtttcttgtcctctttgcgtcatatctaaaaaaccattgcgtaatctaaggtcacaaagatttacacctacgttttcttctaagagtgttatagctttaactctcgcatttaaatcttgatccattttgagttaacttttttatcggataagtagagggtccactttccttcttttgcagatggatatcccattgtcccagcacaacttattgaaaagactgttattaaaaaaaattccatccctcagcatattttcacaagtcatgaatttcataagtgagtagaggcaactcaaagatagcaaacaacttgattaatatcattggctaataaagggcaccgtaggaatttaaaagccttagattatctgcttccaaaacccatacttattccaatataccagtggttctcaattttgagcctgcgtcagaatcacctggagggcttgttaaaacactggttgctggggtcccacccccagagtttgattcagtaggtctgaggtagggcctgaaattttgcttttctgtcaagttcccagggattctgatgccactggttcagaggccacactttgagagccattgtaatgcactgcgatggttcccctgtgtatcctgatgctcgaagagccttcagttggggtggagggagacacagagagaataatataaagacaatagtagtgacaaagggctaagtgtgcatggaggaagaaaacagtaattctgattagaatattgaaaaaagtttctgcaggacacattatggaatggattggtttatggataatctcaagcatttacctccacctggtgaaatcagacagcaactgtctcttcttacatttatttggccacaagtatgcttagagcagctaagctcttgagcacataagcaagtatatggcggagtgggtggtggttccggaatggttgacgtgggaaatgcagagagagcacttaagtgtcagattatgacactgaatacgggaaagtgatgggagtgaggctggttaaaatttttcacccacgcagtctccctgtgttgcccaggctggagtgcaatggtgtgatctcggctcactgcaacctctgcctccagggttcaagtgattcttgtgtctcagcctccccaatagctaggattacaggtgtgtgctaccatgcctggctaatctttgtatttttagtagagacagggtttcgccatgttggcctagctggtctcgaactcctggcctcaagtgatccgcccgcctcagactcccgaagtgctgggattataggctgagccgctgcacccattctccactcatgcttatatcccacagtcaggttcagtgaatcgatgccacttgtgtgagagactaaaataaataatggatttaatttgatgactttttttttgactctgaatctttcagtgtacaaatgaaatcttgataaagaaaatatcaataatagcagtatatcaatgctttcctaagaaactgtgaaatactgtggtgatcttatcctggaacaaactaggatgagccagtctttattagattattttgtactatatttatacttactttgtgatcattcaggaggacccttcatattgttgaatttggtaaaatttccttgcaggcctaggttaatggggtttacaggctctcaggattgtgtgccagttgtcctctttctaaggtagttttattcataaaccacacaggtttttttcaaaaacacaaaaaacacagacaaacaaacaaaaaaaacagaggccaggtgcagtggctcatgcctgtaatcccagcactttgggaggccgaggtgggtggatcacctgaggtcaggagttcgagaccagcctggccaacatggtgaaacccctttctttactaaaaatacaaaaattagctgggtgtggtggtgggcgcctgtagtcccagctacttgggaggctgaggcaggagaatcgattgaacctgggaggcagagtttgcagtgagccaagattaggccactgccctgtaacctgacagagggatactctgtaaaaaaaaaaaaaaaaaaatcagagattttaacaggtcaatcttgaactatgtgaacaacttcaatttataaaagagtaaaaaaatcgttgaattacagaactatgaactgactcctttttgatgcagcctgattattaatagtcttgttcacagctgtgcccaaagtagaacatcacaccggcactgggtaagtaaacaaaacaggccagtaactctgccaaagacctagctattaatggcaatttatttttattacatatttggaatcttgtcatcccagaaggtgctgaagtagaaatttagtaatacttgatttaagaggcagaagtcctgtaagtttgcagctattaaaaaatggaaagaaaagaaaggttacaaaggggaggggaccatatctgtgtttacatttgttcctttcctcaaatggaaggtagaataatgtattagaagatattttaaatattaatatctaactgaaacctgatattagagaatgagaaaattttgctgaaaattaattttattttcttttaatttatggtgttactataccttttagatttaggaaggcagaaagactgtgtgtgtgtgtgtgtgtgtttgtgtgtgtgcacttgcactttggggttccctttctatggatgtttcaggatctgaggataaaggatcacagtctagcagaaagctgggtttcaggggacgtcaaaggtaatttcatgactatattagtagataaatcgaagaccagagagcatgctgaatggaggacatttacatagtctttccaatgctaaaggaaatagggaagtgattatttcaaaattacctagaggatcttgagcatagtatgacttaagataaaaatctcattgtttctgagagttggcctctttctcctctccagatgaaatattttttcctttttttctcctccgtggaaagaaattattaattaaaacaaaaagacattgttggaaagggaggttttttagtcgcctaagagaggtgctattagtacttgtttatttaaaaattgacttttggtcaaactaaactatacaactttttctttttcaatccttcttccctccatccctcttcctttctttcttcctcctactttttgcccttcctccttccctgatcccttgttttatttagtttatgtcattccacagagctcacagttaccacctggtaggtacccttgacattctacacagttggtaaatcagtgtcataccagttgctaaataattggccaggaatagcctttatcaatgaatgcttcttctccttttcactctccattgaataaagatggaaaccagctttgcctcctttttgagtatggcctgttgatttctaatttgtcatagctcacatggaaaccttgtgatgcgcttgagggggttttctcatggagacctcaatacctgtggaatgtagggcacatggcaaacagatctggtttatctgatcaagtgattaatgcaataaaaaattataaaaattcaaagtgaaaagtgtgctcttgttactgtgtgtggtaagtagtttagtggattctggttctacccattgaagcactatacctgtggctggtgatggaggcgaaaatcttttactggaaggaatgggaagaagggtagtgggggccagagagtctctacgttcctccaggaggaggaaaccatctctttaaaatgacagtgctttccttccacgaaagaaccataatttttctaatcattggtaactattttggtctttcaaatgtgtcaacaacttgtacactggaacagcctctgtctacaggcagagcaggattcagtgatttttagaaggcatttgggccccagccagcctgaaagttggggtttacaactgtgttaaacagaagagattttgtttgaaagggtaaagcacatcatggaaaagttgaggaagaaacaaaagagaaagttgcaaacttacctttatgtttataagaacagatatgttcttgagagattgtggatttttaaaaatatgatttttttggtggtgggaaaattgtagacattaaatatcttttttaagttatgttgacaccttacaattacgtaatcctttataattttcaaataaatactaacattagtaagcaagtactacataccaggaaaaattctagttgctggaaataagacaataaagaaaacagggattattttattaagtcctctcaataaagcctatgaatcagttactatttttatctcgattttacagattaggaaactgaggcacagaggagttgtgttacttgctcagagtttccatagtcaggaagtggggagtaaggtttgaaatccagactccaattccagatcctgtgctcttggcaccacgcagtcctgtctcaggcaggcagcattgccactgtgcactttatcctaaaaacaaccctctgagggaggtgagaaaggtatgtttcttcacatttaaaaaatacgaacatgtttaaaaagtaaacagtgatctatttacatttgtatgctgggaagaggttctagagtcatcatcttcacctcttcaatgcttcagtcattggcttcccagcctctaagcagccatgtactccatttctttttgcaccgttataaccagtgattttctcgaatccaaaatctgtaacgttcctctgcttaattccctgcaggtgctcactgttacacctagaatcaaacccagacttcttcgcatgcgcttgagattcttctggctgggtccctgcacacctctgcagtgtcacacttgcactctctgagccctagctctacagggcttttctcattttaacaaaacttgctctttcttgtctctcacatgttgtatatgccagttccctggcctcaacattcttttcttcccctcttccctcttactctacccttcttaagtggctattcttgtcccttcttttcatctctaccttgatgccatgtctctacagtgtgttgtaattgcatgtccaacgccacttttcctgagtccacgggcctggagaccatgtgatgctgggtccaaagtgaagaattggggaatagagaacgggaatcttgttcacacagttctctccagtacccagcatggtgacccagaacatgtacatgtaaggcatttgtacatgtaattaattagcaggcatgttttgaacaccagcttcattaggagtgatgccatatttgaggcagaaacatagtatgatggagaattcaagaggctttggactcatagctcttagttgaattctggctttatcaggtactacctttgaggctttaagcaagttacttaacttttctgagcttactttctcaaataaaaagcaaggataactaaaatgctttggaaactttcctgtgagaaattgatgcgtaaatagataattaagggacattctaggagttgtgttacaggcatgaacaggaacacagaggaggggacaaccaacacagctcaagaggtcacagaagatgtcatgtaagccttttctttttctcagagcctctggcatcgacgtgcttggagatacctgaaaattgggcagctgtttatctttctggaaatgtttagtcaaaggtcttctgagcatagagatacaggaagtgatcttccattcatgcatatttatgattctattctaagttaaattattaatagcatttgacgagtattctattttgatatggacaagaaaaatcgttcactttgaaacatttattgagctcgcttatagcaaactgggaaaaaaagtcttggttttgttatttttctcaaaagatttgtatgtattttcctgcaataataaaccaaaaataaaatccatgaaggatctagaacttttaaggctatgtaattcatattttaagcctttactgtttcataaattatttaaataatttgaggaattactattgaagagagtcttaatctgtcaaattgatcagattggatttatcttgaaaacagttctgcatctttggataaaaatctattttattccaaagaaagctttttttatggcaaataaaagcaaaggtatacatttttaataatcttatgataaataggatgatctgctttaaagaagagtaagtttatagagtcagagtatacttgtacacacctcaaagtcaaacgtttgaaaaatgaagtttgttatgattctaagtgtagtttcgaatgtaagaaaaagttaaaagtgtgatgcagtcaggaagcttggaatattctcctgcataaattatatgtgttaacagccttagcagtattctcttgtaggccacttggctccatctttaaggtagtttgatgaatattgactggtctgcaaaatttgacttaagaaatgttgagccaaagtatcctggataacgtagatatagagataaagtaatatatatatatacacacacacacacatacacacacacacatatttacatatatacacatatgtacttatttacagtgtatataaaaaataatttagaagaatgcatccagaaaccaaattgagcttgaaaagtaccacctcacatgaccgcagggacagctggttattgtcttaggatatatttgcattttgaagtgaactttagtgacattacaaaatgccagattggaaaaacagccattatttaaaaaaaaaaacaaaatataattagcaccagatgaatgagttgtctcataatcacctcattattacaaattaattccaaatgaatatgtttgaacagggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtaggatctactgttattctctggagagctattgtgtcagaacggatttggattattttttaaaactactgctacctagagggtaattttattaaattcctttatcatttggattaaatacagcaaaatgaaaccagctcctcctgctcagaggagctgtcaccacaatctttaatattttcttagcattatttcctttaaagtatgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaaggaatcttcccgcctgcactcccctgccagctcagctacttccctactcctgcgccaactcaaccgtaacagtagctgagacgaaagcattgctctgaagtaaggtgtagggaagctttctggcttccttaataaagttacacacgatcttctaagcttggcgatggagggagaaggcacatgggagggtcttcaccgatcctctggccctgactctgcctacccttcattcattcacctgcccctctgggggctctgggcggtgaccactgccactattgggctagctagtggtgggggcactgctccccttaatgctctggcccctaggggagacacaaaatattgttttaaatttccagtagtgtagctcatggcaggctgaggcacttacacaaaagggtgctggaggctttagggtaacacagtagaaatcatcaaagggagaatatgcggtagacaatttaggctcttcaacataacttgcttgatctccagaggccccaaactctgctcatgccaggctttgcacatgccgtttcctctgcttggactggtcttccccatcattgcctggctatcttcttctcaattactagatttcacagtaggggttccgccttcttgattcccccggcctgggttatataggtttgtcctagatagtgcggtggccccacatatgcctcctcatcaacctgttttacagttgtttatcctgttaggccataagctcagtggcaccagggaccttctctgtctctctcagcactgtattctcatcagcttggacagtgcctggcacacagtggggactcagaaaatattttcgaatgtgtcaatgagtccatgaatgaatggaatttggtaaaaaagagaattctgacctccagcttctctttatcttatgagatgctttcttcactgtaatcttgcaggactggagttaggttttatttagaaagctggcaggtttatttacaaaagatgcaaataaaccactgggcttaggggacagaaagaaagagccattttcttagactagaaaataatatggaatggattagggggcagaagaaggaatgggtgagtggggtggaggaatggcaacagataagatgttgatggttataaaaattgggaaactgtccaattctccttagtttagactttaaaaaaaatgagtaaatttcctagaagtcaagtgtagccatatgaaaatatttggactaagttaaatataattcccttggtattattgaattgcctttgacttggagacagagctattcattatagagcagtttctaagagcctgggcttcacagagattatctcttttcattcaacaatgtaatgaagtaggaattatacttctattttacagatgaagaaatagactcagagagtttaattgactttaggattgtaaaactacaaacagtagaactggcagccattcattcattccacaaatatttattggcagtattttttttttttatcattagctttgtcttttttgatggtagaaaatgcatttcatttagaactatgattttagcccagagaaagtgatgtagaaaaaagcactaagttaactagatcatatcagtataaatgtgaagcctcaccattttactcatccaaaagtgtctagggccttaagttcagttccttttattacaactttaatattttgtctgtcttaaaaaaaaaaaaaagacattaaatctccagcccctggtatcgtgcttggaacatggtgggtacttaataaataatttgtagtgaatgggaaaattgagaaccattagtcattttctattcagtattaacaaagtctgacttacttttttgtttttgttctgtgtgggcacatttcactgagtgcaacttatgaaggacctcaagatcaaattcatgtcgtactcttggaattgaattctgacaggtggactgagagttttttgtcctctaagccttcattctaagacagatgacaccaatgtaggtagttattcagaataatagactcaggaatttaataagggtgttgtttaaaacgcaaatatcaccaaccagtggtaaagcaaacacattctgtgtgaatgagtacagcccactgattgacattcaagacccattggaaaaatcaggagacacaagagtgggaagagtgcagattggagcagctatccaaaaatacagaaggccagaaggtggtgagaaaaatgtcagacaacagattgtggagaaaaataaacaagccaagaaaagtcctatttggccttaagaggcagatggtgacaggaagtgttcagtgaggagtgattgtgctgaaaatcacaaagtctataaaattatccatctgtagtttgaggtttttggggaaaattaaaactctttgctagcattacagggaagggtgatagcacacaaacagaatattaagtaagtgtgtatttgtgtcaggataatagaaatgagagatgcgttattccattagaatagaagttttgtttacttagagattgtgaccaaaattataaaacgtgttttgttttgcataaaagcagttgaacttgtattaaatctgttctttccacatttttgatgtaagaaagaattctcccaagaatgttaatagattgctaaggtagcaatgataattttctaactgaaggaatgtactaaacatttttttccattagagagtttttttggaatgggatatagaaaatgacaaatcacaatgctaactttaaagcaaagaattttaatttgaaagttgagaaaatatagcagggaaaactaatcatttggaatagtatgagataatttgaaaaaaatattataaatattttaagatagatgtggttgaacatttagaattgggaatcattttttgatagtttgggacctagttttctgtgcttaaattttaattcagtactacttactccatggtcttctggtggtgtgcaacttgaggaatcaaataagccagggtttttacaactcttttctaggtcattaaagcatttctgctatgtgcctgaatatgtctttgatttcatgcataagaaatattagatgcttcattctccttctttagaagaaatactaactgaatatgttggattcttctctatttttattgtttctctcttagatttttaaccacagttgctcaagtctaagttttgtattttaagtttagacgtgtaaagtaaaaggctgggagctgagtgtgtggtgatgcttcctccttttcccttgagaactgaaggcaaaaaattaaatttattataaaaatttgttttacttttaaagatgtgattttccagacagagaaacaaactcatgtatcggtgtattttttaatgaattagaagcatgaaatctaggtactttatgtaagtcattttatttaatcctcaaaataatgttttaaaatagttattattttcattctcattttataattggggaaatgtaagatcatcaaaaccaagtttcagtttcctaaagtcacacacctaatagcagagtcaggatttgaactcaattccgtgtctttcaatggcagaaggggttttgcacattagattacataagccattgtccattgactccttgtcctttgcacttgtccaagagtggtccccaggcacaaacatgcatgtgaagaaagctccagaagagattctgattcaaatctccagttgggaactaatacatcaaacatttcaaaaatcaatcaaccaaccaatcaacccagcctttattgtatggtggtagttaaaaatctaaactctattttctgcaagttgctagccaattgaaccaaacttcttcactggataatatttttaaacatagatttagaatgcctttttttcaaatatgaaaataaaagatataatagcttatttctgtgatatatgcatacataattgcttcccacctaatttttttttcacttttgtagccttatatgtgtgactgtcttaatatctcaaagggctagtgctatcctcacccttattcttagattttatctctttaattattttctttgctttgttattcccaccagtttgtcttctagaaggtcttcgtatcatgttatcacttaataaacattctcttttttattctgagtgaaaatgcaccaaagtataaatctgagaaaaagtgaatgttttataacttttgtttctcagaaaattatagcagttatgttaatattggtgatatacttctcattgtagtcattcctatgctagcaatatttttattgctactgtggataaattatttcattatatttttaacttgttattgttggagtaaaacaactatttatttttcatataaatattttgtttttggcctttttgctgaactctgaattctaatggctgtccagtttgtttatttatttctttattttatcatctccattttacaggtgatgtctagtttattttttctgttttttttctgagtgtactatataaattgtatacagtgttggtactttatatttttaagtttatatatcgtaatttattcctatgcataattgaatagtagagaatttctagtatactgttacatagtatgtcttttccctgattttaatgggaatggcatttctgtgctcatatgcatagtcaagcattcaaataaccattcttctgaagttgcagattaggtactttaagcatttggaataattagtttttattaaatgtcattttgatttaagataattttttatttataggatactaaaagtaaactttggagcagatttttaaaacacacatttctactttctgacattttacttaggttttcatatgtatattcataaaggaaattggcccgtacttctctattttatataaattttatcacacttagaattagagttgtaatttattttcaggaaataatttcattatgatctacatatttgttaatgtcgtgagaaatagctcaatttgggcctgcattgtagtggaaaattatacttcttaaagctctgcctgattattagttacttccttttaactgcctaaggctgatccaatagcaagacacaaacctactgagtgtgcagtagtaaatttctcattttctgtagtaggatttggagtcttcgttgctgtgctctataggttaaaaacaacacatgtattgaaaggtatacttttaggacctacgtgcctggccatagcctggccatagctcctggtcctcctgtgggcagagaaggggccaaatcttagttggtatctcttctatgtttggtcagcaaataacctctgcctctattccacctgctggacttgacatttgtaacttttgtcttctgtgtcttgctgacagagatagggctcattcctagattggtgaattgcttgctctcctccaagttgtccaaaaaatcccgcatatttacctcacagccctgcatccttcttgttcttacagtaaggaccttgaagtttccttgccaccttcacatagtataccttttcacccaggaagggacaattggagttgtagttatagaattcttaaagtttgatttaggctaaacattgtgctcacattttcatccatcttataatgctacttaatatcatatcatgatttagaacacaaattacataaacagaaaggcatatctggatagcttgtgctcttatatgatgttcttccatttttaactaatgttaatggtgcatagcattccattttaatgcctttttctctgttgtttccattgtattgtttttaacctaattaattatttctgttttttaaaatagttttgtaagaagttagtctaggtcagcattctgcaagctgttctcagaatactaaaaaaagggcaaataagcttgggaaattgtactaaatactctccttgaggattcaaagtacatattaacataagaaaagatctgagaagttttaaaataacagggaaaacttttgaagtttattcaatgattaaaagaacttaaaaataaagaacttatttgtgtagaggaaggctttttcttggcacagttattaaaattctctggaatagattttaatttttttcttaacaccaatttaagaagtgctagtctatttcatcattatcattatcactttaaataaagagcttaggaaattacttactcaattcatcgttgttctttcatctcatttattattttttaaatatattttaattattttttatctatttaaggaattcttctctttacaataaaaaattgtttggttcctttatttttatatttaagcaggaaagcaggaaaagaattaaagttatggcattatctctgagtaaccctttgaacaatcctaaagctttttatatttagcaatctcattattgctattgtaaaccagagtatctgagataagtctcagtcaatttaggaagtttattttgccaaggttaaggatgtacctgtgacacagccttaggaggtcctgatgacatttgcacaaggtggtcagggcacagcttggttttatacattttaggaagaaatgagacgtcaatcaatatgtataagatgtacactggggccaggtgcggtggctcacgcctgtaatcccaacactttgggaggccgaggcgggcggatcacaaggtcaggagatagagaccatcctggccaatatggtgaaaccccgtctctactaaaaacacaaaaaattagccgggcgtggtggcgggcacctgtagtcccagctactcgggaggctgaggcaggagaatggcgtgaacttgggaggcggagcttgcagtgagccgagatggtgccactgccctccagcctgggcgacagaacgaaactctgtctcaaaaaaaaaaaaaaaaaaaaagatatacactgggttggtccagaatggagggacaactcgaagaagggaggggtgttccagataagagacaaacaaacattcttttgagtttctggtaagtctttccaaaggaagcaatcaaatatgcatttatctcagtgagcagagggatgactttgagttctgtttgtcctttgtcctcaagaaatgtccctgtggacaaattgtgagggaggtatgtagcttttttatcttagtagctatcgtttttaggaatagaatgggagcaggtttgccctaagcagtttccaggttgacttttccttttagcttagtgattttggggtcctttcacagctatttcataaataaactatttttaattttcttctttgatctcatttattttttaaaaacagttggggatcctcttagagtcgcaccctgcaaggcatcgcaagcattcgcactaggaccgtacagtgccaagatgaggannnnnnnnnnnnnnnnnnnntaatttccagtttcatcatatggttattagagaatgtgatctatagtctttcttatttataaatttataaaatttacaaattttgtttctaaaatttatcaaaatttccctatgacaaattatgtaattagctattgtatttcatgtatatgccagaaggtgaattccctgttgctagattaccaagataaatatatgttgattcattttattttattttattttattttttattattatactttaagttttagggtacatgtgcacaatgtgcaggttagttacatatgtatacatgtgccatgctggtgcgctgcacccactaactcgtcatttagcattaggtatatctcccaatgctatccctcccccctccccccaccccacaacagtcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgacatattgattaccataattatcatgtttgattttattatttttatctttattttttattactgtttgctttctattctgtattttgcaataaagtccagtttttaaatttttatttatttgtatttgtatttatttatttttttgagatggagtctcgctctgtagcccaggctggagtgcagtggcaccatctcggctcactgcaagctccacctcctgggttcacgccattctcctgcctcagcctcccgagtacctgggattacaggcgcccgccaccacgcccggctaatttttttgtatttttagtagagacggggtttcaccgtgttagccaggatggtctcgatctcctgacctcgtgatccacctgcctcggcctcccaaagttctgggattacaggcgtgagccaccgcgcccggcccatgttttttactttgagtttctgtaatgatttaaaaagtagaaactttttttttttttgagacagagtctagctttgtcgcccaggctagcatgcagtgatgcgatcttggctcactgcaacctacacctccctggttcaaatgattctcccgcctcaggagagagtaatcccagagggattacagatgtgtgccaccatgcccagctaatttttgtatttttagtagagatggggtgtcatcatgttggtcagggtggtctggaactcctgacctcaagtgatctgcctgccttgacctcccaaagtgctgagattaccagtgtgagctactgtgccaggcggaaacttctttttaattccactgttgcttactataaagataatatagacttaaaacctctttattattatgaaaatgtaaatattattttaatatttgttggttttttgtatctagaagtttttactctgacttttaagctagaatatttttatcttgttaaaaaaaattactatttcttcttcactacatcttctagtttcttgaattaatttcttgagtctaatgaatttatagaactttgctcaagcaatattttggaccaatatttcctttatgtgcttacagttagacgacaaggtgaaaccagctttgcctccttcctgtttaggaaaacagaaaattctacctgcccagtttttagttggataaaaggagcaaggaataaaaaaaatattttggcaaatttactagatattgacaataaagtcaaatcatccaaagattgatgaaaatcaaatgtttaaaagcaaatatttcctcaaaaaaaaaaaaacacttaattccaatagagtcctagaagaagttttagaagtagttctcaaatgggtgagatcttgctacctaggggacatttggcttgtctggagacatttttggttgtcacaactctggggagagtagggatggaaaggcagggaggaggtgggtgctcctgacatctggtggaggccatagatgctgctaaatatcctacagtgcaccaggcagcctctcacaacaaagaatgatctggtcccaaatatcaattatgccatggttatacctgtgtagcttacatgctacctattgtgcctgaatgaattgcttacttaaagacttcagcaatacagttttctgtattgctctctctgttttggatttcagggctctcacaagctatgatcaagagtcttcagccaaattaaaataatggatcattttcccacactgaaaaatattctctaggggaatgtctttcaactctagaattttaagctctattcttagtggtttcatatctataaatactgttccttcaagaaggatatgaagcaagctttatttctgtatttctaaaaagtaaaattgaacgttagattattggaacaattatttttactgaattatagtttaaggttagcctttgttatatataatgatttattctgtttaaacaggaaaaatgttaagtccagcctccagctatggtgattaaatcatctcagttgctgtgtgacatctacttcttgtttctttccttgctatttaatacttaaagtgtggtgccccacttgtttgccaggagcagtatcacatcagactctgctgttaacaaggtccccaggtgattcatatgcacattaaagttcattttgcacctcttttggcattgactttactttcagtggcctattttatgtaatgtaaaattgtgtaggctgcctccaattattttagaagtaggaaaaggcaaatgtcttttgtgtctgtttgaagtaggctatttctggattaaagaaatacacatgcacactcaccggtttgagaaaattcagaaaagtacaaataatttgacacggttaaccctttgttacaatctcaccaatacactacaatgtagcagtctctcgtgaggtatcagccagagttttttgtctcacaaccaagaaaattaaggagcatggacacaaagggtgaggttggagcaaaagtttagtaagtgaaagaagaaagctcttcgaggcagagagcgggcctgaaagagagttgctgtttttatagttgaatgcaaaggcttttacaggaaaccagtgagggctgggagtctcatttgcataaggtgcaaatttctggtggctccaccccatcatactagtgcacatgcaggcccttagcttgagttactccatattgctttgttccctttactgtgcatgtgttagaggacggaattttccattgtgggcatatctgggaagtcagctgtgtaacctttcttatatgtgtggctgcaggcatgtcttaggcaagccccttgtgcaaaattatctgtgcctgcagcttgatttctcaggctgttcttttgattgaaagaattcaactgagaacccatcctaactggctgcctgatcagtttcttcctttctcttctctcactttagcaattacctttttgtttttttttcctgtgcatatgtctttgtataaattataattttgtccaacctttttttaaacattttgtcataaacatttcctgaaccattttctataaacattttctcaaccattttctataggtatttgtaggtaatatcaatggttgtataatattccattttatggacatggcataatttattaaatcactttatagggtataatttctgaattaaaaagaaaattaatatgggcattgggtaagaacctacacatattttgcatttttttcctgaatattagatcctctaaaggagattgtcttccatagcaagtacagaactccctatctatgatggtttatcccccaaggctctgacggaagtattccattgtatcactcacacaaaacaaaagtggatataatacttctcaatattttccattggatctcctctagcaatagggaagggtgatttagaatctctgtgaatctcaggctgtagtccaaagcacccatacattgcacatttgatatttaatttagatgtaatttcttcttgaaaaaaatgtgaatttgtattgcattctgtaatgtataaataatgttgtttattacttatgagtgaaatggacactatctttaagttctatttcagattatgcatttttatgctgtattttcatctctctctctctctctttctttcctcttttatttcttttttatagacaagcttttgctctgtcacccagtctgcagtggagttgtgagagcatagctcactgcagcctcaaacttctaggctcaagacatcctcctgccttagcctcctgagtagctgggactatatagacacatgctgctatgcctgactaattttaattttttaaatgttaatttttaaacttttttcattttttgtaggggtctcactttgttgactcatctcaaactcctgggctcaagcaatcctcagcatcccaaagtgttgggattataggcatgagccattgtgcctggctgtcctgtattttcttaaactccttgtcaaggtttaagtactccaatatagaagcaaccaaataattgaattgttgctcaaagaaaaaagacttactgtaatgggagataattttccctttgacatcacagcataaagacaacttggtctcccatatacatgtattacccatggtattagtttcctgtggattctgtaacaaattaccacaaatttggttgtttaaaacaacggaaatttatcctttgcaattctagagaccggaagtttgaaattagtatcactggactgaaataaaggagttgtcagggctgctgttccatcagagtctctaagggagaattccttcctttccttttccagctcctggtgggtgccagcattccttgacttgtggctacatcactccaatttctgcctttgtggacacattgtattctctttttctgtgcttgtaatctccctcttacaaggataggtgtgattgcatttagagctcacccaggtaatccagaataacttccctattgcaagatcattcatttaatcacatctgcaaagattctattgtttctgccatataaggtaacattcacaggtttcagggattagggcatggatatctgttgagaggccattttttcagcctaccacactaatctttactctttctgttaatcaattgtgtcactctcctgtcctgtgttacttatctattgccacatatttaaccacccctgcaactcagtggcttaataacaatcatcatttgatttttttcataactctgttggtcagcaatttgggttgggctcagctggaaagttcttcagcaagtcttttctgaattcacttagaagctgcctggttcaagcaggagcttcacttacgtctgactgttggtactagttgtcagccaggccatgtggactcggagttatgattctttgggggcaattaggttaacaattttctgtgtctcctatttttaataattttggaaatccaagtttatacaaaaacattcccacttattggaaaaattctttgcttttttaaacatactttaaaaattattgctgggtgcggtggctcacacctgtaatcccagcactttgggaggccaacacgagtagattgcttgagcccaggagtttgagaccagcctgggcaacatggtgaaaccctgtctctacaaaaatacaagaattgggcaggcatggtggtgggcacctgtagtcccagcgactccagaggctgaagtgggagaattgcttgagcccaggaagtggaggatgcaatgaatcgagatcgtgcctctgcactccagcttgggtgacagagtgagaccctgtttaaaaaaaaaaaaagttactaagcttctgtcatgttacaaacacttcaagtttataggaaagatgaaatacacatacacataatgtaaaaacaataataagcaaccaagactgattataagaaattatgtcattgtttatgctgtgcttgtgctttttgggtttttaaaaatgctgtatagatgactaacaggtaagaaacatcttattcttaatacctaatccctaaggaaatcataacctcatttggcatgaggccagccctaatcatgttgggagaaattctgcaggtaattttcatgtacctagagaatttctgattatttgaaagctgaatggaaatatcaaaaaataaaaataaaaataatgcccttattattattgtgctctttaaaacgaattgattgtagtctttttgaaaatcagtttttagtagctgcagaaatcatacagcctagaggcagttttcattttttaaaaaatattgcttgtaagtaaccatatgtggccaaattgattgcatatgttgactcaatttttggaagaagtaatcttagtcatacgtactacaggacctccttgttctctgagaaaaatgtcactttgggaaatttgcacaaaaaattttcaaagtagtgcaaaacaacatatgacaaaataacataaaattttttgagttgagtttccaaatgtaagtgcttgtgtgggatttcagaatgatgtttatacatatattctgcaagatcccatttcactgacattttattggtaatagatgaaaagttttattaattaaaatttgagttttaccatatctgacatgaatcccaaaaagaagataataaggactttcaaaaatttataatataattgattgttaaaattgtgtggtggtaacatatagtttgcacttcatgttggaatttgaaaaaatataaatcaatatgaaagtaatttttattatacttaatatatgcctcataaaagaaatgcaaaaagaaaattatttaaggatatacatttcagacctactaaaagagagtgaaatttagggtgacaaagctgtacttcaggaaaagaaaaaaaatgagacaatgatttaagttaaatgtttgaatttagacaccaaggttgaagaatgctggcacagtccagaggaaatgaatgatggaatgggactctggacaaggcctctgccaccacctcagtattactgaccttacctttccaggagaagctctgacctcggtggttgctcatgaccagatttctgctcttgtcttttccaataaactcgtctcacctggatggagactttgtgatcatacctaagacagttcttcagcagcctgagccccattcctagagactttccaatgtgtcctctgccttttgcctttcttatcatagatctcctgatactgacctataagctgcattttactaaggttcaggagctgtgtggtttgagttaccttcacacctatcactgcctgtgctggtaaggcttcctgtcttaatgtgatacctccgttttccactgtccacacgtacgtgatgccacctgggttagcctggcatttgtttttacatctgctttctcccactccagctataggttaggtgtgttagtactacaaaattgatcttgcgaaaaaggcgaaaggaccggcagaactgacgtccttttgtacatgagaggaaaggagaaagggagagagggcagaaattatgtttagggcacaaactatgtttagggcactaggccaggtagtttccatatagactctcactttatatagctctctaggaagcaggtgtgaatagctcccttaagtaaggacacatagttaataatagggggagattttctgaaaaagaccaggcattttccaccacaacttgctgcttcctgatgagtttggaacatccccagtggacagattctggttttttctgtatatattatataatcatggtaattgaaattaagtactgaagaacttttggaactttttggcagagatatctgaaagctgatttgatttttgttgaagtatgaagacagtaaaatatggtaaagtgtgataaggagccacagagtaataaaaatagctaaatgtatgagaaaagatctgaagggaaggaagaatattaaaggctttacagaataaagcagacattcctatgtgtgttaatagagaacataggtaacaagacaagagagatgagtgtagtagatgggaaaacaaaaacatctctttcttttcctcttaccccaccctacaccccaattaaaaaaaaaacccaccaccaaatgaaacaatccatgtaagacaagcaatattaagactatcagtatgatgccagagaaaaagaaggtcggggaagacaaagacactcccaaaacatatttcaagtactcagaaaatgaaaagctgatgggtgaagcaagacctatttgcccttgtctctcttcataccatgttttgtgagcatagctacattcttgccattgtgccgggcactgatgacggatgtgctaggcaagaagacactgcacaaagagctgaaaagaattgcaggattttaaaatcatttttgtgtgtgtgtgtgagacagggtcttgctctgttgcccaggctggagtgcagtggcacaatctcagctcaccgtagcctccacctcccaggctcaaataatcctcccacctcagcctccccattagctgggactacaggtgtgtgccaccatgcctggctaagttttttaatttttttgtagagatggcgtttcactattgcccaggctggtttcgaactcctgggctcaagcaattctcctgccttggcctcccaaagtgctgggattatagacatgagccaccatgcctggtgaattaaataatttttaataaaacttttcaatagtcacaacaatttcagagagtagcgtaagaatgtgagtatcctccttttccctcagtaatttatatgtttcagacggattattcatattcatctcaaagttcagggcccattcctgatctgcccccactctctctgttcatctttgtttccatgtggcctaaacagcgcaacccgcccccagctgctcctaccagagacctgggagttattccaggtgcctccttatcccttcctccagccctcaccaagcactgtcaattccacgtcttcgttgttcttgaatctgttcactgctttccacgacctccaccgccaacctagtccaagccaacagcctcttttgcctggatttgtccaaagacaaaattacaacaaatttagtttaaagctctccattggctttattgcaattctagaatcaggtgacacttcatcccataaaatagaataagtgtttcaatgactctagcagaggaggttggctctagagacagaaaaagggctgaagaaagaacaaaagtggattggttatttcaaagttactttccttgttaggcagagacagggagacagaggaatagaaaggtaatggattggttaaggactaaaagtgaggaacttaattttcatacttactggcctgtttggaaaattggcttttatctctctcctgatttctcggaaggtcagatgacttagttttagtttggtgacatggaactcagaacaagtgactccattttgatttttagcctggtctctcggagctcaaggcaggaacttagtccaaaataatggcctcctatagtgattactgaacagactaccacaatatcctctgacttcttttccttattatcctctcagcccctccaattcattctccgcaccaggtgtgggcaaactttttctacaaagggccagaaaataaatattttcagccctgccggccatacggtctctgtctgtgtcaactactcaatgctgccatttataggagaaagcagccatagccagtgcataaagaaacaggcgtggcggcatgcaagtaaaaccttatttacacaacagaccgcagcaggatttggtgttctcatcactgtttgctgagagtccttggtctacactgaagctagggatccttcttaaatgcagaggatatcctgtcaggcccctgcctaatgttatttaattgacttgctgctgctcaaggacatgcattcacaatgtcttgcttcttaaccttgcttattttgagccccttccttcttgctcattttgtacctgttctttggctttctttcgttcagatccttgaaagctcctttctgagctaggacctttgcacgagctgttttacggttccctggaaatcttgactttcctaacccctgctcaaccttctgtctttagcttaaatgttaccttctcagggaaaccttccttgtctttccagactgatttagtttttttctactagatccatacttttttttcatttatctcaactttttaaaattaaataaaaatctttgtgtgactgtctagcatttagctccttgctaaactgtcaactcccagggtcagggaacatgtgggagttttcaactccgaattctcaacattttgtctagtgctttgtatagtgggcacttagcaaatatttgctaaaaaaaatacatttaaatctataattttcatctataatgtgaacattgatattggagaaatgggtgcaagttggcaagccaaggtgaaatagcgatgttatagtgttcacctatcagctatagagagcacacagattttgcaagaaaagcttttaggttgaaccacatgaaactacctatatctgactactcttgacctacagaaaaggtcatttcatgtgccttaatgtaatactaaatattatatactctttttcttttggcatcttactttcagcacctaaagaactcggtggaacgatgagcactaatatggcacctggcacattgagcactgtatttaataagcttttgatggatatgaggttctggaagtaagaaagagggaagctgccagtgtgaagggtatatgcaggaagaggagctaccacaatacctggtagttgagtgcgtgataacacaacatctgccatagcttggtttgtttgacccctccaaatctcatgttgaaatttgacccttagtgttggagatggggcctaatgggaggtatttatgtcatgggggcagatccctggtgaatgtcttagtgccatccttactgtaatgagtgagttttgctcttagtcccctcaaaacctgttgttaaaaaaaagcctggcacctcccttcttttgctctggctttctctctcaccatatgatctctgcacatgctggctcccctcaccttctgccatgagtggaagcagcctgaagccctcaccagaagcagatgctggtggcatgcttcttgtgcagcctgcaaaaccatgagctgaataaacctcttgtctttatgaattacccagcctcaagtattcctttatagcaacacaaatggactaagataacatctttgaagctagtttgccaaagttataggaaaaaagatggaaaagcaagagtctcaaataagttatacagcctcaatgaaatgataaaggaccatgactttgcatataatggctttctgagaaagttgaaatgctaatgcctttcaggctacagaaaaactgactttggaaaagaattcagagaagcaaaagaagaagagatgaaagcttgagtttgtgtttataagagcagatatgtaaccaatttattagtggaacatgttatgggttattatatcataggaaaataattataaatatgatgtaaaatattaattcctgaaagttttggaaagtaaaatagaattttttctgtgtaataagttagtataattcttagccaggatatgaggactatgacctcttatgtgcttttgtagttctgtgattccataaaagatgtagaagggaagtaaaaaataacattacacataaatttgaacatgttttgtttatcgtatataataatacgtgtgctgacatttatttactttatgtttcttgtacattttaaatatcaatccatgccattttatagcaaaatctttgattcttcacttcctgttgtgaatcagttccaagaaggctttaccctatcactccattaaagactataatcttcatcactgtttagatcaccagtggccaccttctggctaaatacagtagtaattggacacacagttgaccctacggaccatgctttccttcatagaacactttttaacctggttgccagggcttggtttcttggttctcttcctacctctgggctgattcttctttgccatctttgatagtttctcctcaacttcccaaactcaaatatttagaaaccctagcactctgttcttgaccttcctctcttctttgcatacatttattaggtttatgactttcaaacttattttgatccctacatataaaaaatatattttgcagcatttcccagcacacatacacacacacacacacacacacacgtgtgcacagaatccaagttctcttttctatatcattaaaaaatcctctttatacccactaaattgattttactacccacttagtgagtcatgacttgcagttggaaaaacatttttctaggtgatctcatataatctcatggctttagatgctgcatttattctgatggtacctaaatatataggcatgacagtgtgggatagtaaaaatgtgcattgcatagaaaccatacagcatgatctatgtaatcaatggggaaagttatgattgtttcctgatctttacaactagaaaaaatattaaaaactcatactattgtatggctgtgttccaataaaactttatttacaaaaaacaggtggccagcccatacactgcagtttgctgaaccatgatctagactattccaaaaactttttggaagaatcatttctggatcatcttagacagaaaaatctttttaattatttagagatgggctcttgctatattgcccaggtttgtcttaaactcctgggctcaagtgatcctcctgccccagcctcctgtgtagctgagactgcaggcatgtgccaatgtgcctaactgaagaaaaatagttttaaaataaatcttttctttaaggaaaaagcttttgtagagtcgaagaggaaaagcttctactttgccctctaaaggtttaccgaaaaccactgaacaaaaggcagattactaagaaaaaaaggcatgcaaaatttatttaatgtgcataagcacaggagacttggaggattacccagtgaagtctaggtgcttatatatccttcttcatagggaagtgtgaaagtgagatcctggggaactagtcatgaggactgctgttctctatgttgtctcctttctcagacaggtccttctctcagaagaataaattcccacaaaagtccttaattgagtgttattggtctggctggggtcacatgctcatatctgaaacagttgctgaggtcagagatgaagaatagtgattctaagccctgggtcagatggactgagagtgaagaagaaaatcatgatgccgtgcctcaatgcaggagaaattaattctggtccagcaaaagcttcacatgtcccctctggacaccatttaagtaatattttcagcatattttttcagagcctgcatcctgtattaaatcagctctgttctgtcattgtcccagatcctgtatctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcatgcattgggtatgatgggaggaaagacagtcagccaatctgggagcaatctgggagcagagtgtggggtgtggagagaattcagggaaggtgttctagaggagctaacatctgagctgaatcttgaagtttgagtaagagtttctggatgtagaaggggaggcatctaggcagaaggaacagaatgaacgcacatatggagaggagacagagcatggtgtgtgacgagctgctgataatttaacattgcttcaggatgaggtgtgaatcagaaagtgtctggaggggtggaagagactagatgttggcactcaacataagttgcctagtgtttagattaagttcagatatgaatgaatttagactttatcctgtgagaattaaggagatcttgaaggcgcttacttaggggaaggatatctgtggatgaatattttagaaaaatcactctggcgattgtgtggaggaggcaagatcagttctggaggtgggaggacagacagtttaggagactattttaacagacccagtgggagatgatgagggtagtggatgggagaatgttcagaagggaatgagtatgagcaatactggcgaagtttgataaatggagttatgtgagggagttgttttgcagcacggggctttcctggatatgagtcctcaggttaggaaggccattttggtctagagaaagtgacaggtatatttggtagtacaaaaaagcctttgaggaaagagtaggggaaacaattggtcatctatccttctttatttgaggcacaatttccccctccattggtgtattttatcaacatgtattcattgagaatctcctatatgattgtcactgtgctgagattctaactatgaacaaagcgatcataacccttgctcctgggtcctacagtttagtgggaaagacaaatggataatttgaatgggtcatttcaaacacgatgagtgttacaaagtcactaaaattaacatggttttaaaaagatgaaacagatctaatgcagtggaagagttcatcgtgacttccaggctagtgggtagtaaggattgtaaaggctaatgccagcttctttgactggggcaatactttatatggactgattttggatttcttggcactcatggactgtagagtttgtagtagagtttcaagagtgcttgcgcaaaggatgtgcacggatggcaaaaatcagaggtagagatgcatagttcacctctagttctaaggctggcccctttaatattgggcaggccagtagaaatgcagatttggtgcaaagcttcatatctgtcctggtgttttaaaagagtaagtgtttccaaaggtgtctgattttcagtcaggaagaagcttaaaccttcagagattctgtctcttataattctgacttagaaaaaagggaataatgagaaacacttcatttgccttgttcattgaagatgcttttggataaataatctagcatcatgtttgaaaaaccgaccaaccaaccaaccaaaccaatgttaacaagaacaatagcaaaacaagaataacaacgtaaaaagcagttgtctaataattcccaaaaggtggccttgggttgagccaactttaaaattttagtaaggcagcaaaaagatcacgtgaaagagaaatggataaggtagaagaagatggtggggagggggaatagaattaactgtgaaaggagagtagactgtgtctttattgttggtcattctgatttataagtcaacagaaattcatttcctagttaaattgttagaaataaattattcatggaagagccatctgtgttctctattgccaatttctccacataaaaggaacaatgtgttgtggcagaagtcggctgaagcttttttttttttaatgtgactcatgtcactttgaagatttactttactttcaaacttatatctcagttctcagtgtgacaggaggttcatgttacatttcttcctcttacaaaaaatccagagagacttctaatcaaagaattatattgatactaatgagaaaatatatatttacggttgctgctagacatttctatatataaaagataggggcagcagactgattggaagaggggagcagtttacaacaaatagagcaaatgtcaacattctggataaaatcatgttgaggcaatcaaggaaccgatagcatgatgagagggctaaagcactccccagatcagctcgtgagcccattaaatgaacaaaatgcaattcccttgtttatgaagtttatttctctgttttctataattttttgtttagcttttaataccttagctcaaagatcatcatttgcatagtgcaattatattgttacatagctttgcattagatatccatatcagcctttcttgccttcttcagtttttcctactataaacattgtgcatgtgtgtgtgtttttctgtttttactctctgtgtatcctttctaggttcccaacatgccgctcctgctgtgaaggctttaaccagaaaaactcctaatgttcttctgccagggatatatcagtgggaggcaggaagaatggtggttttaaagttcatcttcattattatagaaaataactttggctctttacttatctagaagttagatcagtttgaactgagccccttgtaatatagatgttggcaatatggaagtgtaccaaagtattcatttgcagagaaattaatcaaagataagtttcagaatccccttagctgctgctgctgctctcacaaccccacccccccacacacacacaagctgtggtttctggaacagtggtctggtgtgcaggatttggaaaaatgccactgatttcatgattcatatgcacaccatggaaataaacaagagcaaacttctataataatttaggtactttaagtcttatccactttgtgggattttttcctcgtaccttcccaactgagttcctgtagccctatataaacattagcatcattgctgggagaattccaaggagtgagtcagaaaataccacctctgcccctatgtcaccgatttggaaatatttgccttgaggggttgtcctcagtgacttctgagtccttgatagacactaactaattagcacttgaaaactgcctccgagacctggaacttgttggttgccagagaggctggtgtgctccttctttcatgtgcagcattagcaaatgccggtgtggtatgaatcttaaaaattcagctctgacaatctaatctcaataatgaaagtataaaaacgctattgcatcaatggaaatgcagatgtcactgggtggcaaatgcatcagtacaaaggcacatccaaagggaggcaaagtcggagacgtgcaggtgctgagttagatcttgactgcacacctggacctttacagcagtattcccagggggtgaccacatgtttgggtttgctcaggatggccccatttatgactgtttccctggcagaattaatcgtcgagaccccgttcactctcaagaatcttgatttgattgttaatctgatgaacagtgaaagtgttttcaatggctcaaatagcataaagaaacccagagtatctggagaatgaagcaatttgaggaagtggctcctatagatcctgaactccttaacaggccagattaatagcacttggtggaccttggctttcctgtgacatagtacgtcccagtgactccatttgctacagagtggagccatcatttgaatttccatcacggcctgtctctggagcagaccactgtggtactggggttttgggggctctctcaagccagcttcatagactcgctaaccttattttacaagtagcattctagaaccagtcattataactttcagggtgggcattttccacgagatcctggttccaattacgcctaattatttgttatgtcctatttgggttttctttttacagatctttaagaaattttcctttggctctgagttgagtcaaaatgttgagttcaactttcatcctaagcaagatagagggcatgaattatggttgaggacttatgcatattttgaccaaatgaaaatgaccactgttgctccagcccaattgctgctactctagattgtgaatgcagatatagtcaaaatgactttggtaaatgcttctaatcatgactgattatctttttggctggtagaggaagtaggaatgcattcatattttgtatgaaaggtagcgttctttttgtaaattcttgctatttaaataactttttgggtttgtcaaaaccttttcaaatttttccagttaaagtttcttcctacagcaagacggtgagtttgttttttttttttgttttttttttgtttttttttttttgagacagggtctagctctgtcacccaggctggagtgcaggagtgtgatcatggctgactgcagccttgaacttctgggctcaagcaatcctcccaccttggcctcctgagtagctgggactacaggtggatgctaccatgcccagctaattttgtaattcttttgtacagacagagtcttgcgatgttgcccaggctagtcttgaactcctcggttcaagtgatcctcctgcctcagcctctcaaagtgttgggattacaggcatgaaccactgtacccagcctagcaaaacattgagtttttataccaaaaatatacagcagctcgtgctagtgtatccacagtactacttccatatttccttctgatattcctcaaacttatcttcttgagatgggaataaactcaacatacaggaagttcatacaaaagtgctaaattcagtttccagattataacaaggccccataaacatcaaaacatcagaggttgatctgtgctgttcaatatgctacccacatatagctatttaaatttaaattaattaaaattaagaataaataaaaatccagttcctcagttgcactacccacatttcaagtgctcaaatgttatttcccgggacagtacagagagagaaaattgccaccactgcagaaagttctactggagagtaatggtgtaggaacaggcagaccttatataaaacaatccttttattttctggtgaaaatggaattgagccaacctttcatgcgttcctagttctgattctgtgccattaagtcagagcactatgagaatccctatattaccttgaggaagaacagtgaaaatttacagtgctgcagctgtcccagaattcagaacccatgatctaggagactttagatttcatgaaagtaaggtctaagcttaccctgtttttcactgcaatcccagggtctggcacatagtagactttcaataaacacttgtgtaatgaatagttgagggaacccagcaaggacccattaaaagggcctaactacaaaaacacgggcatctcttggggtttggatcatttttgagggttccctgggaatcatgcgaaggggcaggcagtagccattggagatttctcctttgtagaagccacagcacagcatagggcaaatggcatttgctgagtagcttctcctttttcttctctttcttctctgtctcctctccttctcatctccctattccaacatcctatcaaattgctaattctgtggagcatttattaaatgccagccactattctaaggtcctttaatagattatttcatcttcccagtgattctattgtattgctttgctaaggccaccataacaaaataccacagactgggtagctttaaccacaaacatttattttttcacagttctggagactggaagtctgagatcaaaggcaggcaggtttgttttctcctgaggcctctctccttggcttgcagatggccgcctcctcactgtatcctcacatggccctttctgtgtatctgcatcactagtgtctctttctgtgtccaattttctcttcttataaggacaccagtcaggttggattaggtgcatcccaatagcctcattttaacttaactgcctatgtaaaggccttatcttcaaatacagtcacatgctgaggtactgggggataaggctttgctatggtctgaatgtttgtgttctcccaaaagtaatttgttgaaaacctaattgccaatgtgatggcatgaggggaagggcctttgggaggtgatttgtacatgatggctgaatccttatgaatgggattagtgcccttacaatgagaccccagagagttgccttttccatcacatgaggacacagccagaaggtaccatctacgaaccataaagggggcctttagcaaacgccggctctgccagtgccttgaccttggccatcctagcattctgaactgtgagaaattcatttctcttatttatcagttacgcagtttatggtgtttgttgtaacagcctgaatggaccaagccaggcgtcaacatatgaattttgagggtgcacgatttagcccgtaacacctataaagtcggtgttattattagtcccacattatagtagaggaaactgaggcatggagtaaccttgcccaaagtttaacagctggtaaatgatgtaacacagatagacatctcaccagtctgacttcaaagcttgcatttttaaccattagaaggggtactgcattttcttaaattggcaacacatttgggtttgaaactaattagaaaaagatatcattgaccaggcgcagtggctcacgcctgtaatcctaacactttgggaggccaaggcaggcgaattgcctgagctcaggcattcgagaccagcctgggcaacatgatgaaaccacatctctactgaaaaaaaaaaattaaaaaagaaaagaaaaagatatcaccatgagaggtagatcattgcagcattggaggtgatctgcctccccaggtggggagactgtgtacagctattgctgccccagcttctgccgttcttcatatgcttgtcaactgcactgtctccaaagttcctaccagctcagccatattcttcctccctgccctcaatgcgtcttccccagttttatctgggagtgaaacttgtggtggttagagagattcatcttgggctgtggcaatcttcagttgcacaaaccgtgtgaattacaggatggccggagcaactgaagggccagatccctagtcattgcaagtcggatagctttctctctagttactttgttttgtaatactaataagaataaaaattattttaacttcttccatatgtattattccattctctttcttcttattttatttttttaaattttttttgagatggagtcttgctctgtcacctaagctggagtgcagtggcacgaacttggcttactgcaacctctgcctcctgggttcaagccattctcctgcctcagcctcccaggtagctaggattacaggcatgcaccaccacacttggctaatttttgtatttttatagacacgaggttttgccctgttggctgggctggtctcgaactcatgacctcatgtgatctgcccgcctcgaactcccaaagtgctgggtgtacatgtgtgagctattctctttcttctaaaaatatgtaaatttattttccctttttttgttttttttttcttttaggcacagcagaatttattctactttattggtatttttttgttttattggtgttatttatccttcataccgcatatttaattgttttttaaaatactaatttcgcttttagcttttaaaatttctactcctaccttcttttggctggttttggtattttctttgaatttgaaaaaatgaaagaaatgacaaagaaagttaacagcttttaaaaataatggcaataacaagttagatacagaagtagaaaaatgttcttttcacaattgtatagccaggaatagatttaacaaaaaaggtgcaactcccacatgaagaaagatgtacttattgacaggacttgaataaatacaaattaaattcacaagaagatgtaaaatcatgaaaataacagttcttccaaaattaatatttgacttaataaaattccaaccagaattttatttttttaagcaaaaatattattttcggttcatttgaaataataaatgttttagaattccagaaaatatgttagaaaagagacttatattggagcactagtcctactggctattaatacatggttctaagattcttttagcaaaacagcttgatatgaagtctggaaaaaagcagctattataatagaataaagtccagaaatagattaaagtatagatggaaacctaatttatgataaaggtagaatttaaattcagagggaaaacgatgttggtgtaattggcttctaggtagaataagataaaatgaaaccacaaattcacaccatgtatatataaaatatacatgtgaggtggaataaatactgaaatgtcaaaatcagaatataaaataatagaagaaaaattttgattatatttagtttttctttaaaaacaggaaaaatccataagccatttaagaagagttggatagttttcactaacaaaattataaatttctgtgttgaaaaatgcacaacataaagtaagaaatacaagtttagactgagaaaatatttccaatactgcattataaacaaaagtgtaatgtacttatacaatgagacttaataaagcattaagaaacatagaaacaacaggcaaagcataagatttggcaagatacattggatggaatgcagatggccaataaatgtatgaaaaatgtttaactttttaaataaaagaaatacaaattagagtttttgttttgctttgttttgtttgttttgagacagggtcttgctctgtcacccaggttggagtgcagtggcgtgatcacgactcctgaactcaagtgatccacctgcctcagcctcccaaagtgctgggattacaggcatgagccactgcgcccggcctagagttattttctaatagtttggaaaaaataataatttttattgctggccttagaatgagtaaacaaaccctttcacacattacgaaggggggtgtgaattgctacaattgttttgggaaaagctattgaaatataaaattcatattctcctcaaatcaacaacactgctgttagaaatcttacctactgaaatgaaagcacaagtatgtattgataaacaaattatgcaaaacttaacaatggagatatgttttgagaaattagttgttagatgattttgtcattgaatgaacatcagactatatggtagagcctactacacatgtaggttatgtggtatagcctattgctcctaggctacaaacccgtctggcatattactgtactgaacactgtcatacattggtaagcatttgtatatctaaatatagaaaaggtacaataaaaatacagcatgaaagattaaaaatggtacacctgtatagggcacttaccatgactgtaggactgaaagttgctctgggtgagttagtgagtgctgaatgaatgtgacggcctaggacatgaccatttaaaactgtaaaccttattaacactggatactttggttacacaaaatttattaagaaatatttttatggccaggagtggtggctcacacctgtaatcccagcactttgggagaccgaggcgggcagattacctgaggtcaggatttcaagaccagcctggccaacatggcgaaaccccgtctctactaaaaatacaaaaattagccaggcgtggtggcgcatgcctgtaatcccagctacttgggaggctgaggcaggagaatcacttgaatccaggaggcagaggttgaggtgagctgagatcacgccactgcactccagcctgggcgacagagggagactctgtctttaaaaaaaaaaaaagaaaagaaaagaaaagaaaagaaatatctttattttttcagtaacaaattaaccttagcttacagtaactttttttacattataaatttaaaattttttgactcttttgtaatcacacagcttaaaacacagaagcattctatagctgtacaaaaatcttttctttctcttatatcctattctataagcctttttgtattttaaaaatttttgtatttttctactttttaaattctttttttaaaaaaacaaggacacaaacacacagattaacctaggcctacacagggtcaggaacatcaaaacataggccctaggcaatgggaaatcttcagatccattataatcttatgggattgcagtcatatgtggggttaatcattgactagaatgtcattatatggcctatgactgtacattgattttactaaatatatgcatgtatatatacatatgtacatatccacaaggatgtttattgccttttcagaaggttcatcaataggagagaggtaaaaattattgtgtatttataaaaggaattgttacccactattataaagaataagatctaagtgtgttgacctatagaggggtagagagaggaaaggagattatgaacttttcaaaaataaaacttcagataattttgtttgtcacaggagaatgcattacttttcatattaattataataatggttaccacttattgaccgttacgatggaccaagtgtagcgggaatttaaatatatcatttataattctcacaagaacatgcaagaacaatgtcttcagttacctatggggaactgaggctcagattggcagtcaagtggtggagccaggattcagcccctagcccatctgctgagaaagtctttgctctttcttctggttcctaccatggctgcatcatcttctgtgtgggccctaacggggagcaggaaatgccccacttctctctgggcatgggagccataagaaggaggtccctaacatgtacaaccactgctggttttggtcctggggagaactaataaagaataaagcaaaaaaaaaacccttcttttatcattgcgagcattgtcaccagtcctaactgaccactccactctaccacacccatagcaatgggctgccttactgtgtcatttttgatcgtcagtccactatccagtgaattattgcatattcataagctagaatgtggacagtcagggaaggccagcatggaagaggtaaacacctgaaacttgattatggagacagagtcagagggtagtgatgttctttggttgtggtgctacatcgtgggttgctgagttccagtactgctgtgaataagctctgtggtataggggaagatatttaaactcctgatgccctaggttttctcatctgtaaaacgcagatgaaaagagttcctacttcttagcgtgtgtttgtgtgcacacaggcacatgcacctgtgtgtatttgagtgtatattaaatgaattaatacacagcccttggaaaagtccccaccacagggtaagcccaaaagtacatgaaggccattattatgattatcaagaccaatcctcagattctaggtctaataagatagtttacttttggcatgattagcctatgattaccaatgtcataatgctaatgcctgcatttataccatgagtttaaagaaggataagatcaggtcgaggttaataaccatttgaattctgacatgtttgtgacacaataatgttcacgggtgacaccaaaaatgttgaattataatttgctttcttgaatcccggtttattttaggaggggcctaattttttgtgtgactcctgttaattttcatgactgtccttgttgctctgttgtctgtgtcttttcctgtcttggatgttggggagatgagcgatatgtagataggagaggtgagtgtgagggcagaagtgtggttggttgagtgttgaagagagagtaacagacccgtaaagaaaaccacagtatttcctacccttgatgctgagatatgcgatgaatatatctatctgttgatagagctgtttaggtttttgtttatttgtttgggtttcgtgcaatttcatgtaaaatttttctggtaattttttgttatttaattatcttcccagaagagaaattcttttttttttctgggtttggggcacattgctttatctttttctgagttgttaagcagttagaaaattattttaaatagattttttttgatacacttgatgatttttatcagtaaacttgaaaacggctgtttattttggtcacaaagaaatattttaataatgcttttgacaagatatctcaaaccatctgaatagagaatcttaaatagctttaaaagaatcatgaacttattagcaaaaataatgaagttcagtataacatttaagttgacattttgagatagtagataaagtttacttgggacacacatgaaattaaaggtgattcgttagtgtttagtaactgtctttatttcttcatttttttgttttatattttatttagcaaaacatcttaatattatttttagtttggagtgtttgtagaatatttaaataaacattaaaaaattcctaagggaagggacaggtgaaatactaatacaaacaaaaactgttacaaaatcagaaatgtcaagattttggggggctactgtgtatctgtttatctacttgatcttatatgcgattttgtctttcatttcattactcttcttcattgggaagaaaaaatcctctcaaggtcctatctcagtccctgaagaaataaataaaaaagagtagcagaagatggatgagattgagtgggaggtaaaattagaatggttgcaatcagtaaaaatcttgaaagtactttagtgagagaaccataaacaaaatatgatagtgcatatcctataagatccatgattactcataatttattcacaagtacattaaaaatgtaaaaccatgcataattatttaatgtataattaaaatttaaatattgaatttgaaactgggacaagcaatacgctttcctgtcatctgaacagttctggagtatcataggattatttcatgtctgataatattccatcatcttcctgtatctaacatcagatttaatacacacagcaggtactttttgatcatacagtttagcatttataatgaatcttggagctgaagccatatagcagccttgaaaattatgctgtatgcctttgaatgcgtgggcactcaagtaggttggagtaagaaaaagcactcaagtttttgttgttgttgttgtctttaattattttaaaagtcagtctcatttgatctctctttctttcccccactcttgattttggaggttccaaatggcctttctccactcaaagagtggttcttaggcctgcaggatagcatggtccactgacaagccgcatggcatcccaggggagcttattagagctacaggctctcaggccccactccagatctgccgaattggaatctgcattttaataggatcttccgttgcttcacgtgacatccaaatttgaggagccctgccatatgggataggtctgaatcaggccgatgttattgtctatattcctggaaggattgcttaattttccaaacttgtttgggttctgtagctttttgaatgatcccagggacgcctgatattcctgttggaagtttctaagtctccaacagggaagatcatctatattattattaccagtatgagtaacaacaatgggtgatatgatttccatttattagctacccactagtggagcatgatgcaaaatgtctcatctgtgtatttcacctgtaatcctctcaacaactcagcagaagaggttttattattatttatttatttatttatttatttacttgagacagagtctcgctccgttgcccaggctggagtgcagtggtgcgatctctgttcactgcaacctccacctcccaggttcaagtgattctcctgcctcagcctcctgagtagctgggattacaggcacatgccaccacggctggctaatttttgaatttttagtacagacggggtttcaccatgttggtcaggctggtctcaaactcctgaccttgtgatccacccgcctcggcctcccaaagtgctgggattacagtcgtgagccactgtgctcggcccagaagaggttttaagaagacaatttacagaaaagaaaaccgaggctaggggttattgttcaaggttaaatatacaatgttagttctgaaatcaaacccaagtttgtctcccctaagccacgtaccgcccccccaacccccgttttttttttcgttttttttaaacaatactatattgctacatgccactttggtcctcttgcagtaaggaagggcatataaaagtgccctgtttgtctgggatcagaaaacaagcctgtgtaggcccagagagacaaatatggcttgttgtcacatgtgtgcaagagctaaagtggatctcacagaaggagagggcagaatgatagatactagaggttgggaagggaaggtgagaatgaggagaagttagttaatggacacagttagctagaagaaataagttctaatattcaacactaccgtcggtaaattatatgtaataatttattgtgcatttcaaaatagctagaagagaagaattgcaatgtttccagcacaaagaaaagataaatgtttgaggtgatggatatcctagttacccaaattcgatcattgcatattgtatacatgtatcaaaatatcacatgtatgtataattatatatttatgtacaactatgatataccattaaaaaaagaaaataaacctgtgtataggcatatgctgatatttattgtgactcttatttctgttttctgattctgacttataaatgtgtagaataaggttctttaaatttgtaaaatctttgtacatttttgtgatttgttttttgggttttttttgcaaatgtgggggaagatcattcatagttttgtttaaattgaattttcaaaaaaggccataacccacaaattgttaagagccatcccctaactcagcctgtaccttcatggccctcagctgttgaaattcccaccagtctgctggcatcattgcatccctcccaattactagattttcccagtgccttcttcccagatcattccttctcaatcctgccctggcatcagaatcacctctagaccctgtacagaatacagctgctcaggccccttctcaaaccttctgaaggatgaccttgggaatggggctcagaaacctgtatgtttaagaagctccacaaatgattctgacccagagcgctataagtcagcacaattttctttctttcttttttttttgagatggagtctcactctgtcgcccaggctggagtgcagtggcgcaatctcagctcacaggttcaagtgattctcccgcctcagcctcctgagtagctgggactataggcatgtgccaccacacctggctaattttttgtattttagtagagacggggttttaccatgttggtcaggctggtctcgaactcctgacctcgtgatccgcccacctcggcctcccaaagtgctaggatgaaggcatgagccaccatgcctggccaattttcttattttctttctttctcattttctttccttctttttctttctttttccttccttccttccttccttctttccttccttccttccttcctttctctctctctctctctttctttctttctctctctctttctttctttctttttcagggtctcactctgtcacccaggctgagtgcagtagcatgatcatggctcactgcagtctcaacctcccaggctcaggtgatcctcccacctcaggctcctgagtagctggaaccacaggcttgcaccaccatgcccagctaatttttaaattttttgtagagacagggttttgccatgttgcccaggttggtctcaaactcctaggctcaagtgatcctcccgccttggtttcccaaagtgctgagattacaggcatgagccaccacacccagcttcaattttctttacaaactttgaacaaaaggagatacttcatgaacgtcctcttgtggaatgatctcctggagggagacccaaagcagcccagtcctcccacaagagactcatcatcatctagatctggctttcctggtaagatcctaactaaagaaagagaggtgagcaaaggaaaagaaggtatttccaccttcactagtttataaaaaataatgtcagagtttcaatatttacagaaatgccctcactttttgaaatgcaagcatttgatgccttcacaaaagctagaatttttttttttacaaataccccatacacagtggtgtgctggtaaatgttttacaatcagctctgatttgtagcattgcctatttccatggtgtaaatactcccatcctggccaatttgaagctaccaacttggctcacaaatttcctgaaaattaaaaaagcctctcatatgccagtacaagcctactccatcccaccactgcatatggagagtgattatctgggagagatggcttctggatttctccataggctcaggcatgcagaatgattcagagagctccatttgcttctttattctccttcagaagattctactgcgtggcctactccttccgaaaccagtgcatgttcgacaccgcaagtctttcatgatgatgttgaaaaaaaataacatcctgaagatgttttgacaaattaatttgacttttgaattattttccttttgagagaataaaatgttccaaaggtctcctgggaagagattgttcaaataaggttttatattgttgattttgttttaggtagttaatgctactacctctttatctgtgggttagtaaattgacgtttttctccttcatttatctgtgtctgctagaactgtttgacattctccacccacacaggttctgatgacattacttttactcattgtctatttacctgtgaaaggatgagctgttcattcatgggcataaagagcaatgactgaggaaatggactagtgtttttccattaatttttataatcatgtcttagttcactatgatgacgtacagttttctctttgttccagagaactatcaaaattgtcactgacatttatttacaaccatgatttgtataggacagttttagaaacttgaataccagtagtttgtcaagcaagatacagcgcctgcttctctagaatcaggggatgtttaagaggttatctagtccagcctcacagcttgtctcttagatatctttctgcttctgtgggaattaatgacttctactgactgtagatttgtctggagttttgcagaacaaaccaaatccttccccacataactatcttggaaaacctggagaactttcgacctttggaaacttgatgctgcctcctaaacttttcttctcaacctatgaaatgagcttctcatggaaattattttccaaaatagatatacaaagcacaataaaatatgttaatgagagaatcagctaaattgattcactcgaatcatagttgctgccacaagtcaggtgcattcctattttctttccattacctctagtgtcacttcgtttacctctgttttgtgcttaacttcttagacaaatttatctttccaatttatcttatttgataagaatattagtgaaagacagcagaatcttctaagagagttatctaagataactagaagctaataattctaaaagatgcttcaaggtccaaaaaccctcttcagtaaataaatgcacaaaggcattttgataagcatttgatgtagccgataactattatagcactttaaaaaataattatggtctttttggtgattaatatctacagaaagatttcaaatcatgaaactaaatcattaaaacaatctctgccttatctgatttgtatattaaaacttctctgtgctcacttaacaatgttcttaaacaagtcaaaggtatttttttttttttttgagacagagtcttgcactgttgcccaggatagagtgcagtggcatgatgtcggctcactgcaacctctgcctcctgggttcaagtgattctcctgcctcagcctctcgagtagctggaattacaggcgcccgccaccacatctagctaatttttgtatttttagtagagacagggtttcaccatgttggccaggctggtgtggaactcctgacctcaggtaatccgcctgctttggcctcccaaagtgctgggattacaggcgtgagccaccatgcctggccacaagtcaaaggtttttctgaatctgaaggctttcataggtagcttcttcttgaatggtaataataaggtgttttgtgatactaattttaaattattgatttctgtgaattttaaatgatgaatttatatgaatgggaatggaaattatattgcctttttattgtgaaggtcgtcttgtaggataggactatagagagagcagaaggaattttgaatatctgatattattgctgacaaatattttagaaaaactatataataggttaaagtaaattttcttcattgatttattatggctaatatttagggcaaagggtgatatactctcgtgagtcagtaactgctaggataacttattcagtcaaaaaattttccctaggcccgtttaccgccactccccctaagttgaattcataatgatgcagtgctttggaaaacagctctgtattaatacaaggtaaaaaagcccccacaaaataaaagcttcttttaattatcctagcatgaaatgaaacaaaaagaaaagtaatagggtagacgctaatttcatctttctttctttgtttctctttgtttctctctttctttgtttctctctctctttctctctctctctctctctttctttgtttcgacggagtcttgctctgtcgcccaggctggagtgcagtggcgcgatctcggctcattgcaagctccgcctcctgggttcaagcgattctcctgcctcagcctcccgagtaggagtagctgggactacaggcgtgcaccactatgcccagctaattttttttttttttttttttgagatggagtctcactctgtcgcccaggctggagtatagtggcacgatcttggctcactgcaacctccacctcccaggtttaagcagttctctgcctcagcctcctgagtagctgggattacaggcacccaccaccatgcccggctaatctttgtatttttagtagagacggagtttcaccagcttgaccaggctgctcttgaactcctgacctcgtgatccacccgccactgcctcccaaagtgctgggattacaggtatgagccactgttccaggctgtagcctcattatatgtcttattgtgtttcaaaattctgcagatttcttagacctcagtttccccttttggagaatctttggagaaaccagaagccatctatcccaaataattgctttccacatgcagtggtgggttggagtaggcttttactggcatatgagagcctattttcattttcaggaaatttgtgagccaagtgaccacacattagtagcttcaaattggccagggtgggagtatttacaccatggaaatagtcaatgctacaaattagagctgagtgtgaaacatttaccagcacaccactgtgtatggggtatttgtaaaaagtttgtagctttcttttgtgaaggcatcaaatactttcatttcagaaagttaaggcattgctgctaatattggaactctgacattattttataaacttgtgaagctggaaataccttctgttcttttgctcacctctccttcaattagaatcttagtagagatattttagatgtcatatgtaagacaactttgaaattatattaaaagcaaatgcataattaagattacaaaatgattctgtaatatgtctctgcagaataattctgtaatatattccatcttgactgcccattaaaaatcagatgaagtgagatttcacttttaagatatcatgttgatttggttgttttctaaatttcactctgaaggaagaagcaagaagagagaatataatgctgtcatttcttttgcaatcattttttgttcctttgccttttcttggtttcctttctccacttttttctttactttttcctcatttcttctgtaagtgagtaatctgtttttgtaaccatcctaccccctcgtgttgtttattggacccctggtgacttgcatttcctttaggaatatgcccagcatttttaggctgctaaaatatgagccaattaatgatgttcttattgacgaggtctaggaaacttgtagggttcagtttctgcaagaatgatttacagtctataataggttagaatgtcaaacaaggggaaacaattagtagcactaatgttttaaccccaggtttatcactgagggaggatcattgatgaagaggcccatctgttccaaagatgtttccaacttgcttgtatagcagtttgtaaatcaaatcagtgcggtgattgtgaggcttatatagccacttgtttgtcaatttttaaaaatcactgcttttgtgcacatttcatcatgatatctttgaaaaatggggttttacctgtggaaattacactattgtttttcagcattatgttcagtttattacatgtaccaggaacacgtgttttgaaattgtcaccagctccaagaattatgtaatcagtgagttaaatatataacttccaaatgaattagtgcacctatattttggcaaaaatttgttgttggaggaagaatagattcatcccagagtaagtttcttgtctattttcaggataaaagatgggagaattctgttactataatcaagttctttcttaaaatacccttaacctactttttttccctctaaataatgaatgctccacttcttacatagaatttcacaatttacaacccacattcacatttgttatttcatttcctgttggatattttccctctgctgttttcttcctatagaaaggccattgaataattggctctaagatttgaaaggagtcttcagattatctgttcaattactgtgcctagtgatcagcctgtctcttatttccaaaaggagaagaaaatattagataggtagacagactgatcatggggccaaataacagagtgaaagtaaattttcttttcataggagtggaagacaatattattttttacttttgtctttttatttgatcatttatgtcatgctcaccctactgacatgtggacttctgtttcagtggctctctggtcactttaaggcataaattccttttaccatttgggaacattgctaacttgcctccagcttcaaatttcacccacatggatgtgagtttctggggtgtaaaagagtaacattttatttttgaggcaagagacttctttctttaaagctgcttttttactgatttagttatttcaaatcatattaatacaaattggggcaaattaagagttacaagtctggacttaaaatcatttgcctgctctggtttggaatttatgcagctatttctgccttaattaaaactgtggatatttttaaagcttagaatttattcttatcttattctgacgagaatgcaaatccaaccaggcacattaaatgttctgtgatacggatggaaaaagatagaaactgggcccagccaggctggatttggtttgtgagaagatcgtcttttaataatggcttgattgatgattgtgtgccatgtgaagtaactggaatgctggatggttacatgaaattgtgggaaaattgacacaatggggaaaagatgcttgctgagcctatgaagtgcaacctgtgcaaatatgatgattcctcaattgcaagatcaggaactcaggattactgtgtaaaaaagaaaatgaaggccgggcgtggtggctcacgtctgtaatcccagcactttgggagggctgggtgggggggggcggggcagatcatgaggtcaggaggagttcgagaccagcttggccaatatggtgaaaccctgtctgtactaaaaatacaaaaattagctgggtgtggtggcgtgcgcctgtactcccagctactcaggaggctgaggcagaagaattgcttgaacctaggaggcgggactgcagtgagccgagattgtgccactgcactccagcctgggcaacagagtgagactctgtctcaaaaaaaaaaaaaaaaaaaaaggaaaatgaattagtgaagaaagtaagatgatgtaaaaacaaccatccccagtgtcctgagggtagtgcttctagccgctttccccgctcccccaccccgttgctaggagagagatgagttaacacacagggacgtgtacattataccagccggatccacatacctggcagctgcaacctgttaaacctgtgtttttttcttctgtgtaaacactataaacaggaaggcaaacgtcatccatttacgcagaagagaaaattgatgatgaaaaactgtcactgctttgcttaaaaaagtctaaggtaaagaacgtattgactcagagagggccattcaaaatctaaagtcttcaattttattgctatttctgtattaaggattctgaaggcaaaatttcttcagaatctgttgtttagactttacaacaaaaatagctttggggagctgcttgcctggagaggttttgtggtgactatggaaattaatcttcttgatgggaaatcagctgttcaccatactgctgccttcattcccaaagaagagtttccattcctacctggaatggctagagcctgttggctagagcaatgagccattgaggcctcctgatattccacccgggtgcagcctccttgaagctgcctcaagcccccttcagttactcctttattcccttcactgctccagaagggttttcaagcatctgcagctgcacctctgtctcaagggcaagctctactgtcagccacgctgctgcaaggatgggattgaaaagcaagaccattcatttactctttcattcacaaatttattgaactgatatttaagcttagaatttattcttatcgtattcttacaagaatgcaaatccctactatgttccagactctatgtgggggcacaggtgacacactggtgagctaaaatagatcccatcccaggactaatagaccttacagtctgggtgacagaggagttaatcaaataactacattgatgaatgtatattttcaaactgaggtgttaaaaataacaaacccagcctgggcaacatgacaaaacctcatctctacaaaaaaattagttgggcatggtggtgcacacccatagtcctagctactcagaaggctgatgtgggaggatcacctgagcccgggaggtcgaggctgcagtgagccatgattgtgccactgcactctagcctgggtgacagagtgagcctctgcctcaaaaaaaaaaaaaaaaaaaaagaaagaaagaaaagaaaagaaaaataacaaaggaactgtggacttagactaaagctactccaaggaagctgtatttagccatacttagaaggctgtgcggataaaatatgtgaatatgtgaagcagagagcattatagggacgagcctcgtggctgaaagaaggatggctgaaacacaggagggaaaggctggtgccttgagaggcaccacgccaaaccacatggaggttcaagatctcgtagagaattttggtctttatcatgaaagcaaaggggaagttactgatgggttctttggtggaggtgacctgaggagggttgcgttttaaaaagaaagctttggccttgggagggaaaagagctggagagaggccagaggggtgggaggaatatcccagtttggaaccttgaagcagtttagttacatatccaacattccttcaccgttgcctcactcctgaacattgtccattgcatgtctgagtcttcttccagactctacattccttcagtttaggaatgctgacatatttgcttttggatcccatgtagtgtctgaccctgggatttgcatgtatgtccaacaaatgctgtatttaaacaatgtggctgttccgcatctcacaagtcatgttagttggcttaaaggagcatagctcttctgtattctagtgataacattatatagtgatctaagttattcctgaggacagaaggagttagagatacacttgccttttcttttgctatcatatgtgccttgcattttatttccgtacattagtatcttcaatataatgacctttgttgtcctgtcttcatgtcaacctaaagcattgttattgtcattagtgttactaccgcctcacaaatacatagatatattgggggagatttttcctgagagaaatctgcagatttgaagagaaaccatgtcatacattttctgagtctgaaaatcaggagttgcaaacataaatgagtaaagcagcagtagggaatggcgcagcctgtggcagaactagggggagcatgctctatcccaaagcattcacattcgaacacaaaatatactgtgctagctaaaccagacatctgggggcaagtgtggcttagtgactatgggtttgttgtttcttctttaattgattaaaaaaagatttaaacacagagaagttataaaaattttcagtgtaattaggggttgtgggccaagctttattgagtgacatgaagcttcaaagttgttttggggaagggagcaggaccaaaatgccttcttagtgcaactttttcaaaaaaaacttgtgaagccagcttctaatattcccctggctacttgctctctctctctaatgggctgcagcagtttctcctgtgcctcaatcaaatgaatacatcacataaatgagggtataaactgcatgagtttacagaaaggaagaaggttattattacctttgaaatcagaagccaagaaaacatctcttctcacacctcctcatctcttctcttactttctgggcaagtccctaggggtaattttattagagactctccctcaaagtaaaaactgaggggggtataaatagccccgatcctgctcccacctgatccttagattaagattagcataagctcaggctgagaggtcaccacaaggtcatagttttctggggtgaatagtcacttaattcagaaactcaggaatctcatgcaaagaatgcttagttaacatatttccaggagaaaaataattctaatttgctttcttataccaagaaccagcagtcttagtgattttgtaaatgcagaaattgggcccgtggggatggatgaagcagaaacgagcagaacaacaggattaattgagatcactttgctgctacgttctgcaatttcattactactcctaaaacgcaatggagagtctcacaaacaggcaacagtgacttttgttagtattctgagcccttcagcaaagtatatcctctttgggctgatttataccataaggataataaaaatacatgccttacacattttagtgggctgttgtgaagagaaaattagattatgtatggcaaggaacttcacaatgacaagataatgtcatgtaataataatattaaagaaaattataggaaacatatagcacttgctatttgtcaggcactgttctaagcatttacattcattattttatttagttcttataataaccttccgtatgggctagaatctattgttatctctaatttttagatggaaaaacagagccacagagaactgaagtaacttgcccaagcctagacagtaagaattggtgctaggatttgaatccatgcagtctggcccctctcaatcactatgatttaggaataaaaacaaaaaaacaaaaacatagacgtttaagtaaaccagaagactagcatttgaatcctggcttcccaggccatgtaactatggagacagtcttcttaagcagtctgaatttcagtttgtttatctgcaaaatgaagttggataataatacttatttttagatgtttggtcaggattaaataagaaaacatgcaaagcacagtgtttaataggaggcacgtagtgtgttattattattagttattgtgggtgagatggtatattagtcttgtcagactgccatagcaaaatatccacagactggctggcttaaacaacagaaattaattttctcacaggcctggaggctagaagttcaagatcaaggtggcagcaggggtggtttctggtgaggcctctcctcctggctgccgccttctcactgtgctctcacatggtctttcctctgtgcagaggagagaaagagggctctggtgtctcttcctctttttataaagatgacagtcctattggatcagagctccacacttataacttaatttaaccctaattacctccttaatacagtcacattggatgttagaccttcaacatactaattttgggtgaatacagttcagtccataacaggtgggtagctgggaggcgaggaatagaaggatagaaggggtattttaatgtctacggtagatttttttttaaggcatcgctgctggaggaaaaaacccatcagatattcataatacatttgtaggtatacaatatatttggctctgtatgtcatagaaaacatctccatgctatctattaatcttttaggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcaggtgagtgccaggcagctcagatcaggcgtgctttcttcattttctgtatgtttgtacatacatgtttatctaaaaattatgccctcgcacaaagcttacagatggtgcagtggagggcataagtgatgcattcattattcaactcaccagtaagaaaatagtttagaatgaaagggattatgggtgagtttttccagtgaagactgcaaatcagaaattgtgttaagaagttaatgttctaatagtgttctgttttatgtttttcaataaattattcatccatttttgtgactaggtaagttttgttttaaaaatctacaaatataaaaaatatctactgccttttgttgaagagtaacgccatgggtgtatgtggatgagccagtgtcacagcgccctctactgaatttaaggaagaaatacttttggccggaataatgttttactgatgtttacttggtttttacatacgctgagtaaagttaaaaaacaagcgaaaaccctacctcttaactaaaaataatttaatatatcttcgctgttagatgaactggaaagtaatgcctttttaagagaagatatatggtgtgtgttcctattttattggacggggcgggggacattatatttgctgttttctacagtttaaaataattttcttagtctatgggaacatgggaacacattcaagttaatatttagcatgtttatctacagctaaaaaatccaatgacatagtttgacattgtaagaaacccagccaatttctgtaaataaatataaaattgatacgatttctaaagttatgagagaaaaattctagtaatatataaaattaaattatttaatattttaaggtaatattcagaatttttagacacatgggcaacagattatcattgctgttttctgtcttatagatttttatccctcacagtctaaggtatctaaacttccatgacttaaaatatgtgggaaatatatctatatcatgtgatataatttaacagtaaaacaagaaaattcacattataaaatgaaacaaatataccgaaaatttattagttttccagattgtaccattagttaaatgaagagtttaaacgggagagaaattcctcaaatcataaagccctagaacttttgttctaggttcatattttttcatgaagactataagagggagacatgttattagtctataacgcatgttaaattcattttaagcttctaatctttagttattcttctaaatatttaaaaaataggttgctgtgatttacagaggcaatgaatattttacttaaatctaattatagaatgatatgctttgaaataggtcatttataactagtgaatatatattgtgaaatttgataaatatctctttatattattaacatttaaaatattattcatcgaacatattttcaaaatacttatgacaagtacagtgatgcatctcttaataatggggaagcattctgagaaatgcaatgttgggtgattttgtcattttgtgaacattctagagtgcacctacataaacctgcatggtgtagcctactacacacctaggctatgtgatatagcccatggttcctaggctacaagtctgtacagcatgttactgtactgaatactgtaggcaactgcaacacactagtaactatttgtgtatctaaacatagaaaaggtacagtgaaaatacagcataaaagataaaaacagtacctttggacagggcttttaccatgaatggagccagaagttgctctgggtgagtcaatgagtgagtggtgagtgaatgtgaaggcctaggacattactgtacactactatagaatttataaacactgtacactcaggttacactaaatttataaaaactatttttcttcctgcagtaataaattaaacttaccttactgtaactttcttttttttttgagatggagtctcactctgtcaccaggatggagtgcaatggcatgatctcggctcactgcacactccgactccctggttcaagctattttcctgcctcagcctcccaagtagctgggattacaggcacgtgccatcatgcccagctaattttttatatttttattagagacggggtttcatcatgttggccaggatggtcttgatctcctgacctcatgatccacccaccttggcctctcaaagtgctgggattacaggcgtgagccactgcacctggccaccttactgtaacttttttactttataaacttttaaactttaaaaaccttttggactctttgtaataacacttagattgaaacacacaacacattgtacagctgtccaaaaatcttttctgtctttatatctttattctacaagcttttttctatttttaaaacttttttaaagcattttaatggtttcttagtttttcaaatgttttgttaaatataagacacaggctgtgtgcagcagcttatatctataatcccagtgctttgggaggcccagaggagaagattgcttaaggccaggagtttgagaccagcctgagcaacatagcgagaccctgtctttaccaaaaataaaaaacttagcctagcatgattgtgcacatgtgtagtcccagtgctttgggaggccaaggagggaggatcacttgaacccaggagtttgaggttacagttagctgtgattatgccactgcacccaagcctgggcaacagagtgagaccctgtctcttagaaaaaagaaaaagaaactaagacacaaacacacatatcggcctaggcctacacagggtcaggatcatcaaaatgtcactaggcaataggaatttttcacctccattatagtcttatgggatcactgctgtatagtctgtcagtcgtggtaagaaatgtcattatgcggcccatcacagtactttaaatctgataccttcatgtttatataagtaaagtagtgaaaatgctgacatgggagggcattgttgaagtaaataatcttaatagttattttaaagagcattgatagggaccttaaatagaaagtgacataataataagcaactaatgatttttctctttgacttttttttttttagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaaggtagtgaccacgggatagtcttcttgggttcgtctctagcctaaggaaatatgttccaatatcttcatcatcatgaaggacagaggagtaacatcacagcttgtatggggtggttaactgtggctttaagtcaaggctggaagggctggtgccatgaaatttgtcctggcccctagaattgggccgtaggtggagaggagttggaggtgcagatatagggaggaacccagttgtaggtttcttagaaaatcaccatggccttctcagagaccctttattagctcatttgatcagctcctcctgccatattaccctgttgctccttttctcttttccagaactttctcctcccttgctttacaaaactctactttctcctacctcttctactgtctttcaaatcactactcagtttttttccctgtttcttctacctgggcataaatgctggccattttcagggtctcatctgataccgttatttgcttccctgggcttccctccttacctgtactttcagtgttgtctgttacacaaggtctcccagatccgtgcctctaactccagaccttccacagagatttatgtctctgttttactagctaacttgggttcctttaactggtggaacttgatatctcaagctcaggttgtccagaaacaaatattttcccttagaaccactattctttcatttatcccaatcatcaaagcttttgatttttccatctctgtcaccgctcaccagttaccacctctcagcgatttgatctctctgacacctcttccatttcccttcttctgcaaactcattcccctgcctcagctgagatccccacggtctcctgctgtaactggcacagtggcctcctacttgtgtttcatgtccagcctctcccaactctattctatcttctcaaattctcaatcttccagagtgacctcacacacaaattattgctcttttgcttaaaaaaccttagcagctctccactgcccagaagataaagtgaaaacttaatgtgatggttaagtatggagactctagaggtaaccaccttggtgtaaatcatggcttcatacttgctgtgtgaactttgtaaagttatttgacctctctgtgcttcaggttcttcatctgtaatatggaagtgataatatctacctcataggataaggattgaatgagttaatacatataaagtacttgaagccaggacctggaacttttattaccatttcagtgtaattttttggtactctctgttatgtagctcagggctaggtggacacatttacatatccactaaacatttggtgcatctttgaaccaatattgtcatcagtcacttggaggacaaattgagcccatcttggaggaaaggtgaagaactgctgtcagcagccctctattccttctctattgttctgggtatttctgctttcatatgtcccctacatgtagtgtctttcctaagtgagagctcgcaaagtaccatttctccatttcattctagttgctgggtcattccagcagctcttggcccctggaagctgccggctggtttattccttaagctggcttcgataccctatagactcaactcataccaactcttttgtgctcctaaacataccattttctaacaattttatgtcttcagatgagttgctgctccaactgtctagaattctcttgtctttccttccatgccactccctctgtgaagtcatcctctactcttcaagacagattcttttttcacatgttcttcatctatacttccagtatgggcttactgttacatccagctttatgtatgttatttgtttatacacctgttttcccctttgattctagaatttgatcacttgattgtaagaattacgattaatatttgattatgacaggcagtaggctgagggcctgttatgaataaacacaatccagctcagcaaacaaatcacaatatctgaaaaagagggccactgcaagtaagcagacaggaatccagacaagtgttcatcatggggttgggatgctggatgaaggatccaggagacagggagccttagattattggtttaaacttttaaaaactctcctgcctatatatgggattcattgcagaaacatgggctgagcctacaggtgggggctggtcttcttagtggtggcaaatccatacaggtcttcagcaacctcaattcttgcctcctcagaagaattcgaccaagaggcataaggcagagtgagagactaaagcaagttttagagcaggagtgaaagtttattaaaaagtttagagcatgaatgaaaggaggtaaagtacacttggaagagggccaagcaggcaacttgagagatcaagtgcactgtttgacctttgacttggggttttctatgttggcatgcttacaagggagcaggaggttgtgtgtcttttcccctgattcttcccttggggtgggctgtccacatgcacagtagcctcctagcacttggtaggcactgtattcacagtgtgtttatcgaagttgtatgcatgctctcttgagttgttcttcccttaccagttgagtgttcctactaagtcacataccagttaatccgtgccattttgcctcttagtatgcttaagcccacttgcccaactcctgccgtcttatcaggaagccgatcaccagttttaggcttttctgtctgttgagggactgcctttccctggcacttgctgcaaccaattattatgttacagaggcagtttaacaaccgcttgaccatcacctgatggttgcctgacattcctggtggttggagggccctctcttgtcctgctcatgtctgactacctacctaccataacatttcccccctcaagaatccaagacctcaattctttgggaaaaatggataaaggtcagtcttctgtaactgcttcctactgatagaggggtggtggtggttgttttgtgggtcttcacctcttgctagctgtcagggtaggatggctccatgggttggtaaaaacagtatccagccaggctggagggagaaaggggtggaattaagcctctgtcatgtcttgttgatgggaagtctaggggtcctctgtagaagggtgactcttgaatactgacatgatggtgtctctcactgaggatcatctggagcttgatggcctgaaggcaagaggagacgaattagtttattagatttagaagaatgtcaaaatgaaataagggagtgaggacaactccaaaaaatcctgacgctgccaacacactcaggtaactggtggctattttcgtgcctgctaagacttgtgtggatggggttacaagccaattccaatgtgttcccagaattagaatattgatccagatttttacattacccattcctcttgtttcttctgagctgtggccagagatcactggttggttcacaggaataaacagggttagtctaaattgcagacaaaaactcaaaaacaactgctgagaatagaatctaataccaagttattagattatagtctgttatgttcttgaaacataacttttctctctccagtcctcatttttattaaaaacaaatcatgataggactgatttgtttgcaaaataagcattagtcctatcatacttggcctggttatttgcataaagcacagcaagaataattatttgccatataggctcctttttaaattggctttgatgaaacttcattccataaggtatttcagataagacgttttaaatgccttgagcccagccatgggtttctgccatcaaatacctgtatgaattgggtaaattcctctcctcttgaggtcctaaataacctggggctcctaggcctgtcagaaagtgacattctttactccccatggatcaggaaccctgtacagggactgtgtagacaaggtatgagaccagttttcccaaggggtttttattggctctataagtcaaatttgattccttaaaggagagcatgccattccagtcaaacccttggtaaaataaccagtttctccaattgtgccttgttgcaaaagaaaacagattactattgcacttatgcaaataactgtattgccattagttaagaatacccacaaatagtttccaaattctggagaaatcaggtagagagaaatatgctccaaattttgtttacaggagtacttatttttaaaagctgtaaatagctcaaaagaaagttttcttgactttgaaaaacaaaggatcagcaatgttttaagcaaaaagtcataaaaggattattttagtcttcttttagttcagtccatgcagttaactcctgttctgcctggtatttgtgaacatttcagctctccatgagagtcctgaaagttctttctctattctaatgttacaatctttaaagttatcagcaacctgcattcaagagtgcctgccagagtcctatagctgattataaaggccaccttttaaagaggattaaaacaagacaacaattgtgaatgagaaaaagtcttagggcagccacagtcaaagacacagttgccaagaaaatttgttatttctgtggcacacaattatgtagcataacagttataattattactgacaatgtatactaagttatatcagaattataggagctttgtataattttggaacacatacaaataacacatttatgaagagtagatcaatgctttactaaaagtctgttgtgcttttcaatttgtggaaaaactgaacaatagttctttaactttagccaatatgattaggcatagaattttttttatcagattgatctttcacaaaccttccacaacttgctcaaaccttcagctttatcctatctaactttaaaaaatcctttaactctctaaactaggtcaaaaaaatccacatttttatgcctttttatataatcttttactaaaaccacattctactttccttacatgccttgcatataaaagttttccagtagtctcaagaacatgttacactgttaactcttagcaacttttacttttggtgaaaaacctgctaagtaagtgattctgactatgtactaggtttgcagcttaggacactagacagaaatgcagaaaaggtttgactctttctagcatctagggggcatgggtaactctgtatgtccccgggcctcacgtagctttaaaggcagcaagttgtacagttaggagtcaaagtagcagtttatgaagcatttagtaagcctaataacttttaaaactgtataactttttaaaaataaattctctttcacagatcttttcacaacttacacagaccatctatgacatgcttggactttctgatttgtcccaaacattcctctttttaaacaaccagtcatttaatttaggacaagaatttaccatacaagatcctttctcatataaaacttctgttctttataatctgccttaccaaaaatacctcctctttctctttatagcttttgaattatattaaagtcattttctttctgttaggaagttaaggtttgtactgcatgttgctgtgtgaggattgtgaagggggagcagagaagaatgaggttatctgcatactgcagaagttatcccccctcaagagattgctcagttagatttttgctggggcttgtctgaataaatgtgggctatttctgtatccttgaggtaggactgactaggttgaagttattagttaaacatttaggtaactttccagaagaaatagagctattagagggaaagatgaatttagagactgggtaaatattaatcaggcacccatcttggaaagcatatttttgcccaaaagagtgtgaatcttttcttttggaaggaggaggtgccatttgccccattatgtggcagaatttggaggagagttcagagaaggagattagcacagagtaggcagctcttaaatcccaaagggaaatttataattttactcctccaggagtttctcttagctttgtcttgtcaatgacttggaagccagccagagcagagagccccttcagctcaaggccattaggcattgggactctgtcccagagccctttggccctcagggcatccaatttccagtagctaagcttgtggcagagggggcaagctgtgctaggcttcctctcatttgtcccattggggcagtttgccttccagtggcctggcttcccacaccaatggcagttacctgaaggagtgtttttagggaaacctggatgggggctggagagcttataaagcagccaataattgagcattcctcttgtttctgcatttttccttctccttatctctatcctccttattatgctctcagttataaaagactgaggaggctgatttgagggtttcctgcataagggcaatgggttccaaggctgacttttgtattttctcccagttcatttttaggccaaacgatattacaaaggaaagctagttttgttttgttttaagctttgggggagtcaaatgtttctgtttttggggatgcatctgaggagtatatcctgtggtatagagacatggttacccatctgtaaagagggaacagaggagaaaaaaaaggaaaaaggaaaacaaaggcatcccctcttactttcctgttatcctagataagcatctcccattcatccttagggttctggaatgaaccagtcttaccgtgtacccattaccttggttccatctcatcacaattacccacttgagaacagaagagatactagagtaaacagtgggacccttgttcatccttgggactctggaataaccgttcttactgtatacccctaacctttccttcatctgttttaatggtaatctgttaacctagaaccaaccttcatgtctgtcatatgggtcttttgtgactgcaaccttgggctggcctatgtccttgtctccatgacattatggtgactctcactcagagcattgtagcaacaaaatgattgtctcttttttcagatttccttcccatgttctttaagtagatgagaagcctgtttttcagctaactgccacaagatggctggatttccctcccttcgaatatgaccttgaaggtcttggtgcatgttaagaagggcatggaagtgattagagaaatggaggctatgggaggaagtgagataaatactcatggaaagctttcatatgcgagtgaaacggcaacatttatttgccctcttaacataaagtagtaacctccggaggacttgaggcttgaggtaagaactcacaagtggcaaaggaagaattttccctcctttcaaaggagtgttaactcaaaaaaagcaaataagtgagatccttaaagggccacagtgaggacctatgcagacacacaaagtacttaaaaagtcactggaaaacagccctggagggtaacagggacaaaaagtatacaataaatcataagggctgggattccaatttgtatctatcctggcaatgcgccaccagacaggggatgagttggaggtcatctgagctggtagggtaaaaacaagtataaacctcaggggatatttgcaagggagcctatgtctttgctgctgcacaaatgcagcaagagccatgggcacacaaataacaaggagtgtgtgtttaagaagttacatggcatgtgacgtgaaagcaaacaagaggcaggcttgcccctgaggcggatggtctagctggtgtacaaggccatttgagaacacgaaggagaataggaggtgaataggtggagtaaaaaggagaataggcagtggttttggggaaatagccaactttagttgaaaaagcagaggaaaccccagacattgcagtgttaggctttagttctaccactcttgtaagcctcctgtccaggagggccattagtgtctgagttctactcggtgtgaactccgagttccttccacccctccgagccacccattagagtgaactgaaagatcagctagcgggagcagagccattgtggctgagaagaattgttctagtggttggtcagtaagcaggagagcaaaaagagagaaggaaactgcatacaggggttgagtacctccagccaaagaaggtgaggcatagaggtcctttaccactgggaaacatatccaagtcatgtggcacaaaggtatgttaccagtgatgaatccatatgggtttgcagcaacctcaattcttgcttcctcagaagaaagaattaaattgagaaacataaggcagagcgagagactgaggcaggttttagagtagcagtgaaagtgtattaaaaagctttagagcaggaataaaaggaagtaaagtacacttggaagtaggccaagcgggcaacttgagagatcaagtgccctgtttgaccttttgacttggggctttataggttggtatgcttatgcttctggggggttgtgtcccttttcccctgattcttcccttggggtgggctgtctgcatgtgcagtggcctggcaacacttgggaggggcgcttgcacagtgtgtttactgaagctgcgcacatgctcacttgaggcgttcgtcccttaccagtccagtgttcctagaggaaggtcatataccagttaaactctgccattttgcctctcggtgcgcatgtatgaacccatttgcccagctcctgagatcttattgggaagctgctgatcaccagtttcaggttttttaatctattgggagactgcctttcgctggcgcctgctgcaaccaattattattttagagaggcagtttaacaacctcccgcccatcacctaatgtttgcctgacattcctggtgttgggagaaggccctctcctgccctgctcatgtctgactagctacctactgcaacagtctgagacaaaggctaccaaaggctgaggacactggcagaacctgataagtgagtgacttaagctttcctgcttctgagtcatggatacacgtcactgtctcagcctgaaaattatctttcatgggagagggggagccagaaaggcggcaggctggggtaaccccaggtgaaagagggcagtcctgtgtggtaaaccacgagggctgagacagaaatggaaaacttctggaagcggagtccccatattagcctacaagctttccccattgcttgcattgacttgcttgtgctgtctttgttaaatctgagaaatgaagaaaataattccttccacctatcatagaagaatggtgaaatcaactcaggttgacaggatatttgattgtcaactttgtgcaagcaccattatttctagccagcactaccttcttctccagctgaacctgaatatttgcataatctctagattagatgtttttgtatttctagcttaggcaatacttatttaaaagaggcatgttcatggtactattttttaataagagcttttgtttaaaacaaactcagtgtgacttcttttcataaaggtaaattaaagaaaaatacatgaaaatgaaagattagtccctttttggaacataagcaagatttgtttactttacactaaatctttagtaaacttacttcataatcatggggtgatattgcctatgtctggttcatcacctttttccatttttgtctgtaagtgtgagacagtgttttgacccagcttggtacaaaatatatagtaggcagttcattaatgttattatacattcctcttccctcttccccttctcagcctaatatctgtatttgtatcccttatagaggttcttaaatgtcaagatttattcttctgtttggtggaacagggaatcaaatcagattaatagaaaatagaaatgcagattcctcctcctttgtatagctgtgagaaaaaaaaaaaagaaattcatattcccacataagctgatccaggcctggggtgtgtgtgcttcaggagggggtggtgggaaggaagttcattcttgcaaagccctccagatgctggaggtagctgagacacatccactcgctcgagatccatgctctccttgttcttctgaacttctctgaataaaaagctctctcttgctctcccagacttccttctctaagtcgtttgtcatcggctcttgagctcttcagcctggtcacctccactgttatctgggctcagtacatgagccttggcctgaaagcagagtcaattaaaatatacccagccatttattaagtttaccctgactttaatagctagagttgtgaagaaaactgaataaatagagcttcaacataatttaagaaccaaagacatctaattatagaacatcatatttgagctgtatttataatctttaaatggaaagtttaaagaaaggccacaattgtttctagtttctattaaaggctcaattttaaaggtactccaaagtcttctctgtggatcagttaaatatataattatagtacacaggggtctcaggatttagtcagactaaaagattctgttaatagtcaaagggaaatttagtttaatttatcaaattgtagaatttgcttgcttttgaacatactggtaacatgcatataagcaattgtgtatgatgtaagaactagtaataggctaaacctgatagcttcacacaactttgtgtatttagggctgtatctttcaatttgtttcaagaacagtttcttttaaaagttttttattgcaaaattcatattttattacaaaaattaaaacatgcaaataaggagaaagaagaatccattaccctacaatcttcagtgaacaccattaacattttgatacgtacctttcaaaattattttttatggctgtatcaacctgtaaatatatggtgcatactgtgcaagccattctgaacacttttaggtggataacaaacacaggaatacagtctgccttggcatggctttgcctcctaactcccactaaaaccaaccctccctctcagagagtattttccttacccccgacagatgggccatgggtacttccaacttctttatttttactactcttttctcttttcttctcctaccccaattcgtccctggacttggtgaagttccacctccttcctgaagtcctcaatgattctccaaaccatggtgattttgcctcttctgaacttattgaaatgtgaatatttgtcaatatctgccattgggttaaagaaaatagagggaatgagagatgtacaaagaagaggaggactgaaaataaattcaatagtaaaagaaaaacttttgaatagaatattatagaagagtgtgttaaactcatctcatataatattcatgtcatgttagcaattggatataaaaaacataaattcacttaaaaaagcatatgcattatagagtattttgatttcatctcccatattagttatttttaggttgatttaaatcaaaatataataagagtgtatttcagatccctgtggaaagaatgcattattgaatacatggaattgagacaaatccatctcataaataacagcatagatcaaaataaattctagacactacaatttaagtttaaaaagtatgaaactagaaaactttcgtaaggatgtaatacttagagggggatagaactttctaaatttcttgtatagacactagcacatagtggtcacttaatacttattgaacgaatgaatgaaatggaaaagcaaagagaccataaagaaaagatcaataggtttgatgttatgtacttaacataaatatcttaatgctctgtattttaattacaaaatttgaaaggcacatgacacacttagaaaatatttatagtgtgtaggtcagagctaattttttttactaaacaactcttgcaagtcaaaaagaaaagctatgcatttctcccagcactttgggaggccgaggcgggcggatcacgaggtcaggagatcgagaccatcctggctaacacagtgaaaactcgtctctactaaaaatacaaaaaaattagccaggtgtggtggcaggcacctgtagtcccagctacgcgggaggcggaggcaggagaatggcgtgaacccgggaggcggagcttgcagtgaaccaagatcgctccactgcactctagcctgggtgacagagtgagactccgcctcaaaaaaaaaaaaaaaaagctatgcatttcaatagaaaaattagttaaaccatataaatatgtcacagaagaataaatagaaataatctctaaatataaaaaacttctagttttattagttaattaaaataatgcaaactttaaaaattctattgtcattaatcaaagtgacacactttaaaacacataataattccattgttcttaaaaagattagagatggaaggtttattatactgttgctggttatatttctgtaccttacaggaatgcagtttggaatacatttttaaatgtaaacagttttagctaatatagattttaacttaaaacatttttagctaaaaacgtgcttagcttttggtcaagtcattcaatttctagggatttctctaaggaaagtacagatttggacaaatggtagctacaaaggtgttcatagtatttttaatttttaaaatataaacatcccagtatcacctcttggagattactagtactagtgtagtggctgtgtagccggcctggctgggcttgagaccagcctctgccagtaccagctgagtggcctcatgctgttccctaacttctctacatctcagtttactcatctgtagggtgggggaaaatgtagtccctatttcatagagtaaatgggagaattgaatgtctgacacagaaagtgtttaataagtattagctatcattttattagtatttaagaatggtatatccagacattggctgccactcagccattaaaatatcattttagaagggtatttaataacatgaaaaggtgttcattatctgttttcaagcaaaaaaagcagtatataaaatggcatataaatgatcacatttaaaaattatataaatacattgggaaaagactgaaaaagagatatatacaaatgttagtagtggatatctttaggtggtaaaattatgggtaattttaattttcttctttgttcttgtctgtctctacattttctacaatggatatatatatatatatatatatttttttttttttttttagcaaaaataagatctaccaaccaaatgaaaaataataaaaacaacctcctactctaaatcacacttttccacagttaacagtagcttatgtgaaaataggataattttaatagactaaagctgatacactagaaacagcgtgagccttagggtttcactgactggatgtgaactcttagctgtgtgaacttagatatgctatttaacacacccaactttcagattcctccttgtgaaatgggtatgaatatctttgcatatccaatacgaatgttgaagtgcagtaaaatagttcatgtcagaactattcataaacagagcagagctatacaaatatgagatcttataaccatcaaaccctactgatgccattagattttctgtcctaaagaacagcatggatcacgttgccagtaaaatcttttcttttcatcagagaagcacttggggtttgagagtcttcctagttgctattaaaaactcattgcataaaagtatcaagcttttggctccacattatttctttggtatacatttcttttttcctttgttttgcttccaagatatgaggggcagtgaatcattctaaagacttaacatgaattcttgaaacttgcctttattttaaaatttaagatgaccattccaaagtaaacatattttacagtccactctgaaagagactcaacctaatattctttgataggaacaatgtttgaagtaattgagggaagttgggaaaatagtaagcaaaatttggaaataaactttaccacatgtttgaaccaccacagaggacaaatcttgttctgcagttcaattattttcttttctcctcatattatccttaactattcataataacaatgtgtgaaccactacagatcagacagcgatgtcccaaaatttgtgagttgcatgctggttttcaagttacaaagagaggataactggcagcccacaaaaataaaactttgaaagaaatttaaacacttttgaaacattttttattaaaaatctgagaaagttagacatgaggaatactgcttttgtaggaacctttattttttctgtgaggacaacagcaaaatagttgaaatatgaccagctttcagttttttcctttacctttcctatgtcttttctgtcaagtgatcataccaatgattattaaatttataatccttttaatctctcatctgaacagcttgctcctgagaccaaggctgtcattcattggattatggatattccttttgtgctttctgccaatctccatggaggagaccttgtggccaattatccatatgatgagacgcggagtggtaggtattctttctgcttctcttattggttcaaagtttataacactgtacaaggttttataagatgatttctgtaattttttttaaggaactgaacattaagtgatttttgcctgaagaaagaactatgtttaacaggaagctctcctaatcatttcatatggtgttggcatatctatttggcagaaaaggactcactttttcaataggttaggtgaagagaaacgtgatcttgacagtacctagccaacagaaagggagaaaacacacgtcataaacttgggtcactcttggacactgataaagtggagagattacagaagttgtgtaggttcatgtagaagatggcttaaacatgggggcagcctcttggtgcttgatcaggatccctgtggatctctacatgtgtcttattgtgttgacacagttttgcatttggaactgtttctggtggtgtcagggaggggaagtggtgctttggctttctctaactagttttagttaagcttcagacaaagcaagctttagccagacagatattttcaaattgttttttgttgctccagggaatttcctgctttggatctattttctggggcctttgaagagttagctttttgtaaaaacaggatgattagtttgtttttttttttttaattttagattcggggtacctgtgtaggtttgttacacggatatattacataatggtgaggtttgggtttctagggtacccatcaccaaaagagtgaactcaataggtaatttttcacccctcacctcctcccatcctccccgcttttggagtccccagggtctattatttccatcttaatgtccaggtacacccattgtttagcttccacttataaatgagagtatgtggtatttgatttctgaattatttcgctccagataatggctcctagctccatccatgtcgttgcaaaatacatgatttcattctttttaatggctgcttagtattgcatagtgtatatgtaccacattttctttatctaatcaaccattgatggacaattaggttgattccatgactctgcttttgtgaatagtgctgccataaacatatgagtgcacatgtcttctttatataataatttcttttcctttggatgcatactcagtagtgggattactaggttgaatggtagttctatttttagttctttgagaaatctctgtactgttcctcatagaagttatattaatttacatttccaccaacactggtgggaatccacgacaacatctgttgttttttgactttttaatcatagccattctaagtcatgtaatatgatattgtggttttaatttgcctttctcagatgattagtgatgttgaggatttttccaattattttgactgcttgtatgtcttcttttgagaaaagtctgttcttgtcctttgcccactttttaatggggttgttgggatgataattttagatattggaaactgagtgttgaagaacgtctttggggaaataacattgttaaataaatttgaagactttgtggtttgttgataattgggaaacttgtaggcctgcataatttataatgcatgaataagaacacagtgtatcaaaatatgttatttatttctataatacatacaggagatttaaaaaatataaaaccagatattgaatggtatatatgagaatgattcatagtgggtatgaggttagtataggtacattttttaaattaaagatttaatgataaaaatcttcctcctattctcccaggcctagtttactatgactttattacctttccctgcaaagctttcaactcataagtagaatgtacattctacccaatttctactttgtagtattaggaatggaaattttgtaacttaaaactaagtgtaattatttagtatttaaattttacctctttcccatagttatgtagctaaaaaaatacatcaacaatacaattactcaatactgaatcactctttagaaaacatgctgtgctgcttggtctgtgtctgtttctttaatcttgtggatttgttttctaggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggaggtgagtttccattgtgctctctgattatgtgattgtagcttatttacaatgaccatttaggtttagagagtgatttagatttagagaatcttcaatcgtcctccatcattaaaaagtagactgaatctatagttcttccattaaagtcaactttttgcgtgaatgattactatgtataattttgtttttgtggattttaaaaattgtgatgctaattgaagagatacaggaaatgaactgaagacattcatttggaaaataataaattgaatattgttaactaccctactttccaaattcaagccttagggaataagatggcatccttagtttatgccagtcatgctctttcactgtaggtaaatatatattttagagggcttgttttggcttttagcataacctggtgcacagtacttttgtattaaatgatgggataatggggagtatttgacatggaatatttagtttatgttcactattctaataatctctatgagatcaggtagctttttgccttttagtctgaaaaggaagcagttgccatgtgggacagcagctgggggaagccccttcctaggtagccaaggaagctctcttgccttccttgtcccaaggcggactttacagagctcgtattttcactaacactcaaggatgaagagtgaaatgcgaagatatttatatatatttttacttttctctttgcctgagaaaaattttctatggcccacctggaaaaagaaaatttgttagggtaataagcaacattagctaattgaagggtattggtatgtttaatatgcttaattttgttgaattatgtgctgagaaaaatattctttctgatttttttctttctgatacatgttaattctgtttttatttatattttgcattttatccagatcagacttagtactctttccccaatagcttcagaaatatgatctatgtcaaatttaggatttagagcatgtctagtacatcagatgggaagtaattttatactttagtttttataaaaactttaatgacttcttggaattcctttttgaacaaatagtgtattgtcaacaaaatataaagtaatctatatcagttaaatactgataataacattattaacaatagtaataatgttagttaacgattacgtctcgcttaactaaacagtcaaaggaagctccgttagtcttcagttctgtatatagtgaataacattcatgtcttaggtcaggttttctagaagcagagcctgagatagggatttgggtacttgtaatttattaagggattactttttaggacaaaccctgtagggaagtgagggaagcagggcaaggaaggggatagagctaaacagggttgtggtctcaggcaaagtccagccttggcctgagccattggaagaagcctggagcataaattaggggcaggtttgtctccccttgagagaaagggaccagcctttggtggctccatatctgtcagccattggttgtggggtgccagcaggaattgggggtgagagatagcatgatgtaactcccaagccaggtgggagattctggctcccatcagcaattctctggaaaaggggtgggggggtagctgtgagctctaacagccaacacctgcagcagtttgggtctggatgccctgcctccataaaagcaatctggtgggcactaacagcatcctctgctaatttgagtcagatttaaattaaaattgttctgaatgcagaatattctctttggtgctatttgaagtattgttatcattatatcttgtatgtaattcaactcagggattgttgaattagcatatagtgtgaaaggaaattaaattctaggaccccaaattcatttagctaaagggaaaagtcaagctgggaactgggtcacacaaacctgcctccccattttggttcctaaataagatgattacaagatgaaagggtacacgcctcccccatattttgcccacagggaaattctgggtgagctgttaaaacttcaccatggccatgtaaattgatagcttatctttacaggtgcaggcaccccagcccaccagacacaaatgcgtatccgattgcccccctaccccattttgtctgcgttatcttatgtaaaatgcacattccccacatttttcctctgtcccctttggtttatgtgaaaactctgtgcttatcaatatcccaccctctcccctttcaatttggagccctcaaaatcatcttcggagagaggcatagacctgtctctggggcgcatccttaactttggcaaagaaatctcctaaaacaattgagacttgtctcatcattttccttgattgacaatagtatattgccaagactcccaatccctcaggaatacactatgatattgattgggcttaaggaataatatagtatgtcagatcatgtcacatgaagctccaagttcttctccagtagaaaggtagacttagagggatgtgcatttctttaatagatcagtggggatgaagtcttttaccctgttgtcttctccgaagcccactccagcaatgtggaaggtgggtaatgtctgcattagcactctgcagcagcaaatgcttttgcttaggaacctgagagtttgtgcttttaaggtataacaacccccgacctatgttgttcaatcccttacagcagatgatttcccttaagttttcccacaggcttcccaaatgccctggtttgtgtaccttttacttggttcttgattcagaagactagcctgtgtagagttttaggctccttgtgcatattttgactttccatttggtgttttggcagggatgcaagacttcaattaccttagcagcaactgttttgagatcaccgtggagcttagctgtgagaagttcccacctgaagagactctgaagacctactgggaggataacaaaaactccctcattagctaccttgagcaggtaaacacagtccccagcataaaaatgcaaggtttacaagcattcaaacctgtcctacaatggtcttgtaagaggagtccaggagaatccgtctggtgcagaatgaggatgccatatttggaaggcaggtgtcagcagtgtttcagttaggcttttatttgtcataggttttgtggctcaggactattcaccaagaactgactaaactggagagtatacagaaaagacgtagactctcgtttctgtttgtattattctaagcaagggcaatcctaggactctctcccaccctgatcaccgtgaggcatcccaggcagagccagaacaaaagtaaggcaagcgaggcacctgaatggaaaatttaaggaggattttaatcttaggggcatgcaagtacaggattagcacttgagagtgagtgtctctttaagttttgagctgtacaagcctcatctttctcaccctagactcaactgcatcacaggtaataataataataatgagttatgtttgtcatttactatttcccaggcattatactaaatgccttttatgtaatagttagttcatttaatccacacaacaaccttatgagggaaattatcatcatcatcattataatcatcactaaattaaagatgaggaatcagagacacagagaggctagacagctcacctgaagttgcttagctagaatctgaatcaaggctgtctatttccagaatcaccatgctgtactgactttcagaacagaagcctggatctttaccagagagtcatttatgtagccattccaatgtgatccatatagaattttgggggatctcaccatctgccagaataaaatcctttacctactcaggccagtcctctgccaaccccaccccctgcatagtatgtagacactggccccagaggcagtggcagtggaaagacctaagactctgttcattcctgcagttctttgccagtcttcaaattttatcctgaatgtggccatttacacctaaagtcaagtagagtgatgttagtttcatgtgccaacaaatagtccagaccaatctgttaaactaatttgacataaaaaagctgttaaataaacatttaagtatttatatgtgtatatgtacatataaacatatacatataaaatcaacactttttttaaagtaaaaccaggagttgaatccagtttctttctccaccattgcaaggctctgttgcagtggtccctatagcttgctatggcctcctttgaataaaggctgctctaaaaaaaaaaagaagaagaagaagcaaaatcagcataggaattcttttacacatgtcaaatatccatatactgtaataccttaccagggactgtcgtggaatagatccactgatgtcagatggtgattaaagagcactcattccactggattctttttaaatcaatggattcctgctgcatgttagcttaaaaaggtattttccaacaacaaaaactaaggataagcagtccacgatgactctagaacaactttggtgggaacccctacagaatgtctcctttgaggagagccgtatttggatggatcttctgagagcaaagttaactgaaaagtatgtttttggatagaggaagtaagatgggactgattggggtgttctccacttacatatcaaatacagtgctttttattttaataaatatttaataatctttaaatgtttaataatatttgtcttaatactccttaatacagtgcttttaattttatgtatatagtttttcaactaaaatgtattgactagtttcacatcccaggcattctgtgaggcactggggatagtgaccgtcctcaggaaggcttcacacgagtgctgtcagaaacaagaatacctaatcacaagagaggaggagagctggctgaaaaacaataaaagcttagctacaaggagcaataacagtacacagaaggggacctaaccgagtcacgggagtttggaaaaggcttcttggagccgggctataagatttactaaagttgatgccaataagatcatcactgtgatcaacaatttaaaaacatgcttagctgctgtttaaatcatctcttagttcttgagaaaaaaaataatacaaaacaaataaaacacgtcttcttaccatcaggaaaaaggagatttgtcatacttatggtagcaggtgggcatgcatccaattcatctgacagtaatatcaatttatatataaataagctaaaaagaagaaggttaaagttatacaatcctattttatgccacgcaaaataagaatttgctctgtccacagatccatgtgatctaccttgatatggcattgtcattaggatgcaaactgtgtctaagcagtgagtggtatttataaccagctcatctagcttgcatcatagaacactccagtttaggaaaacaaaggctgatgaaaaatcagtgagggctgccagaagttctgtgttgtaattgttgtcttgacaatggtggtgattagtaattgaacacctgggcctaaaatctaagcttggactagtttacaactcatggaaaataggtgattaggagatctatttctgtaattgtttgagaggaaatcccttgcagagttttaaagagatgtttgcagggactagaattgtaaagctaattagagtagagagtctgctaaggagaagagcctcccttccactcagtagctttgaaagagtctagttctcaaaattctcaaaaaatttcttaaagaatggttcatgggccaggcgtggtggctcacgcctgtaatcccagcactttgggaggccgaggcaggcagatcatgaggtcaggagatcaagaccatcctggctaacacggtgaaaccctgtctctactaaaaatacaaaaaattagccgggcgtggtggcatgtgcctgtagtcccagctactccggaggctgaggcaggagaatggcatgaacccgggaggcggagcttgcagtgagccgagatcacactacactccagcctgggcgacagagcgagactccgtctcaaaaaaaaaaaaaaaaaaaaaaaaagaatggttcatgggcacctgcattagaatcacctagagttcttattaaaaatgagtttcctctcctaccattgaatcacactctctgcagggcaggaccgaagtatcttcatttgcagcaagctatctgcgtgacactaagtacatgagggtttaggggctataaacagtcctagcaaaaatggagaatcttctggaggctttttcagccttcgctgaaactgagatgtcctggaatctggggagcaatcattgcaggcaccgcaagtgtagtaaaacagcttctccaggcatgagtgaaatttggactttcgtgatttcttttgcaaaagccatacaatctgaattttccagtctgaattcatgggggagttgacacagcccatacacttctactgagatttattactacactggaatttttcaaacagaaaagttgacatatcacagacagacatttacttctttaactatttgttaaactgcatattgcacatattgcaatataagtcttggattgcagaagcagaaaaaagtaaagccatgaatattaacctaatatatttctgcctaatacaggcaaataatatgttcttgtagtgattgatttacttactttacaatgatgtgggaattagaacctttctttaaggcttatgctattgataatttcaggattatagtgcctcaagaggaataaagtacttgggtaaagcctcttttatcagctagcatctttctaagttttattgaatggggcctcattttaagaaatttagagtttgggtctctatatatagcccttttcttcttctctacactttttctgatttttcatcttttaattcagaaagttaagttttcatgtttcatgttttccaatggctgaatttcaaactcttttcaattttggttggcttattagttatggagaaaagttagaattgaataaatcttaaatttttaaaaatatatttactctactatactggttgccaataaaatgatcattattactgtttcctatttgcaacattaaaaaattacatgttatttttatagggtgtgagagttttctttttttttaagaaaaatggcacacacaaaaaatattgctggtaacaaggcacatctttttgataaaacagtgtaccactgccgaatttattctttgatgacaaaggattacaggagacttatctgtcttctgtagggaaatagtcaagtatcataagtagcgaaagacaatttattttctatagcccgattgagtgaggcacaacctgagcatttgggaggttggtgcatattttgttgagtaatcaagtttaatgcattacgatttgatattctagatgcagtactttcttaaagacctgaagcgactctgtcacttcaaacacatattgacttagatgaattgtctttccaaaataaagagaaaagcagtttttgtagtttgcagtgtattaaataatagccagttgatgactacaacttaatttagggggattattttcaatggcagctctcccatcttctttctaaatcaacattctattttctgttatgaggctcactactctattttcagccaaaataatgttaatagatttaatgcaaaagcagtcacagtatatatctttttatccagaatgagctaatattaacaggcttttattatgatatccttgttaattgacagtagccatataatgaatacacaggtgaccaaaattgaaagagagtaagttatgaaatgcactaagactagaactttacacatattggagcaggacgagctgcagacaaaacccctcagacaccgagttaaagaaggaagggctttattattcagccgggagcatcgtcaagactcatgttgcaaaaacccagctccctgagtgagcaattcctgtccttcttaagggcttacaactctaagggggaccgcatgagagggtcgtgatcaattgagcaagcagggggtacgtgactgggggctgcatgcaccagtaattagaacggaacagaacaggacagggattttcacagtgcttttccatacactgtctgtaatctatagataacataaccgattaggtcaggagtccatctttaactaccaggcccagggtgtggccccgggctgcctgcttgtggatttcatttctgccttttagtttttccttctttggaggcagaaattgggcataagacaatatgaggagtggtctcctcccttaatatgacactttttaaaatgatttggaaggtactaaaatcttttttttgggaagcaaacaagacattaattttcacttatctatttagggaaaagcagaataaaatgcacaaaaaattcagtggccttttgtgcatgtcttgattcttaaacaatgggggtctacggtatttgctggaaaataaagagatgcttgatatgaaacatatttaaggccatttctataaatttataggtcatattaattttttggttatttttgaccttcacagatacaccgaggagttaaaggatttgtccgagaccttcaaggtaacccaattgcgaatgccaccatctccgtggaaggaatagaccacgatgttacatccggtgggtctttgccacaattggaggctctacgttatgtacaagagcataattactaattatcataattataagtcttatgttcttctaagcaaaacaaatagctcgtatctctacagcgtttctcagctttgatctggtgaagtttcctttgtgggctcaggtcaggcggagtgagtggagcccagggcggctgctgcgttagaaatccgggtgcagcagatggcgccctttcctcagctatctcgccccagagctgggaggtggtgccacaggctgccgattcttcgcggttcttcaggcaaaggaaaaggagctgctggagttaaaataccagtgactttctagtctctgttaagaagtgctaacgagctgcgaatggggagaccgaaggagggagcggaaagaggaggaaggaagaaaactgctgcgggttgtgtgtctaaaaattctcacacagtttttcatttaatccgtataataaatccgcagggattcaaggttaaacaagagtttataggattgaggtgcgatgttagtgacttccaggttttgagctccatttccatttccccagtttgaggaaaatgatgcatttttctggcaagtctacctactcgcattaataaacattgatccaggtcattttagtttgtcatttgttgggatcttttcaataatgacaactttttctttttagctgtaaactctttacaattttttttagactttgtgacaattaacctttaacttatgtcccaaaccactctgtaccatcaactctttcttaaccttcacatttatagcttggattaaaaaaaaatctttaacatttgtcctctaaaactccattcattcttcatgtatcaacagcccactaggtgccagccagtatgccagaatctgtgccaagatgtcagcccatgtagccccttagcccttagctgagagggtgaaacccagcgttagtatccctgccacaagaaacctgttagccctaatatgtcatacaaatattttattttctctacattccatgatgtgaaatgtttaggaaaatctaacctagggaataaacacgtgggaagaaattaaatcagaggaggggctctagaatactccagcttttcagggacaaggtgataataagaaggaaccagcaatagaactgacggtagaaaatgaagtgtgttgtactgaaggtagaaaatgaagtgtgttgtcctggaggctttgaagtgcttcaagaagaagggagtgaaaaagcgttaattaagatgaaccttgtgaatgaatccttggatttagcagttcagaggatcttgaaaaaatctgttcaatggagtgaatggtgggatcctgattggactgggtccaagacagaataagaaaagaaccattctgagattgagaacatgaacaaacctttccagaaattttgctataaagcaaaaagacaattgaggcactagctgcaaggagatgtagatttagaggtagatttgatgatacggtgatgggggcttaatttttttgactgtacctatttttgcaatgaaataagatgtaaagtaacaactgggaggttgaacaggatgtgtaggggtgttaggaaaaaggagaaggtgtgaagtgtctacgaaaaccttgctcttcaaagtgtggcctctgctcgcaaccttagcattgccctggggctggtcaggaatgcagaacctgggagctggaatcagatttttcattttaccaagttcccaggtttgcacccaagtttgaaaatcactgacttaggtaaatgggagattgaatggactagggtgcccagtgtattctaagtctttagaaatctaaatttctaactaggacctcagagatcctacaagggctacctttggcccacactctgtgaagattctctgaccagcaggtcttcacctggcaagaatcaaaacatgatggctgtatgttctgaccctgctgcttggggaattcatctgtctttttacctgtgttgctcctgatgtgattagaagatctatgatcgtacgaggtttattagacaatttaacattgatatctataaagtagctataagaaatgaagcctgtaaagagagtttcacaccctattcaataaaatttcattaaattccctatatatttactttaaaaatcgagaatcaaaaaaggtgaactgagctagactgggtattccttagatggcataattatgcattgtgtaattctgcatatttcatgtgctttgtgatttgatattctgccttcctacagcaaaggatggtgattactggagattgcttatacctggaaactataaacttacagcctcagctccaggctatctggcaataacaaagaaagtggcagttccttacagccctgctgctggggtaagtaatcataataatagccaaacgctataataataattaagcatttatcattgtcaggcatactgaagtgatttatatttaatcttcgtactagccctatgaggtaggcaacattgttatctcaacttaacagatgagaaaactgaggcttagcaaagttaatatgaagctctattaccatttctcagtttttgaagagatttacaagaaaatgaaataaaactttaaaaaattaaatttttatttgctaaccttgatttccatctcaatgggattatgtttcatttgcctttttatctttagcacctagcgcagtgcctttctcaataagtatttgaaaaaaaaatgatgcatataagaaaattttaggtggtaaccaaacacttatttagcatattttatgtgcaaggctctctgtgctaagtagtatcaaaaaccatatcttatttaagtagatctcatttgtttgttaggaaggtgatggtgataagaccaaaacttctcttagagcagaattttactactacctttgtattatatgcctgggaccgtgggaatacctgtaggatttcttgaaagtctaaaaagcttacttgaaaagaatttattattatttttgtttatgtacccaaaacttggagtataaatgcttgatttatgcaaacaaaatatcttgagtttttaactggtatatggttttgattgtgtgcatgtatgtctacattgggctgtatatgtattaaaatcaagaggtatatttgggtaactgaaacctggaaaaaatggccctgggaacaagttgtaaaggttcaactattttgatcctttgtctttctggcatgtgttagtgcaaggatatagtcagtgtaatcacgatccaaaataatcaggcgtttaagtggccaaatcaagaaactcttagttccatctgggatggggcctgaggggattggggttgggggctgcctactttgaatagccttttatgcggagtgtgtggcttctccctagacctgatgaagattcccattcacaaagagagtggcttggacacatacgtgcttttgtcagtttctttaacaaattcaagattctggatagcagaaccttgtggtttgggataccagcatgctgaactgtattcttccacattccctcccacattaggaaaagattcaaggctgacaggaggtgctcactaaataaccaaaggcagaaaattaactataagttacatcctctttttttcttttcttttttgagacagagtcttgctctgtcgcccaggctggagtgcagtggcacgatcttggctcactgcaagctctgcctcccgggttcaagaaattctcctgcctcagcctcctgagtagctgggattacagcgtgcgccaccgtgcccggctaatttttgtatttttagcagagatgtggtttcaccatgttggtcaggcgggcctcgaattcttgaccttgtgatctgcccacctcgacctcccaaagtgctgggattacagacgtgagccaccgcgcctggccagttacatctttttatgaggagaagagactggggcaagaattttgttgaattatatctgtcttcaaagctattaaatcaaaggacatttcaaacataaggcttttgaattttgcttttgaattttttccccctgaaaatatcttttgtttattgcaagagattttatttcaggatttactttaattcaggtggctggattgagtgtatactgaaactgctcttatttttttatttcaatttaaaaaaacacatgcagtttgataataatatgttcttgattttctcttttaggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtgtgctaagcactgcatagcctctatgtatgttattgtggcaggcaaaaggttctgattttgggcacaacctttatataaataacacaaaaattaatgtttggacacaaactctaaatcagtaacacactggttaatatgtaattatgcattgtgataagtaaaatgacaagaaagagtagggaaagagaaagaatgacagagcaacttaaattagactggatgagaagagtcagggatgcatcttaatgcacagacctagaatattgagtgggtgtgagcagtgcagagtgcaggggtgtgtgtgtgtgtgtgtgcatggtggtggtggtatggttgatcaatgctgcaagtgtaagttttggttaaaatcgtgctgttataatagtaggcccccacatatatcctgggttaaacacaatggaagtgtattttttgctcaggtacctatactggaaaaagacagaaagatggggtgacttttcttcacacagtctgggaccacgttctgggatccattctgacagaagatctgccatcttctgcacacgtccaacactgccgcattggtggtcgtctccattgcagccaataggaaaggggaaagagcaagggggagaatgtagagggtgttcttatgggcaggcctgggagtggtgtacattacttctgttcacatcacactgcctggaattgtacattctttggccacagtaactgcaagggagtctgggaaaggtagtctagaagtgtacccaggtaggtgaggagaagtggactttgggacagaatagcagatgcaaaggcattggggtaggaaacacatggcttgatggagattgaagaaggacagatgtacaattgcctaagagaagcccacagtgagaagaaaaatgagattgaaactgagctctgaagagcttcaaaattttgcttcttgaggtttagataagataggatagactggagtatgctgccgtaagaagcaactccaaatcttagcgttctaacttaatagtaattgatttttcatgcaaagtctgtaggtctacgtaactctccaggaactttgcgctgcatgctgtgacacaattatgtagaatgtttccacgtgcggttctgccatctcagcacaaggtttcctcagtctcctgtgttggtcgcagaagaagataactggggccactactgcccacagcccacaggtcagagctagttacatggccttgcctaaccacaatgtttggtaagcattgtcactgccgtagtcctctctctggtgccaacacaactttgctctcctgtttccaaaagtaggactcactttgcaagggagacgatttacagccacatcaaatcatggctttgagcttcaatttcaggatctctgagtgatctcacaatagtctctatgtcaggtctgtacatggccagtcctgtttcagggacaagtaaactaagaagacaggtaaaatgcatccctcacccgcagtgtgcagtggtagaacaggatcaagacaatgtgaggaaacacttccacagtggtgaggaatgagaggggcccagcattcaggcctgcagcaactcagaaatcttgccgagcaaatactttatgggcctcctattttgggggtggaaaatgtttctggtttcagaattcattctacactttggcaagagctttctttcttttctttttttttttgagacggagtctcactgtgtcgcccaggctggagtgcagtggcgtgatctcagctcattgcaagctctgcctcctgggttcatgccattctcctgcctcagcctcccgagtagctgggattacaggtccccaccaccacgcccggctaatttttttgtatttttagtaga

SEQ ID NO: 17079 - DNA, 9170 bp, Human
tcaggaggctgaggcaggagaatcgcttgaaccgggaggtggaggttgcagtgagctgagatcatgccactgcactccagcctggatgacagagcaagactccatctcaaaaaaaaaataaaaatctttggtactacactctgttaaaacctaatggctttccactgcacttagaatgaaatccaagcccctcccctagtcttcaagggcaccctttgatttcccttctcaccactccctctgtctccctgtgctccagccacactggcccttctgtctgctccctaaacaacctgagcttgttctcaaaagctttaagagcttttgcacttcctctccccccgacgcccccccaccactccccaaccccagcgttcaaatgactcctgtcttcagctcaaatgttacctcctccaagaggccttccctgattttcctgtttcaagtagtcttccctgcactctgtcattatctccatcactctgtttgatttattattgtatttatttttcttttcttcttttatttttttttttctttaagatggagtcttgctctgtcacccaggatggagtgcagtagcgtgatttcagcttactgcaacctccgcctcccgggttcaagcaattctcctgtctcagcctcctgagtagctgggttacaggcgcccactaccatgcctggctaatttttgtatttttagtagagacagggtttcaccatgttggccaggctggtcttgaactctcgacctcaggtgatcctccagccttggcctcccaaagtgctgagattacaggcatgagccaccacgtccagcctattgtatttatttttcaagtcacttatccttatctgagatttatcttcatcattgatgttttctcttgtctgtcttcctctactagaatacaagctccataataccagcagggctcatgtctgttttcattattaactcccagatcagagtacatgttcaataaatgtttgatgaaggaaggaacaggttaggtgtgtgagtgtgccagtattaccttattcattcagcataagtatcagaattattattatcagtattagtattttgtcagcattattatactctcaacatagactaagatactggagcccaggtgggtgaaataattggctcaaggtcactgaaccaggaaatgatggcgctgggattcttagcttccgcttcctccccgcttccagagtttcacaaggtttttttttttgtttgtttgttttttgttttgttttgttttttttttgcgacagaatctcactttgtcccccaggttggaaggcagtggtgcaaactcaactcactgcagcctccacctctcgcgttcaagcgattctcatggctcagcctcccaagtagctgggattacagtcgcccgccaccacgcccggctaatttttgtatttttgatagagacgggtttccaccatgttggccaggctggtctcgaactcctgacctcagatgatctgcccgtctcggcctcccaaagtgctgggattacaggcgtgagccacaacgccctgccgagtttcacaaatttcatctcccatcctctgaccccccaccacggggccaacttcaccagcccaatctcaagtccatgccacagaaatctggcctcttttcccagactcctatccagctccaagctccatcagggaaagcagacatccggccccagggcaagacctcaaaactcaagggtcctgagaatcgggccctcccacccctgacgcttgccccccccaagaaccccattccaagagtttctcatctcaaccctgggagggagccccagatgatgtctgtctggagggattgggtgggggcccaaagaaagaggaaccggagtgcctgggccctcccactggcagccgacctcagctgggtgcggtgagggtgggtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggtaagtttccagtccgttattcagggctgggacttcttaatttacttgggaatgtagcagtttgggaaggacacccccaggctgggagagacgtccctgactcttggaaatccttttaatttaataagtgatctcttagcacttgaggtggggatatgggaaggggtggggcccggcaaagttttggggtcccagcagagccctccactggaaaacttcctgcagtttttccctcagcggtgtccactgtcctctggggtccctgagatcagggcattgcatgagaacaccccaaatctgggagacctctaggtcccctgttcctgggcaccaaagagtcctgggaggctaactccttcttgggcctctcttccccccagcgcgaatcctatccatttcctccagaagatgtccaacagtcaccagtctggcagcagggtggggtgaggacctcgtggacatagccaggggctggggtttccctggtgcttagagatgggggggggtggggatgagtcaccagatgactcaccaggtccccctcctcccctcaacccaggagaggagtggtgtgagtcaagaatgcctgttgctgggggcagctcctcaatcctgatgtcggggtgcagggtggggtctcaacttgaattttcactatctggcctgtatgtaacccagagtcagggttctggggagagaggagccacattgctagtcctcctcattcaaggaacccaagagtccatctttggccctctccacccctccagccaatggggatctcaggaatccaggccccagcggtctcctccctgagagacccaggagtctgcacccatgcccttcctccatcaggagacatctcacctgcctttatgccaaatttttttttttttttgagacggagtctttctctgtcacccaggctggagtgcaatggcatgatcttggctcattgcaacctttgcctcctggattccagtgattctcctgcctcagcctcccgagtagctgggattacaggtgtgcaccaccacacccagctaattttgtatttttagtagagatggggtttcaccatgttggccaggctggtctcgatctcctgacctcaggtgatcctcccgcctcggcctcccaaagtgctggggttataggcgtgagtgtgcctggcctgtgccaacctcttgagactccgtcccctgctccccctccccaggcttccactgcagccatgtcactcctcttgctggtggtctcagcccttcacatcctcattcttatactgcttttcgtggccactttggacaaggtaagcctacttggagctcagggcccttctgttcccctttggaatcttgccacgcccctcctctaaaggcattctggccccaccccctttacctagtatttcttttttattttatttcatttattttgagacaagggtctcactctgtcccccaggctggagtgcagtggtgcgatctcggctcactgcaacctcggcctcccgggttcaagcgattctcctgtctcagccccccaagtagctgggattagaggcacctgccaccaagcccggctaatttttttattttggtagagacggggtttcaccatgttgcccaggctggtctcgaacccctggcctcaagtgatccacctgcctcggcctcccacagtgctgggattacaggcatgaaccaccaggttaacccttttagctctacctccgatgcctcctccctgtcctgaccctaccccctctcatattaaatcctaactctccccagttctgccccatcccagataccctgcccttttcccagcccttcccacagtctgcctgaccctatcccctctcctttcctaaccctgccccttgtttcgttctctgtccatcccagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggtaaacccttcgtgtcctcatgggactgagaattgggaaccctcccccaacaaagttggagtgggcggggtccaggcctgagtggctgagtgcctagggctaatgcatgtcccgcctgtctggatgtacctacctcttgttttttttgtttttgttttttgagaccgagttttcctctggttgcccaggctggagtgcagtggcgcaatcttggctcactgcaacctctccctccggggtccgagcaattctcctgcctcagcctcccgagtagctgggactgcaggtgtgtgccaccacgcctggctaattttgcatttttagtagagacaggtttcaccatgttggccaggctggtcttgaacttctgacttcagctaatccacctgcttcagcctcccaaagtgctgagattacaggcgtgagccaccacatccagccagtacctcctgttctgaagaggccatatagataaaagcatgctataggtttaaagaatagagaggggaggccaaggcgggtagatcacgaggccaggagttcgagaccagcctggccaagatgatgaaaccccgtctctactaaaaatacaaaaaaattagccgggcatggtggcgtgcgcctgtagtcccagctacttgggaggctgaggcagaagaatcgcttgaacccaggaggtggaggttgcagtgagctgagattgcactactgcactccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtgcattggagttctaaaggaatagagctgcatctatctaaagttctgtgtgaaagatttaatgcaaaactaagattaaaggaagtggtctgctctcaccacttctattcaaccttttactggagtagccaatgcaagaaggcaagaaaaagaaataaagggcatgggaaataaattaggaaaaagtgtctctattcccagtaaacatgttgtttatgtagaaaatccattaaaattctgcaaagcagacagacacagtggctcacacctgtaatcccagcaccttgggaggctgaggaggaaggatcacttaagcccaggagttcaagaccagcctggacaacatagggaaaccctgtctctacaaaaatttaaaaattacccaggttgtggtggcttgtgcctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaattggcaaagcaactactagaactgagaagggaatatagcaaggtaacagggctcaaggtcaaaataagtgatacatctaagtatctaggcttgtatgggcctaaacgggagcagggatggggcagagaagggtcacatggtgagcaagcaggtgaagctggaactctggacccacggtgatgtccccctctgtgtcctccttactgcaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagtgagcactgcccctccccaaccctaatcccccaagaattgagcagaagggagtggggtgtgtcaagatgctgggggccctgagaatgggcctctcgtagaaaaaaacaactttcaacaccccacgagccacaagaggtgcctccgtgggctacatctctgcccccagggattgctgggacttgtagttttcagtggctaatgatagttatggcttgtgcgtatgagtcatcagggaactcagagtttcagggagccggggctggggaaggaggtataggtaaatagttttggtcccagggatcggccgtgacgtggggggataaactaattagtacctcagtagagagctctaaatcataataataatggtatttatatcagccaaccgctgtttcttgcgtgcctattgtgcatcagatacttcaagaagttttgcgtactttttaattttttgacttaaggtgcaaagggctaacttaatcacagtcagtttggggaacattataggttcttgcaaagcttctctcttggtttatgaatttactactgcatgtttggcttatagaaacacactcaaaaatattccttggatggatagagagatattattggacctagagagattaaatcagttacctaaggccgcgctacagttgcacggcgctgggcgggggggaaagaaccacaactcccagcaggcagcggcgctgcccacgggccctccggcgcttctttgcccccatgggatattgggaaatgtagtcttgagggggcactgcatgacgtgtggttttcatcttccgcaggcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgggctctgccttgatcttccttccttccgcctccagggacccaggctgcgcacgcttgacctctcctgaacctaacatggtccccaccgccagctgctcagccctcagaatgcccatctcccagcccccaaccccttcctcccgaggacacaggagccgggaccccaggcaccttttccctcccacagacccaagagcctgggccttccccgctcaaggcccaagagacctctgtgaggcacctgaatctagaccttcagacacttctgggaagaacctggattctgggtcccagcagaccctgttaggataggaagcctgcagtgaccagtcctgtctccttgctcaagcttctgtcactctgttgctctctctctctgaaccccgggcatagtgtgtgtttctagattgtcggactctttttttctttctgtccaggttggagtgcagtggtacgatctcagctcactgcaacctccgcctcccgggttgaagcgattctcctgcctcagcctcccgagtagctgggactacaggcacgagccaccacacccggctagttctggactcttttttctttctactaactttccatttgggaagacagctttctttttccctctaggaaaccagtctccctctctctctttttttttttttttttttttttgagacggagtctcgctctgtcacctaggctgtagtgcagtggtgcgatcttcactcactgcaacctccgcctcccgggttcaagcaattctcctgcctcagcctcctgagcagctgggattacaggcgcccaccaccacgtccggctaatttttgtatctttagtagacacggggtttcaccatgttggccaggctggtcttgaactcctgacctcaggtgatccacccacctcagcctcccaaagtgctgggattacaggcgggagccaccgcgcccagcccagtctccctctctagggactgaacatttggggtcctagagagggagacttcccctgtctccccaaaggctgcctctagcccatatgacacgttagcaaaaattaggaggcaccccttcttctggctgacccagccccacaccaggatacatgtaggggtatgggctgggtcttacagccacccacccgtggctgtgttcctttgtgcagttaacaatctgcacaggccgggtgcggtggctcacgcctgtaatcccagtactttgggaggctgaggcaggtggatcacctgaggtcaggagttcgagaccagcctggccaacatggtgaaaccccgtctctactgaaaatacaaaaaattagccaggcgcggtggcaggcgcctcccagctactcgggaggctgaggcaggagaatcacttgaacccaggaggcggaggttgcagtgagccaagatcatgccattgcattccagcctgggcaacaagcgcgaaactccatctcaagaacaaaaaaaaatctgcaaatctgcacaatcgcacatggctacgctatctcctctgttcatcaggccctgggactcctctggaatcagatccttctaagatcctcttctatgactgtctttgtttcaccgaccatgaacccagcctctttttaggactacagctttctctgtctgggaccccaagacctagctagagtccctcccctctttccaggattcaaatgctttccttccctccaactcctgcagccatcccactcatctagatttttaaaaataattttttaaccactcctacagagcagggttaccctaaaggcagtgcgttaagagtagcctcatccagacttattaaacatgatttattactttgggacaggagacgggagaaattgatagaccaataaatattgcacaggctgctggtggtggggagatccagaccgaggtagtttctgtagaaagggtgaaagacctgggcgaggaaggcacctgaggttgccgggagccaggttgggagcgagtcttggtggcgagggtggt

SEQ ID NO: 17080 - DNA, 49401 bp, Human
gccgggggctgccctcctgggcctcagtagggagtgggacgcggggtccctaagagcagaagccaggtaggggtgggtctgggagaggcagaggaggggctggagggtgagcagccactgggaatggaggggagcgtgagtgttaaccccgcgggggccaggccacagctgtgggttattttggggcggagtgggggggttattctgagcgctgattgagccagctgcttggggaagggcaatggaaaggaggagcgaagagaagccaggatcggggagggatgggcatactaggagcccccaaccccttccctggggagacaggggcccgagatctctgggaaggtgaggtggtgggcagaggggacgggctgtggcctcgaggcaggggaggggtggtggacctttcccccgccctggctgtctgtggggtggacgaggcctgcgctaccatggcaaccagacaggagcatgacagccaggagagaacccttccttgtctggaccctcaccccttctggaagcccctagtgcggactccagtccttctctgggaaccaggagtccagactcccagtgccctcctccctcagtcccaggcaggacccaggagcctggctcccagcccaaccaccccaggcggctagtattcaacagggggcacaggaagagaggctgtatttcctctaatttaccaaattgctctgggctgggtgccagggacccccacacccaccccacccagctctccacagctgtgccccccaaccccacatcccagatggggccatgactcccttgctttgagaatgaggggatggggacaggactaaggggacaaaatgggttaggggttgtggtcagggtgaggagtaaggtcatgtggggattttctctccttggggtgccccactaatttctctctttctctccccacacacctgaccccttttccctctcattttttctctcccttttcctcccttttatttctgctccctcctgccactcgccttccccgccttactttcatgtctgtactgggcacctccctggtgggggtcccgatcttggccttgcttcgctatttctgtcctcctgttttcgctccgctctgcctgcctccctcaatctcaattgtttccccatcctttatgtgcgcgtgtctcttggtggccttggggtctctgtctccctcttcctgccttgctgtcttcttctctgtccaactttcttgcctcgcttatctctcccgccttcctgcatctcttcccgcctctatcatcctctccctgggcctccctcattcctgtttctgtcactccgtcctctctctctccgtcttctccccgtctctgctgcttccgtctctctccttcttcctgccgctctttccctccccgtctccctgggcctctctctgctcctatcttgatcccatctctgtgggtgtccccatccccaccttgtctatcttcctctctctcccctcttacctctgtatcttcccctgaccccattatccaccctcgtctttgcgtctcccccaatcccatactccacttcttcctatctctgtctcgccctatctctgcgtctctccctgtttcacctcttcctctggtgtttcttccccacctctcccttccacctccctctgctgtgtctgtctctccctctgtctctgcctgtctctcctccatctctctctctccgtctccccctctctctcccctccatctctctctacctctgcccgtctctccctctgtctctcctccatttctctctccctctgtctctctcccttccatctctctcgtcctccgttcctgtctctccctctgttccatcaccccgaccgctccctgtcctccccatctcggcgcctgtccctcgctgcatctcctcctctgtgcgtctctttatctcgtctccctgtccctgcgtctcccgtctgtgcctccctctcctccccgtctctcccggcccgggcgctcagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggtgcgcgcgaccggggcggggcggggccacaggaggggcggggacagccgctgaggggcgggactgggacagccagcgggggcggggcctagagggggcggggactgtcctgtgggtccgagtctgggacaaggtgggcccagatggtaggcagggcttagggctagattagaggcggggctgacttggagggggctggtctatagggtaagctgggcctttagggtcagaaagaggccagtcctcgatgatcagagtatagggaggacgtgggcccattcattgcaggtaagggtctgtagtaaaggcgagtcgagggaagggttaggggctgggaacgaaaagggactagccccaaatggcaaaatctgagggaggggtgggacctaggatcagcacaggaagaagtcagttgaaaaggaatgggcctgggcgcggtggctcacgcctgtaatcccagcgctttggaaagccgaggccggcggatcacttgaggtcacaggagtttgagaccagcctggccaacatggtgaaaccccgtctctactaaatatacaaaaattagccgggcgttgtggcgggcgcctgtaatcccaactactcgggagggtgaggcaagagaattgcttgaatccgggaggcggaggctgcggtgagccgagatcgtgccactgcactccagcctgggcgacacagtgagactctgtccaaaagaaaaagaaaaggaatggagttcagaaagaaaggggcgaagtctagtggagaggtggcagctaggaagtatcagaggtatcaggtaccaaggacagagtttggggaggcgttcggccggtagagcatagggtctagaagtcagccagggatggaggagccatcttctaagtggaagagtcggaaaagaggaagagtcattagagagaggaggacgggcaaggggtagaaccaggaagcaaggaattgagatttggtgcgaggccagtcagggaaggagtgagtcagaaaagggggcggggctagccagttgggggcggggccagcgaggggcggggcctaagcactctaataaaggggtgggtctagggaggaagccggtcctgagagtagggtttgagaaggggcataccccgctgtgaggtgtggaaagcgagagtccagaggatgggcaggaggatgaaggcttatggtggaggccgacccagccaatgacagatcaaagccaggagcctgctgggaagggatggtagaggctggagctggccagagcctggagaaaggcctgactcccaagggcacagaaggggccagttgtagcggacctctggtagagaaggagagaattggaccaagcctgctctgtggattgagaatgggtcagctaggaggtggggcctgagaaggggcggggcctctccagaggtggggccagcgcaacccagaggtggagcttcattcaatctgcccattccctgctgtgcgggcctgtggctgtgtgactgcatcactgttgtatgcagaggctcgtagtcctctcctgtccagagcattctgggaaggacctctgtccaactttcttgttctccttggcatggtacttttcagagatttgtaggtagatgccctgggaggcgaacttatttcttaactgccacttccaaggcatactcaaaagacgtgatccctcgtgccttcattgctgctgagaagtgtggtcctctctgtttcattgtccgctgggcactgcggtcggctcagtgtacgcccatagcattctgggaaatgtagtccccgtgctgcccctggatggaagaaagaatgatcttcacagctccatctgtgccccactgaatgctgggaatgtggtcccctcagcacacctccacctgctgaaggaagaggttctccttgcattacaataagacctcatttccggccaggtgcactggctcacacctgtaatcccagcactttgggaggccgaggcgggcagatcacctgaggccaggagtttgaggccagcctggccaacatggagaaaccccatctctgctgaaaatatgaaaattagccgggcatggtggcgcatgcctgtaatcccagctactcaggaggctgaggcaggagtaatcgcttgaacctgggaggcggaggttgcagtgagccgagattgcagtgagccgagatcttgccactgcactccagcctgggggacagagtgagactgttctcaaaaaaaaaaaaaaacaataaacaaaaagaactcattccctcaggacaactgcagtatcccctgtgcgcctagggagaaagcccacttgctgttctcattgcattacaggaagatttattgagagctgattctgtgccagggctgttttaattcctagggaatacagttctagagggggggaaaaaaaaagagagggagacaaggtccctgccttatagagcttgcattttaatggtgagacagacaaaaccagtaacagtaaaatccggctgtcctggaggaaatcaacacaggatgttgtaatgactgaggatggagtttcaatagatggcagtcaggggaggcctccctgaggcggtgacacctgagctggaggtgtcaggtggaggtctggcatggaggaggtagggaaaagtgtccccaggagaggcaacaacaaaggacaaagcccttgaagcaggaaggagcttgatgtatttgaggaagagcaagaagggagtgtggctggagcccactgggggattggggtggcaggagatgaggtcagagaagcaacgggggccagttcacgcagggccttggggccacggtgaggactttggctttgattctgaggtagaatcactggaaggttttcaattgagaagggatgtgatccaattaatattttgaaacaatcactctggctgctgtttggagaatagactggaagatgcaagattgaaaacaaagataggctgggcgcagtggctcatgcctggaatcccaccactttgggaggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagagagagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagctttcagtgagccgagattgcgccactgcggtccgcagtccggcctgggcgacagagcaagactccgtctcaaaaaaaaaaaaaaaaaaaaaaagattctttactcctttacgagagagagagagagagagagagagagagagagagagagaatagggaacagtcttgagataggggaaagatcgagcaatctgtttttgacatgctaattttgagacaccttggaaatccaagaggagatattgaataaaaaggaggataggggccaggcatggtggctcacacctgtaatcccagcactttgggaagccgaggcaggcagatcacttgagttcagaagttcgagaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaggctgggggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggatagcatgggagacagtatttaaactcatgggcctggttgagatcaccagggagagaggaatagagaagagaacagtaaggcactcctagtgtttagaatttagaattctggctgaggaagaagggccagcaaaggaggcagaggaagaggtgacagagaggtaggaggaaaaccaaagaagggaaaggacactctgcaaagcttcttccagtagggaaataccatcagcaccctcattgcatgctgggagatgtagtctcctcactgccttcagggaaccagtccctctcagtggctgctgggggctgtagttcccttaccggatgctggttgtattaatgacagtgatgttagctgctggaacggatgaacccccaaatctcagtggatcacccaacaggaggttgtttctcattcatataaaatccaggccaggcacagtggctcacgcctgtaattccagcactttgggaggccaaagcgggtggatcatctgaggtcaggagttcaagaccagcctggccaacatggagaaaacccgtctctaccagaaatacaaaaattagttgggcgtggtggcgcacgcctatagtcccagctactcgggaggctgaggcaggagaactgcttgaacccgggaggcggatgttgcagtgagccgagattgtgccattgcactccagtctgggcaacaagagtgaaattccatctcaaaaaaaaaaaaaaaaaatccaaacaggtgttcctgattggaggtggctttcctccgtatggtgactcggggtttcaggctctcaccctcttgtagctctgtaatccccttcagaggactaagcttcaagagtaaggttttattaggctgggcacggcaggagaatcacttgaacccaggaggcggaggttgcagtgagccaagatcatgccgctgctcaccggcctgggcgacagagcaagattctgtctcaaaaaaacaaaaaacaaaaaaacaaaacaaaaaactaaggttttatggatgagtctagaataactcatcacgtggctaaacctaatccagatctagccctgtgccccaggaggaaaaggagatgggtttagtgaacctgtcgagtcagtctgccatattgggagctgtggtccccttattcattgctgagaaataaggtccccacatcggcaggcctgacatcctcctccctccctggcaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtgagtggggctggaatgggaggggtgtgggagggctcccagagcctaactacctcagtattcactgaatgagtggctcaaatgggccacatctgctctttgagcctcagttttcttttctgtaaagtgggtgcaattgggtctcttttctgaggttaaatcaagtaatttggaaaaagcacctgagataaagtgagtgtattactatatttcatgactctaagatgcataatgtttcacattttaatgtctttgaaaacgagatgtgtcttataattgatgacttatcatggcttaattggcagcacttttgtctttctttgtggtacatcttataattgagagcattttagatttagtctaaatacctagactataaactgagcttcagtagcaaaaaagacccaacaatccagtggcccagatgaggtcgaagtttgttcctctctcacgtaacaaccctgataaggagactgctgttccatgtgatcattcagggacccaggattctcccacactgttactctggcatctctgcatggtcgaagtgggtcgtggggatgtctgaattgtagctcatgagaaggggaaaagagaggaagtggacagcaagcactttccttttgagtaagtgaggcagaaaggacacgcctcataccttactgttgagaacgtagtcatatggtcagggctggcttactggttgttgacagtggtgtccattctgattggctggacgtctattggaattagctagacgtctattctgattagctagacgcctattctgattgactagacgtccattccgataggctagacgtccattcctggctagacgtccattctgattggctagtgcctgtgcagcgccgattgctacatattttgaatattactcctgcacatggcctggccaactgcaaggaagagtgggaaatgtcagtcctagctggacaggtgtgtgcccaacttacgcactattattttagaagaggcgaacagagtttgttggaaaatagcatctccacggtaggaagctctgggagtggaaaaattgataagtttggtgacagaacagtgaaaagagagacctttaatcctgaacgaggatggggtgaatttgggaagagatgatggttggggaagaagacctaagagagggtaattgagaactggtgacttgggaatcaggatccccgaaaaagaggatgagaaaagcatcccttcttcataaatacttactgagcacccgctaggaactagggctcatgctgggcgctgggaacatagatgaataagaccatgaacttattcttcaaagaacgcagggtcctgtaagagtggcagacagggacagggataatggcaacgcagcatgatgcttgcagtaatggaggtcatgcgggcatggcgggggcacggggaggagcactggctaagccaggagattttcggatgcatgaagcagagtctcactggagtttccttagggaaaagggggtttattggaaaaataaacacacagaggaattaaagccaggaattgaggctaagcctggggccagctactctttcagctctttctggttctttctttttttctttttctttctttctttttcctttttctttttttttttgagacggagtctcactctgtcgcccagctggagtgcgatggcgtgatctgggctcactgcaacctccacctcctgagttcaagcgattctcctgcctcagcctcctgagtagctggggttacaggcacgtgccaccatgcccggctaattttttttgtatttttagtagagatgccatgttggtcaggccagtctcgaactcctaacctcaaatgaactgcccacctcggcctcccaaagtgctgggattccagccgtgagccaccgagcccagctggttctgtctttcttattctatgctttctccctccctccctctgtccatctccttcctctctctctctctttctctttgtttctcaggcttgcctctcccagacgctgttcagttctttacccagaatttcttctccctcataacttcagctcttgctggtcacaactcatccctccagatctcatagcaaaatgtcatcccaagagaggaaatgtattagcctcagtctgccttccaaaccaggttgcacaagtcacaagtcagcctgtggagtcaggaaggtttctaggagaaggtatctgagctgtgacctgagggatgaattgctcattgattcatttattgattgaaacgccctttattgaaagtctgctatgtgccaagcattgctttaggcacagggtgtatatagtgttaaataaggtccctgctctctcagagcttacaatctgataaaagagaaatgcaatgagcaaataagtaaagaaaaggaaatatcaagcaggcaataacttctgctatgaaaatcaaactggggaatgtgataagaaatgcatagggggctatgctaggtggggtggtcaggaaaggcctttctgaataggtgaaatttggaggttaaaaaacatggataggccgggctgtggctcatgcctgtaatctcagcatttcgggaggctgaggcaggaggatcgctagaggccaggagttccaggccagcctgggtaacatagtgagaactccatctctacaaaaaatttaaagattagctgggcgttggccgggcgtggtggctcacacctgtaatcccagcactttgggaggccgaggcgggcggatcacaaggtcaggagatcgagaccatcctggctaacagggtgaaaccctgtctctactaaaaatacaaaaaattagccaggcgtggtggcgggcgcctgtagtcccagctactcgggaggctgaggcaggagaatggcatgaacccgggaggcggagcttgcagtgagccgagatcgagccactgcactccagcctgggtgacagagtgagactccatctcaaaaaaaaaaaaaaaaaaatctgggcgtggtagtgtgtgcctgtagtcctagctacttgggaggctgacatgggaggatcacttgagccttggagatcgaggctgtaatgaactgtgatctcttcactgcagtccagcctgtgcaacaaagtgagaccctgtctctaaaataatttaaaaaattaaaatttaagaaataggtaggcaaggtgtggtggctcacacctgtaatctcagggctttgggaggctgaggtgggcggatcacttgaggtcaggagttcaagaccagcctggccaacacagggaaacaccatctctactaaaaactacaaaacttagccgggcgtggtgacaggcacctgtaatcctagctgcttgggaggctgaggcaggagaatcacttgaacctgggaggtgaaggttgcagtgagccgagaccataccactgcactccagcctcagtgacagagcaagactctgtcttaaaaaaaaaaaaaagagagaaagaaagaaatggataaagcgaaggagccaagtattggaagatctcagtgaagggagagggaacagcaggtgcaaaggctctggggctggaactgccttgtcttagtctgttttgtgttgctatgacagaatatcataggctgggtaattataatgaatggaaatttgttggctcttggttctggaggctgggaagtccaacatcaagatgtcaccgtctgatgagggtcttctttcagcatcattacatgagggaaggcatcacatggtagaagggcaaagagaggagtgagggaagatcaagcaaacccactcctgcaaccacagcattagtccatttgtgagggtactggagccccatgacctaaatgcttcttaaagtttccacctcctaattcccaataccatcacaatggcaatggcaattaaatttcttttttttttttttttttttttgagatgaagtctcactctgttgcccaggcgggagtgcagtgatgtgatcttggctcattgcaacctccacctcctggattcaagcgattctcctgcctcagcctccgagtagctgggaccacaggtgcctgccaccacacctggctaatttttgtatttttgtagagatggggtttcactatgttggccaggctgctctcaaactcctgacctcaggtgatccacccacctcagcctcccaaagtgttgggattacgggcgtgagccactgcacctggccgtaaatttcaatatgagttttggagcggacagacatccaaatcatagcttgcctgttcggaagcctgtttgggagcctgcactgctggtgtggctagaacatagtgggcaaggggaaggaaggtatgagtagcggatggagagggttgcagggcccagcttgtgaagggcctttaggccagggggcaggggtttggacatgattcttttttttcttttttttgagatacagtctcgctctgttgccctggctggagtgcagtggcacaatcttggttcagtgcaacctcaacctccctcccgggtttaagtgattgtcctgcctcagcctcctgaatatctgggattacaggtgcccgccaccatgcccggctaattcttgtatttttagtagagacggggtttcaccatgttggccaggctggtctaaaactcctgacctcaagtgatctgcccccctcagcctcccaaagtgctgggattacaggcgtgaaccactgcgcccagcctggacttgattctgagagtagtggggagttcaccggaaatagtattccagtcaggggaaacgagcatatgcaaaaacccagaggggagagaaacttgggcagatggtgggaccacaatagttccaagcagatgaaggccacagaattaggagtcagagtgacaggccaggcgtggtggctcacgcctgtaatcccagcactttgggaggccgaggcgggcggatcacgaggtcaagagattgagaccatcctggccgacacagcaaaaccccgtctctactaaaaatacacaaattagctggacatggtggtgcacgcctgtaatcccagctactcgggaggctgaggcaggagaaccgcttgaacccaggagacggaggttgcagtgagctgagatcgtgccactgcactccagcctgggcaacagagtgagactctgactcaaaaaaaaaaaaaaaaaaaaaaaaaaaagcagtcggagtgtgggtggcaccaggcctttgccttcaatgcaggttgagaggcctggatctgttccacagcactggtgagccaggggtgggttatgagcaggagacgggtggcgtgagttttgggtatagaaagacgcctctgggacctggtggggaacagactggagtagagagattggaggctggaggccaggcaggaggctgggatgagggcctaggagggctgtggggaggcacagaagaagacagggcagagagagccccaggccaggaagaaggagacttggggaccgataggctgggtagcgggagggaggaaggcggctaagagtctagtccagtgactgggtggatgacatgagagacagtcagagtacccagggtgatgttgcatagtgaagatattgaggagtccagggacacccccggccatccccagccctgggcacttctaaccagaggaagagacatttgagctcagtctttaagacacatggagttggtcaaggctgggtacagcggctcgtgccagtaatcccagcactttgggaggtcaaagcaagtagatcatctgagcttgggacatggcgaaacctcgtctccaccaaaaatacaaaaattagttgggcatggcggtgcacatttaaagtcccagcagcttcacaggaggctgaggtggaaggatcacttgagcctgtgaggcagaggttgcagtgagccaagatcacgccattgcactgcaatctgggtgacagagtgagaccccgtctcaaaataataataataataataataataataataataataataggccggcagtggtggctcacgcctgtaatcccagaactttgggaggccgaggtgggcagatcacaaggtgaggagttcaagaccagcctgaccaacatggtgaaaccctgtctctactaaaaatacaaaattaggcaggcgcggtggtgcttgcctgtaatcccagctactcaggaggctgaggcaggagaatcgcttggacctgggaggcggaggttccagcgagctgagattgcaccattgcactccagcctaggtgacagagcaagactccatctcaataataaataaataaataaataagaagaatagttggtcaggataaggggtggtataaggtttttcaggcagagagaacagcatctgcaaagtcctagagataagaaatcacttgacatgtttgggagacaccttgaagccagtgttgatagagaaaaaaaaaaagaattttggggtgaaaagagtttgaagtttgagggtgggaactctcagagatgcggcttcagaggaaggcaaagccagaacaaaaacagactctaggggcctggcacagtgattcacacctgtaatcccactatgttgggaggttgaggtgggaggatcacttgaactcaggagttcaagaccagcctgggaaaagtagtgagaccctatctctacttaaaaaaaaaaagaggctgggcgtggtggctcatgcctgtaatcccagcactttggaaggccgaggcaggcggatcacaaggtcaggagatcaagaccatcctggctaacacggtgaaaccccgtctctactaaaaaaaatacaaaaaattagctgggtgtggtggcaggtgcctgtagtcccagttacttgtgaggctgaggcaggagaatggcgtgaacctgggaggtggagcttgcagtgagccaagatcgcaccactacactccagcctgggcgacagagcgagactctgtctcaaaaataaataaataaatacatacatacatacataaaaatttaaaaaaaagaaaagaagaaagagaaagaaaagaaagaaagaaagagaaagaaaagaaagaaagaaagaaagaaagaaagaaagaaagaaagaaagaaagaaagagagagaaagaaagaggcgggccaggccaggcgcggtggctcacgcttgtaatcccagccctttgggaggctgaggcgggcggatcacctgaggtcatgagttcgagaccaccctggtcaacatggtgaaaccctgtctctactaaaaatacaaaaaattagccgggcatggtcgtgggcgcctgtaatcccagctactcgggaggctgaggcaggagaattgcttgaacccgggaggcggaggttgcagtgagctgagaccacaccattgcactccagcctgggcaacaagagcaaaactctgtctcaagaaacaaaaacaaaaacaaacaaaaaaccacacattaaaaaaaaaaaaaaaagaaagagggcatggtggctcatgcctgtaatcccaacactttgggaggctgaggcaggtggatcactgaggctgaggtcaggagttctagaccagtctggccaacatggtgaaaccccatctctactaaaaatacaaaaattagctggacatggtggtgaacacctgcaatcccagctactcaggaggctgaggcaggaggattgcttgaaccaggaggcggaggttgcagtgagcgaagatcatgccactgcactccagcctgggtgacagagcaagactctgtctcaaaaaacaaaacaaaaacaaaaacaaacaaaatattagccaagcatggtggtgcatgtctataatcccagctacttgggaggctgaggcaggagaatcacttgaacccaggaagtggaggtggcagtgagccaagatcataccactgcactccagcctgggagacagagcaagactctgtctcaaaaaaaaaaaaaaaaaaaaagaccagcctgggaaaaatagtgaaaccccatctctactttaaaaaagaaggaaagaaaaggggactctagggcctcaacaccaagctgaaagagagtctggaaccttatcctggggggcactgggcagccaaggggagggtgctgagcagggaaggggtatattcgtgtttttgagaccttggaggtaaaagaagagagattccagctgggggctggggctggtctgcagaaaggggactttctctgccttccgctgccaaggtccagcccaggccccagcatgtcccctttccctcctcctgggcaggtacttcatgaacatcacgtgggataaccgggattactccttcaatgaggacggcttcctagtgaacccctccctggtggtcatctccctcaccagagacaggacgtgggaggtggtgagtcgtagccccagacctcaggcatggcagagggtgtggactcctgcatcctggcagagggggggcttgaggtcgtggactaagagggaggaggggacaaggagcctggactcctgggtcctgggatctgaaggtgggaggggctcctgggtcttggaagaagctgctgcccacacacctaggtctgagggaagaggatcatggaggccaggatacaccgggaagtcttcccaggaagcctgactctctttccctttggccaaggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacaggtgacagctcgggatccaggagttccggctccaaaacccgcctcccgtgaagcccagtagtctgggcccccagccccctcctcccttgggacccaggacccacaaagccctccagcttggtgaccttaggcaaacctcagaattctttgagcctgagtttcccctgaaagcgctaaccatagttttagctgccgcctatcccttcctccatatcctctcttcatgagagagtctaaggagggggtccccaaactccccaagcctggtcactgcccgcagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgagggggcggacgggaggcggggaatcttcggggcggagtcgagaggcgggcacagccgggcgtggtggctcacgcctgtaatcccagcactttgggaagccgaggcgggcgaattgcctgagctcaggggttcgagaccagtttgggcaaaacggtgaaaccccgtctctactaaaatgcaaaaaattagccgtgcgtggtggcgggcgcctgtaatcccagctactcgggaggctgaggcaggagaattgcttgaacccgggaggcggaggttgcagtaagcggagatcgcgccactgcactccagcctgggcacagagtgagactcagtctcaaaaaataataataaaaaaaaagaggtcggcaccctggggcaggggcgcggccaaattgaggaaacacctgattggggcctggggcggggtcgcgggagggacatgccttggaacagggggcggggtcaggaggtgtcaggggcggggtttggaggagggactttggagcagaggaggcggggctaggagggtgggactcctaggggaagggggcagggctgggaggagggactttggggcagtggaggcggggctaggagggtgggactcctaggggaagggggcggggctgggaggagggactttggtacagaggaggaggggccaggagggtgagaatctaggggaagagggtggggctgggaagatctggaccaaggccttgaggtcttgctgggagcagccgggtaggacgcgggctaccaattcccaatcttgttccccatttctcacctccgcccttccctgccccactcttcgtccccctcctcacccacctcgcaatccctcttggccccttccctcaccctgtcactggtctgctcccggggcccgtctctgctcgccgtccgtgtcagtctgtccgcttgagccgggttcccccgcccactcctcatcgcccccaccccaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcggtaatctggggccctgggacagggagctagccctaggcaaagtagccgtccccaaccgtgtgggccctgggatcagaaaacctgggttcccggtatcatcggtacttgaacccgctgtgcaacttcggtgaagtgacatcatttctgaacctcagtttcctaatctacaagatggaagaaataatttccctacccagaagacatttcatcaagaggctaaagaagcttgagctcaggagccttctcttgcactgcagcttccaagccctgcacctggttttgtattcataaggttgaattattttttctcaaagagagccctccaaattgtgcaagcttcaggccccacaaaacccaagtgttttcctgtactaggtatgagatgaagagaacaaattagcatggtaccaataccttgtaagcacttaagtcaccatcagtgtttactgagcatctactatgtgccaggtggtgggctccacactgggaacacagtggcaaatgaggaagacacaaatccctgtccggtaggatctctcagccttgtgaaggaggcagaagataagcttctacttctctctctctctctctttttttttttttttcagacagagtctcactctgtcgcccaggctggaatgcagtggcaccatctcggctcactgcaacctcaacctgcctctcaggtttaagcgattctcctgcctcagcctgccaagtaactgggatcacaggcacgcaccaccacgcctggccaatttttgtatttttagtagagacggggtttcaccatggtggccagcctaatctcaaactcctgacctcaggtgatctgcccacctcagcctcccaaaatgctggaattacaggcgtgagccactgcacccggacaagggttttaactacagaagatggtgtggggatatataatcagatttaagtttttaaaatatccagctctgtgtaatcccagctactccggaggctgaggtgtaaggatggcttgaacccaggaggcagaggttgcagtgagccaagatggcaccaccgcactccagcctggatgacagagccagaccctatctctaaaaaagaacaaagaaaaaaatcccactctgtggaagcaagtggctggtggggatgctactgcaaggtttatgccagagacagagtgggggtgtgcaataggaaggtgacagcagacagatgcagggtgtggttagagagctgcccaccagatgggctggtggctttgagatggattgggtagagggaccattgctgagctggagaagcgtacatcggccaagggcaacagtgcttgtcagttcccacttgctctctgaagtgtgagcaaagctcctgggagaggggaggggctggaagaagagccatcccttcctttgtgttttgttttctgtttatttcgcccagtggtgtctcctgtggcctcccctttgcaccaaggtctctgcagggcacactgagaagcaccacgtggggcccctgcttgcaggcagcacactgcagaggagtgacaaggtcctatttatgccccaccaagttgcccagcagaggtgacaggcgtgtccccagctgccgcagtgacagtccagggtgctgaccttgctgtgacgggggcagtcctgacagctcacacttggccctggaaagttgaatcacctggtcctaatctcaatgaaatggtgatttgggtttattgttggtgagctcccaggggctaaacacagttatcgaatgtgaggaggggacacatgaatgggaggttgtctaatggacagggcagggtgttaactctagcagggacacctaggagacaaggaagagagggtgtcgctgattcaggcacctgcgagttcttttttttttttttttttgagacagagtcttgctctgtcacccaggctggagtgcagtggcacgatctcagctcactgcaacctccacctcctgggttcaagcaattctcctgcctcagcctactgagtagttgggactacaggcgcccaccacgacacccagctaattttgtatttttagtagagatggggtttcaccatgttggccaggctggtcttgaactcctgaccttaggtgatcctcccacctcggcctcccaaagtactgggattacaggcgtgaaccaccacacccagccacctgtgagttttgagtaaagcatgggtgcttgagagagtgatcaggacagaaaggagagtgtgacaaggctgagtggcagggactttgtcctgggggtgctagggagcctggggagggctgtaagcaggggaggggccaggtcctctctgtgctgtgtgggggataggctgtaggggacagacaggagctcaggaggctggggaaatggttggtgggaggagatgaggcctgagccctgttggccatgagaatggagaggagaggcccaagtagcatcaggggcaggagcgtggggctggatactgacaggctgtggccagcgagggagagggagggaggaagggaggacggcaaatgaggtttgggcctgtgactgggtggatggtggggctcccatcatgaggagcgtgggagctggtctgggctcagcatgggacatgatgaatggcctgaggagatggctggggtaggtggaggcttgggcctgtgactcaggaaacatttaggagacagtttctatttggtggctgaaaccacagaaatgcctgcgacggctctctttgagaatggctgcctcctaggggtatgggtgtgccataagactatcttggagatggagaagcagagatagggccagaataggatggggtcagatctgggctgcaccttgttccctgctggtagtaccctagggttttttttctttcttttttcttccttttttttttttgtagagacagggagttcaaggccagtctggtcttgaactccaggcgtcaagtgatcctcctgcctcagcctcccaaagttctgggagtacaggcgtgaggcaccgccccagcctgatccccgagtcttttgcttggctgagccataaccacgcactcccttgtccccagagccctacagccccgccgtgtgggtgatgatgttcgtcatgtgcctcactgtggtcgccgtcactgttttcatcttcgagtacctcagtcctgttggttacaaccgcagcctggccacgggcaagcgtgagtcccccttcctccatcccccgcctcggagatcccgaaccacagagacagagaactacatttcccagcagcccctggagggggggcggtcaagctagggcctctcgggaggtgccagatgccttgagggccactgggaattgtagttctttcttttttttttttcccttccttattgagaagggatttggggtccatgtccacgtcctggccccctgcaggccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaaggtgtgtgtgggcccagggctgggctggagatggggctggggctggaggtcacagagcttgtcatgtggtagattagaggggattcttgcggggggcgggggtgagaggggtggggggagggcgggaaggggtctcttcccaaggagaattccagaatggtagaatggaatgttgtggatgaagaaagaacacggttcacgatgagctatttaaaatattcctagggaagagggtgtccctgaatgttctaggggcagttgtgtcaaataggatattctagaaccagtgcttctctcaaactgtgaggaaggattaatttttgaaacttctaaggctgggcgcggtggctcacacctgtaatcccagcacgttgggaggccgaggcgggcggatcacgaggtcaggagatcgagaccatcctggctaacacggtgaaaccccgtctcttctaaaagtacaaaaaattagccgggcgtggtgacaggcacctgtagtcccagctacccgggaggctgaggcaggagaatggcgtgaacccaggaggcagagcttgcagtgagccgagatcgccccactgcactccagccagcgcgacagagttagactctgtctcaaaaaaacaaaaaactgctagtccattgcagacaatgcttttgtaaaattcaacggaaatgaattattagaaaagtaaaataagatctaaaaccaagacagacaaaagtcaaacctggccaggaacggtggctcacgcctgtaatcccagcactttgggaggccgaggtgggtggatcacctgaggtcaggagttcgagaccagcctggccaacatagtgaaacctcgtctctaataaaaatacaaaaattagccaggcgtggtagtgggtgcctgtagtcccagctactcgggaggctgaggcaggagaatcgcttgaacccgggaggcggaggttacagtgagccatgattacgccacaaatagaactgattcctagcctgggtgacagagcgagactctgcctaaaaaaaagccaaactcacatttttatttattagattcaacagacgaaaaagaattctgtcaaatcactctaaatgctcactctctccattcctgtacacatctcactgcaatcaccgtttgttgagggactggtggtttgcagagcatactttgagactaaagtgattaactagctgggtgtcatgacctattagaggcttgagaaatcagtttgatgggttgcaataagcattttttaatggaatggagtagaatagaatagttgcctgcatcttatgtataagtttggttttacaaaacttgttttagttggctgggcgcggtggcttatgcctgtaatcccagcactttgggaggccaaggcgggcggatcacctgaggttggtagttcgagaccagcctgaccaacatggagaaaccccatctctactaaaaatacaaaactggctgggcatggtggtatgtgcctgtaatcccagctactcgggaggctgaggcaggagaatcagttgaacctgggaggcggaggttgcagtgagctgacagtgtgccattgcactccagcctgggcaacaagagcaagactccgtttaaaaaaaaaaaaagtgaactatttctgaacggattggtaaatagcaacagctcccagctcctgccatgccagcctctacccccaggacctcccgcgattcagtaagtgaagacttaacacctggcacatcaggggcctcagggaggcttctcgtgaacttttggatcacgtgtctgcaaccgtgtgtgctgggtgggagtggaaaagcattccctaatgtagtgagcgagtgttgagaaatattgaacactcctgggactggggtgtctgccagatagcaggtgtgtctcagaatgggtgatttatgttagggatgtccctgcggagggtgccctaatcactccccattctgccccagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggtcagcgcagactcgggccgggggtgggggttgggccgctggggacctgaggatgctcaaagatggcaaggggtccaggttcattcattcagtcccagaggtcagccctgggtgggtcagcttggagggcggaggtcactgagggtggaagtggactcctcctcccaggagcaggctccttgggatattttctgggatgcagtatttctggattctggggtgagactgatggggctcaaatctttgctcttccccttcttggctttgtgaccttgggcaagttactcagcctctctgaacctctgtttcctcctctgtaaaatgaggataacaagagtatccccactgtaatgatcataaggttgttacaagaattatactagtaagccgggcacggtggctcatgcctgtaatcccagcactttcagaggccaaggcaggcggatcacaaggtcaggagatcgagaccatcctggccaacatggtgaaacctggtctctacaaaaaatacaaaaattagctgggcgtggtggcacgcgcctgtagtcccagatacttgggaggctgaggcaggagaatcgcttgaacctgggagtcggaggttgcagtgagccgagatcatgccactgcactccagcctggcgacagagcgagactccgtctcaaaaaaaaaaaaaagaattaaactagttagtccactcagaacatttatttatttatttagaacagtgcctggtgcactataggtgtttgctgatattatcattatcattagacctgaactcactggaatcaatgcttagattgtgtttcttatctttttacatccctttcccaaatcatagggatgaagttaaattcagaggccaggcgcagtagctcacgcctataatcccagcactttgtgaggcggagacgggcagatcacttcaggtcaggagttggagaccacctggccaacatagtgaaaccccatctctacttaaaatacaaaaattaggctgggtgcggcaacaggctcttgggaggccgagacgggcagatcatttgaggtcaggagtttgagaacagcctggccaacatgatgaaaccttgtctctacttaaaatacaaaaattagccgggcgtggtggcgggcgcctgtaatctcagctgcttgggaggctgaggcaggaggatcgcttgaatgcaggaggcggaggttgcagtgagccgagactgtgccattgcactccagcctgggcaacagagacagactccgtctcaaaaagaaaacaatacaaaaaaagttgagttcaggccccaaagtgcagcccacgaatacaacaaggctgagcacagtaactctctccccgtcctgcacttactcagtccttccgtgtgcatttttcttatcctctgctgtacgctaagcggtgaacaaatagacccgattcctaggtctagaggtgggaaatgaacaataaacatgcaaacagaaaaatcaagatctcttcagaaagtgatggtgagctagagggcggcagggctgggatattttcaccagggtgttcagggtgggcttctcggaggaggtgacatttgtgcagagccctgcaggaggtgaaagagctagccaggtggacttccggaagcagagccttcagacggagggaacagagtgtgcaaagggcctgaggaaggtgcagtgttggtttactggaggaacagcaagaaggccagtgtggttgaagggcaaggagctgaggtgagagagtagatgaggggaggattctgggcatgaggccaaggtcagggctggactttatgctaaaggcggtgagaagccttgaggtgtggagattttacgtaaggaagggtatgatctgatttctgtttttgtttgttttgagacaggatctcactctgttgcccaggctggagtgcagtagttcgatctcagctcactgcaacctccgccttccctgggttcaagcaattctcccacctcagcctcctgagtagctgggattacaggcgtgcactactatgcctggctaatttttgtatttttggtagagatgaggtttcaccatgttggtcaggctggtcttgaactcctgacatgaggtgatctgcctgcctcagcctcccaaagtgctgggattagaggcgtgagccaccatgcctggcttaaaaaaatttctaatgcccaatgcagtggctcacacctgtaatcctaaagctttgtgaggccaaggtgagaggatcacttaagaccaggagttcaagaccagcctgtgaaacatagtgagacccccttgactcacaaaaaaaaaaatttttttttttttttttttttttgagacagagtctcgctctgttgcccaggctggagtgcagtggcacaatctcggctcactgcaagcgccgcctcccgggttcacgccattctcctgcctcagcctcccgagtagctgggactacaggcgcccaccaccacgcccagctaattttttgtatttttaatagagacggggtttcaccgtgttagccaggatggtctcgatctcctgacctcgtgatccacccgcctcagcctcccaaagtgctgggattacaggcgtgagccaccgcgcctggctggaaattacttttaataatatattttacctaactatgtccaaaatattattttgacacgtaatcagtataaacatgggtgagaccgtttacataatttttttccccacacgctgtctttgatatctgtggcattttacactcacagcacatctaggttcagagtgaccacatttcaagtgatccacagccctagtggcgtgtcactgctgcactggaccgcccaggtcgacatcacccaaatgcaaaaagtttcctagtcaacataatgaacagaaaatataaaagggcgctggccgccccccaggaccctgggactttttcacttccttactcacccagagcattctccccagccagcctgctgactcatctctcccccttcccccttcttccgttttcttctcgccagcccttccctccaggaaggaccctgagaattccagattctctcttctctctctctctctctctctcacacaaaacagggtgcctttccaggctgccacctcccacctctgcttcacttgcgccttcctcagaaggcagggatggctgcaaacagaatcactttcctcttttaccccttcagggatacctcacactgccagcctgctcagtccttgcagtgggagagcaagaattcagagactctcagtgggcgggcgggggggatcccattttctttttttgagatggagtctcgctctgttgcccaggctggagtgcagtgctgcaatctcggctcactgcaacctccgcttcccgggttcaagcgattctcctgcctcagcctcccgagtatttgggattacaggcatataccaccatccccggctaatttttctatttttagtagacatgtgatttcactatgttggtcaggctggtcttgaactcctaaccttaagtgattcacctgcttcggcctcccaaagtgctgggattacaggcgtgagccaccgtatccagcggatggcactttccaaatctacttggttcccaagttttggatagcaagtggtgagaatgtgactagcaagacagaccagccccatctctcaaaatgaacctaaatctgtccccgccttgagttcagagaaagcaggatacctgtattttttttcccatacaaatgtcagccacatcaccagcctttaataagtaaaaatagctgaggcctcatcccgtgtctttttatagatatttttcatcttttttttattgagatatatacatagatacagtgaggtacagtgaggtacaaaaagcgtgcaactcattatttatacattcatagacatccatgtgaccaggtccagattaaggtatggtgaatttcccggcttctcataaagcttcccctgcccctccagtcaccatagaatatcatataattagttttgcctgattttgaacgtcctctaaacagaatcaaacagtgcatataataccttcctgtctggcttattttcctcagtgttatcaccagattgttccttcattgctgaataccgttgagtataccattatataaatataccataattctttcattctactgctggtggacattcaggttattgccagtgtttggccattatgaatattgctttttttcttttctcttctttctttttctttctttctttctttctttttttttttttttttctgaaacagagtctctctctattgcccaggctggagtgcagttgcgcgatctcggctcactgcaatctccgtctcctgggtttgagcggttctcctgcctcagcctcccaagttgctggaattacaggcgcctgccaccacgcccagctaatttttgtatgtttagtagagatggggtttcaccatcttggccagactggcctcaaactcctgacctcaggtgatccaaccgccttggcctccaaaagagctgggattacaggcataagccatcatgcctagctgaatattctcttttttaaacatgtgtaattgcctcttttttttttattttttatttttatttatttatttattttttcagacagagttttcctctgttgcccagactggagtccagtggtgcaatctctgctcactgcaacctccacctcccaggttcaggcgattctcctgcctcagtctcctgagcaggtgggattacaggcacacaccaccatgcccggctaatttttgtatttttagtaaagacggggtctcaccatgttggccaggctggtctcaaattcctgacctcaagtgatctgcccacctcggactcccaaagtgctgggattacaggcgtgagccaccacaccttggcccattatgaatattctactatgaacattcttgtacaagtgtttgggggacatacacattccttttccttggttgtattcccataggtggaactacccggtcatagggagagtatgcttagctataacagatactgtcagacatcttccaaaacagttaggcacagtggctcatgcctgtaatcccagcactttgggaggctgaggcaggcaggtcacttgaagtcaggagttcgagaccagcctggccaacatggcgaaaccctgtctctacaaaaaaatacaaaaattagccaggtgtgctggcaggcacctgtaatcccagctactcaggaggctgaggtaggagaactgcatgagccctggaggcagaggttgcagtgagccaagaccacaccactgcactccagcctggctgacagagtgagactccctctcaaaacaacaaaacaaaacaaaacaacaacaacaaaaatccaaagtggttgtaccaatttacactctcatcagcaatgcaagagagttctacttgttccatatccttcttgcctccttgccagggcttgggatcattcctatatcttcttttctttttttttttttttttttttttttgagacagagtctcactctgttgtccaggctggagtgcagtggcgcgatctcggctcactacaacctccgcctcctgggttcaagcaattctctgcctcagcctcctgagtagctgggattacaggcatctgccactatgcccgggtaatttttgtatttttagtagagatggggtttcaccatcttggccaggttgatccaccttgaactcttgaccttgtgatccgcccgtctcggcctcccaaagtgctgggattacaggcgtgagccaccctccttggtctactcctgtatctttttaatttactttgatgtttattatatatcaagtcctgttctaactaatttaagttcacaattagtttgcaaaaaattaatcaaatcaatgttttgattcatagtcctggaggctaggcatcctcttggctccttcagagggctgtgagggaaggatctgtccaggcctgcctctccttggctgttgactcttgatccctgtatctcttcccatcatcttccctctgtttgtgtctctgtggccaagttcttttttttttttttttttgagatggagtgttgcccaggctggagtgcagtgacatgatctcggctcactgcaacctctgccctctgggttcaagtgattctcctgcctcagcctccttagtagctggtattataggcatccgccaccacgcctggctaatttttgtatttttagcagagatgggtttttgccatgttggccaggctggtctcgaactcctgacctcaggtgatatacccacctcagcttcccaaagtgctgggattacaggtgtgaaccaccgaacccagtcaagctcccccctccccctccccgctttttttttttttaattgagacggactttcactcttgttgccccggctggagtgcagtggcacaatctcggctcactgcaacctccacctcccgggttccagtgattctcttgcctcagcctccctcctgtagctgagattacaggcgtgtgccaccaagccccgctaatttttgtatttttagtagagacggagtttcaccatattgctcaggctggtctcaaactcccatcctcaggtgatccgcctgccacggcctcccaaagtgcttggattacaggcgtgagccactgcgcccggcccaagttcccctttttataaggacactagtcatactggattagagcccaccttaatgatctcattttaactggattccctctgcagaggccctatatacaaataaggtcgcattctgaagtactaggggctaggacttcaatatgtgaatttggggagggaacacaactaaacccttaagacctcataaaaaatcttaggtgggtatgattggaaacatgaggagcagcaagcttcttgcatctgctaagtggcagaactaggactggaaccctggcagcccagttctacagcccaggttctcaccactaggctatattgcctcacatgtgcactgagtaacccagaatcactccttttgtccccctccctagaagcttcatgattcacaaaggacacccctgtgtttctcattgtcacctcttgctctaatttcctgcttctgctgaattctttttctccagtatcccttgttactttttcttttttttctaatttttagttctatatttatcagagttctccatccacatagtttggagagtcagatacaagaatttcagtttagtttagtttggtttgggagtcaaggtcgcactctgtcacccaggctggagtgcagtggcacagtcacagctcattgcagcctcaagctcctgggctcaagtgatcctcccgccttagcctcccaagcagctgggactacaggtgtgcacccccacatctgattaattttattttatttatttatttttttgagatggagtcttgctttgtcacccaggctggagtgcagtggcgtgatcttggctcactgcaacctctgcctcctgggttcaagtgattctcctgcctcagcctcctgagtagctgggattacagaagcctgccaccacgcccagctaacttttgtattttcaatagagacagggtttcgccacgttggccaggctggtctcgaactcctgacctaggtaatctgcccacctcggcctcccaaagtgctgggattacaggcatgagccaccgggcccggcctaattttaattttttaatgtgtgtgtgtgtgtgtgtgtgtgtagagatggggttctcactatgttgcttaggctggtcttgaattcccaggctcaagtgatcctcctgcctcagcctcccaaagcaccaggattacgggcacgagccaccgtgcctggaaagaattttatctttaaggaaaaaaatggcaccctccatttctctcagcccagaggaatctactttcaccttgtttattgtatcactttgtgatttatctccctatctctaaataccatgtttgcatgactacctcttgatttttcaattttaggcatttttccatccgcttctcactatggaagacatactcatactcttatttaaatcaattcagcctcccacattgtgactctgacagatgaatattcagtgtttacatgttatgactatgtaaatgctctcacagctgccacagtagtaaaccgtgattactttcctctcctacacaattctttgtttttctttcttttttttcttgagacagggtctcactatgttgcccaggctggagtgcagtggcgtgatcttggctcactgcaatctgtgcctcccaggttcaagtgattctcctgcctcagcctcccgattagctggactacaggcgtgcgccactgcgcctggctaattttggtaattttagtagaggtggggtttcaccatgttggccaggctggtctcaaactcctgacctcaagtgattggcctgcctcagcctcccaaagtgctacgattacaggcgggagccatagctcccagctgatagggggtttcaccatgttggccaggctggtctcaaactcctgagctcaagggatctgcccacctcagcctcccaaagtgttgggattacaggtgtgagccaccatgcctggtctatttttcttgaggttagtaactgtcttttttctttttctttcctttttcagttgcttcatggctgtgttttctttgtggttaactaattcaaacccaaattatctgtttactgtctaaatctcttcttggtatgttcagaagtatattaatatacttaatatgttagaagtatcagatactctgttaatttcttttttcttttttcttttttttttttttttgagacagggtctctctctgtcactcaggctggagcacagtggcacgatcttggctcactgcagcctctgcctcctgggttcaagcgattctcatgcctcagcctcccaaatagctgggattacagtcgtgcaccaccacgcccagctaatttttgtattttttgtaaagtggggtttcgccatattgaagagcttggtctcaaattcctggcctcaagtaatctgttcacctcggcctcccaagtgctgggattacaggtgtgagccactgtgcctggccttgtcaatttcatcttattgaagaagttgctcttatggccttctggcctgctccagcctgggcatagccgccatcttgggatcacctttcaccttcatcccttcatctctggtttggatcctgttgtagcacaaattctaactctttctgggttttgcttccttgttcttttgagcttcctgacagaggcacatagcgggtatatttttggagacattgcaaatctgaaaagtctttttttctgtccttgtacttgatggacagtcaggctgggtatagaattctgcattagagctcattttccttcagaatttggaagagtcactctattgttttctaatatccagtgctactgtagagaaatccaagatcattctgattcctatgcctttgtatgtaacctgttgtttcttttccttgtccttggtggactgacatttatcagtgacatgccttgatctgtttcccttttttttttttttttgagacggagtttcactcttgttgcccaggctggagtgcaatggcacgatctcagctcactgcaacctccacctcccaggtacaagcaattctcctgtctcagcctcccaagcagctccgattacaggcatgtggcaccatgcccagctaatttctttgtatttagtagagatggggtttcaccatgttagtcaggctggttgcaaacttctgacctcaggtgatccacccgccccagcctcccaaagtgctgggattataggtgtgtgccaccgcgcccggcctgctttcctttcttttcttttatcttttctttattttttatttttttgagacagagtcttgctctgtcaccaggctgaagtgcagtggcgtgatcttggcttactgcaacctctgcctcccgggttcaagccattctcctgcctcagcctaccgagtagctgggactacaggtgcccaccaccaagcccagctaatttttgtatttttagtagagacggggtttcaccgtgttggccaggatggtctcgatctcctgaccttgtgatccgcctgcctcagcctcccaaagtgctgggattacaggcgtgagccaccgcacccggccttctttttctttctttttttttttttttagaggcaggttctcattatgttttccaggctggtcttgaactcctgggctcaagcgatcctcctgccttggcttcccaaaatgctgggattacaggcatgagccatgcgcatggccattgatctgtttccgttgctgggtctttcaatcgtattctcatgtcatttgttctgagaaaatttcttgaattttcttaaattcttttatgtacaatatctccctctccttcatttctctgtttgtttatttatttatgtttagagacagggtctcactctgttccccaggctagagtgcagtgaggcaatcatagctcactgcagccttgacatcctgggctcaagcaatcctctcgcctcagcctcccgagtagcttggactacaggtgtgtgccactttcgtgtagagacgggggtctcactatgttgcccaggctgctcttgaactcctaggatcaagcgatcctaccaccttggcctccaaaagtgttaggattacaggtgtgaggcaccatgcctggccagaaactggactttctttttttttttttttatttcattttgcttttttttgagacagagtcttgctctgtcacccaggctggagtgcagtggcacgatctctgctcactgcaacctccacctcccgggttcaagtgattctcctgcctcagcctcccgagtagctggttctacaggcgcccgcaaccatgcccagctaatttttgtattttcagtagaggtggggtttcaccatgttggccaggctggtcttgaactcctgacctcaaatgatccacccacctcagcctcccaaagtgctgggattacaggcgtgacaccacctgcaatacaggtgcaatggctcacacctgtaatcccagcactttgggaggacgagaagggcggattgcctgaggtcaggagttcaagaccagcctgaccaacatggtgaaaccccatctctactaaaaatacaaaaattagccgggcatgatggtgggcgcctgtaatcccagctactcgggaggctgaggcagaatcgcttgaacccgggaggtggaggttgcagtgagctgagaccagcacattgcactccagcctgggcaacaatagcataactctatctcaaaaataaaaatagaaaataaagaataaataaataaaatttaaatgcaaatagccatatgtggcgagctagtggttgccatagaggacagcactagaaaattccatctttacagtgaggcacaagggagaggcagctcccagggctctggccggctcgcaggccaaacgtgggctcaccctaccgcttccggcaagtaaccccacagggggagaaaggaaatgcacgtcctaaaaagaaatagagaaacacagcttctcctcccagccagttcttggtgccctttccatgagagatgtgcaatttctcactcactcaagaggggcaaaaaaggaaatatcaaggcccctttccgtaatgtaagcattatttttttttcttttggatcaattaaaatatggatgcattcacactcacacattccaaactaacagtacacactgttctcatcttgcctttttccacggagaaagcccttttggcatcttttctgtgttaatggaatcctacttctcagctccagtgtctgggccatggaaggcctcccttggaccagtctgagtttactcatttggccgcttcttttctttttttttttttttgagatggagtctcgctctgttgcccaggctggagtgcagtggcgcgatctcggctcactgcaggctctgcctcccgggttcataccattctcctgcctcagcttcccgagtagctgggactacaggcgcccgccacctcatccagctaattttttgtatttttttagtagagacggggtttcaccgtgttagccaggatggtttagatctcctgacctcgtgatccgcctgcctccgcctcccaaagtgctggcattacaggcgcgagccaccgcgcctggcggccgcttcttctattttcttttgagatgcagtctcgctctgtcacccaggctggagtgcagtggtgtgatctcagctcactgcaacctccacctcctgggatcaagtgattctcctgcctcagcctcccgagtagctggaactacaggcacacgcaaccacacccagctagttctttttatttttagtagagatggggtttcaccatattggccaggctggtcttgaacttctgacctgagatgatccgcccacctcagcctcccaaagtgttcttgggattacaggcgtgagccaccatgcctggcccacttcttttcttttctttcgaacttcttttttaaaaatttttaattgtatttttttttttacagatggtctcactatgttgcccagactggtctcaaactcctggcctcaagcaatcctcccaccttggcctcccaaagcgatgggatgacaagcttgagtgaccactccctacctgaacttttgttaaatttattcctaaatattttattttattttattttttatttttttgccagtgtcaaactcctgaccccaaggaatctgctggcctcagcctcccaaagtgctgggattataggcatgagccaccgcacccagcctggaattgttttaatttcattttaattgttcattgctagtatataggaatataatttatttcacatattttgtaatttatttcgtatattgatcttgtatcatgaaccttgttgaacttctattagccataataatttttattgtggatcctttgggatttttctatatacaattctattaattcgctagggcagccataacaaaataccatagactgagtggcttacacaacagaaatgtatcgccccacagttgtagaggctagaaggtcaaaatcaaggtgtcggcagtgatggctccttttgagggctgtgggaggacctcttccagaccttcctccttggcttgtaaaaagctgccgtcttcctctgtctcttcaccttgtctaccctttaagtgcccattcagccacttgttttttttttttttttttttgagacggagtcttgctcttgctccgttgcccgggcaccatctcagctcactgcaacgtccgcctcccaggtttaaacaattctcctgcctcagcctcccaagtagctgagattacaggcgtgtgccaccacacctgactaatttttgtatttttagtagcaacaggatttcgccatgttggccaggctggtcatgaacttctgaactcaggtgatccgctcgaggttcaagcaattctcctgcctcagcctcccgagtggctgagattacaggcacatgccaccacacccggctaatttttgtatttttagtagagatggggtttcactatgttggccaagctggttatgaactcccgacctcaggagatccgcgccccgggcggcctcccaaagtgctggggttagaagcatgagccaccacacccagccgtccagccatttcttagtaagcacctagtgtgtgctaggcactgttctagaccctgtggatacagtggtgaatcagacgggcaaagtccctgcctcatggaacttaaattccagtgaagggagacgtgcaatgcacggaataaatgagaatattctatagtgcattccaaggggatacgcgctatgggtaaaaatagggcagggtgaatgcatttggaaaactggggcgggagactggaggttgcagtatcaaatagggtgctcaggaaggtgtctttggagcaaacacctgacggaggttgtaactgcccagtgggttcacgttgcccgctgcctagacagagccgatttatcaagacggggggtctgcaatggaaaaagagtcattcacgcagagccggctgtgtgggagaccggagttttattatcactcacatcagtctgcctgagcatttgggaaccagagtttttaaagataatttggcgggtaggggcttgggaagcggggagtgctgattggtcaggttggagttggactcacaggcggtcgaagtgaggttttcttgctgttttctgttcctgggtgggatggcagaactggctgagccagattaccagtctgggtggcgtcagctgatccatagagtgtagggtctgtagaatatctcaagcactcatcttaggttttacagtaatgatgtcatccccaggagcaatcgggggagccagaggctgcatggcccctaaccttaatttctaatcttgcagctaatttgttagtcctgcaaaggtagactagtccccaggcaagaagggggtctttttaggaaagggctagtatcgattttgtttcagagtcaaaccatgaacagaattccttcccaaagttggtttggcctatgcccaggaataagcaaggacaacttaagggttagaagcaagatggagtcagtcaggcaaaggcactttcaaggtgagagagtgagtcaggcagctgtctaggagaagaatgttccagcaggcagaacagccagtgcaaaggccctggggcaggagcgagctggagaggtccaggtgcatctcccaggccagagtgagggggggcttgggagatgagggcagatgggtaaggagggatggggtgtcaggtggcacagggcctctaaactcgaggtgatccaagtcactctgagtgacgaggggagccaagagggggtggtgagctgaaaagggacagcgctgactcaaatgttaagatccctctggtgacagagtgggaacaaacaagaaagaaaggacggatgcagggaattttaatttttccccaacctacacccaaacaaaggctgtaggaaatggctgaggtctttttgttttgttttgttttgttttcgagacagggtctccctctgtaacccaggctggagtacatggcacaatcatagctcactgcaacctcatcctcctaccctcaagcgatcctcccacctcagcctcccaagtagctgagatgacaggcatgcaccaccaaacccggctaatttttaaagtttttgtagagacaggtctccctttgttgcccaagctggtctcgaactcctggacccaagcagtcctcctgcctcagcctcccaaagtgctgggatgacaggcatgagccagggcccctggaatggctgagttttaatagatatttagggaccatgaaggggtggtggatgcgagaggggagggagacagtatatcccagaaaaactgagcaaaccattgaaagtgaatgctgttagagctcctctttctgaaatctctcaaatatttccaccactggaagccttgacttttagctttctccaaaatgtaacttgagtctctccttccactcccgcttgtcctctgaggacccctggagacactcctcccatcttatcccagtcccagcccttctatccctaactctagaaactccacattcttcccacttaaacatcaatagcacttcacctttcacccccaagggcatcttcctaaacaaagagaaacgtagggaaaaattacagtttgcctacaaggcagaagtgcctgcaggcagtggtggtatttttctcgcctatacttatattccagatgtcatatgggaactccctgttaggatctatataaaattaattcaaaccccattctccaacggtgggatgatgaatgtcctccccacgtttctgctaattctccggagcttcacattctccacccctgagtctttgcttcagctagagagacattcaatttgggggatccacttcctgtctgtttccccacttagcatgtatggactaattcagtccttttctctaatttccacgcaaacaaccacacacacacggcatttatatgtgagcctgtgagtgcgtggacagggtttttctgaaggtttggggacataggaggacttaaatcaacagacaggctaactactcaagactagaggttaagtattcttctctggaagatcctttggcttctcttcaactcagcatccagccgcctttttttttttttttttttttttttgagacggagtcttgctctgtcgcccaggctggagtgtagtggtgcgatctcggctcactgcaacctctgcctcccgagttcaaacgattctcttgcctcagcctcctgagtaactgggactacagatgcctgccaccacgtctggctaattttttgtatttttagtagagacagggtttcaccgtgttagccaggatggtctcgatctcctgacctcgtgatccgcctgcctcggcctcccaaagtgctgggattacaggcattagccaccgtgcccggcctaatttttgtatttttaatagagacggggtttcgccatgttggccaggctggtatcgaactcctgacctcatgtgatccgcccgcctcagcctcccaaagcgctgggattacaggcgtgagtcactgcgcccggccaatatgaactcatattctatataggattctgggagtaatttttgtgttcatttgttttgtttttagagacagggtatccctctgtcacccaggctggggtgcaatggtgtcatcatagctcactgcagcttcaaactcctgggctgaagggatcctcctgcctcagcctcctgagtagctgggaatataggtgcatcaccacacctggctaatttttttttttttttatagaggcagggtatcactatgtggcccaggctggtctcaaactcctgggctcaggcgatcctcctgccttggcctcccaaagtgttgggattacaggcatgagccatcatgcccagcctaactttttaaaaaatacaccccataaggtcaggtgtgaaagctcatgcctgtaatcccagcattttgggaggctgaggcaggaggattgcttcagcccaggagtttgagaccagcctgggaaacagagtgagaccccatctctaaaaacaaacaaacaaacaaataaataaataaatatttaaaaaatatataaaatacaccccatacatccttacctgtcagagcataagcatttatctcataccacagaagagttacacagtattcctctgtgtggattcatttattcattcattcatttattctgcaaatatctatcaaccccgtcctacatgccaggaactatgccccagccacagatgagaataagaccaactgggaccctgggggtcttgcagtctcatggggaaggttgagattaatcaaacaaccacagaaataaatgtaaaatgacagcagttgtaaatgagagtgatagcagcatgtgccataacaaatgcatccatgagaactaactccacagccctgcccttcttcccaccaagtcttagaaatcagggcctaggctgggcacggtggctcatgcctataatcccagcaccttgggagaaacccactttgggaagccaaggtgggacgataacctgaggttgggagtttgagaccagcctgaccaacatggagaaaccccatctccactaaaagtacagaattagccaggcgtggtggcacatgcctgtaatcccagctactccggaggctgagacaggagaatcgtttgatccggggaggcggaggttgtggtgagcccagatcgcaccattgcactccagcctgggcagggcctaggccaagtgtggtggctcacgcctgtaatcccagcattttgggaggctgagttgggtggatcaactgaggtcaggagttcaagaccagcctggccaacatggtgaaaccccatctctactaaaaatacaaaattagccgtgtgtggtggtgcatgcctataatcccagctacttgggtggctgaggcaggagaatcccttgaacctgggaggtggaggttgcagtgagctgagatcacgcctctgcactccagcctgggggacaagagtgaaactcggtctcaagaaaaaaaaaataaataaataaataaatcagggcctagtgggagaacccaagcaagttatgtgtctgggtctgtgttttcccatctgaaaagaatggttatctccctacaggctcacacctgtagtcccagtactttgggtggccaaggcgggaagatcacttgagcccaggagttagagcccagcctgggcaacatggaaaaaccctgtctctacaaaaaatacaaaaattagccagatgtggtgatgtgtgcctttagtcccagctactgaggaggctgaggcaggaggttcggttgaaccgaagaggtcaaggctgcagtgagctatgatggtgccactgcattccagcttgggcaacatagtgagacctcgtctcaggaaaacaaaaaaaaagtgtccttagactagatagaacaatgcttggcacaatataactgatcattcacttgcattatttttttccctcaatcttcctctttatttgttttgagatggcatctctctctgtcacccaggctggagtgcagtggctcgattttggctcacagcaacctctgcctcccaggttcaagcaattctcctgcctcaacctcctgagtagctgggattacaggtgcctgccaccacacctggctaatttttgtattttcagtagagatggggtttcaccatgttggccagactggtctggaactcctgagctgacaggtgatccacctgccttggcttcccaaagtgctgggattacagccatgagctaccatggccagtctcaatcctcttttttaaaatgcaagagtaaatggactctttggagggctatggtgaggagtaaaggaataactatttcattaacagtcacagctggccaggtgcggttgctcacgcctgtaatctcagcactttgggaggctgagacaggtggaccacaaggacaggggttcgagatcagcctggccaacatggtggaaccccgtctctactaaaaatgcaaaaattagctgggcgtggtagtgggcacctataatcccagctacttgggaggctgaggcaggagaatcgcttgaacccaggagtcggatcttgcagtgagccgagactgtgccactgcactccagcctgggtgacagagtgagactctgtctcaaaaaaaaaaaaaaaaaaaaaaagaaagaaaaagtcacagttaacacttctccagcacctcctttgcatgaggtactatctaagctttccctatagtccctgctactggggaggctgagataggaggatcgcttgagcccaggatttctggtccagcctggacaacatagcaagaccctgtctcttaaacaacatacttttgcaacaactctgaagggagatactgctgccatgcccattttactgatgttgaaactgaggcactgagaagtgcaatgatttgctcaagagctcagggccagttaggatttggagcagttggaggttacaggtgaggaggttccaggcctggcggccagggcatctaggtgggactgaccctaccctccattccccctccccccaggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatggtgcggctgcacacagggatttccacagcggagagggggagggcgaggcccctgggttccggggaagaaagggacaaagacccggacaccagggtctgagggaggaaggggctaagggcctacattcccacatcacagacaagggtcctcagagggtactcatagcaggtgacttttgaccgcccctccctagatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccagggtatggggcagagagggaggcagagagggggagatggcaggggcggggacaaaggtaaagccgagcagagacaaggagatgtgggtcgagatgtggatagtggggaagagagcgggaaacacaggcgggtaaatggagaggagagagggactgaggggaggcgggcaggcgtcctgggcatctcgcgctgacccccgtcctgtccccggacccgcagggcatgtacagctgctgcagcgctgaggccgccccaccgcccgccaagcccccgccgccgccacagcccctgcccagccccgcgtaccccgcgccgcggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccgccctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgccgcgccgcgccgcccccgtgcccttacctcgatctcgagccgtcgccgtcggactcggaggactcggagagcctgggcggcgcgtcgctgggcggcctggagccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatcactgtgcagctccccggccccagcgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctcagtccaagcctaagctccgtatctgttagcccccctcaaattctctggaggaaacagaaacacaaaagtcccacaggggaagaggagacagaattagagagagaacagagactctgaaaggaggtgcctggggagacaaagaccaagaaagaggaggtgggaagagaccctgaaaagaaagtcgagagggtactggggcagataagagaccccaagagagtggtgagatagatcccggagacaaaacatattaagatcaaaggtatggttttatttcctatggctataggtaccaaggcttgctacattctcaatatcctgttcatgcaagctaggagagtgtctgacatatcccagccaatccgcattatcttgaatgctgttaatctcaccaatgagaatctatttctaacatttcattatgtcaattagccaaaccgctggtgctgatgggcgataaagagagacgaagcacttgtaatagctgcctccagagggtggactttctgattaagtgctcgctgaccagagctgaaatgtgaatgtctggttaggcaattgactgcccctagagggtagattaaaccgcctaacttacagataatatccatcctgtctacaagaaagcatttttgaaacaaatgaaagccatcacaacagagagaggaaaagaaaccggccttatgggtcctcggggagtagaaactcagtctccttgccagtgaaagagcaaatttgcatatatgaataattaattaagtggaaagaacgctctcggaatcaaactggaagatggggaaaacaagcctcccgtagaactacaactcccagaaggccttgccactaccgcgaggaacagcgcccaaagtcacgcgaagatgcagtttctccgtatccgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaagggg

SEQ ID NO: 17081 - DNA, 10550 bp, Human
tgacgtcaccaagaccattcactattcactcccagtttcccaccctccttccactgcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatggtatggtccagtctgcaccccctctaagtcttgggctaaccctcttatatgtgtctccccttggtgtctcagtgtgattcagtcccatcctccttcctgcgtctatatggtctagcctcgtgagctgtctctttttctctctttccctacatgtctatgtggtacagtccacctgccagccctaggccattgctagcccacgatttgtctttcctcttcactgctttgtaacttggtctataacccttgacccctgccttcctatggtccaattacctactgttctgtgcttcctattactgtgaatttccaaaatggtacaatttggatcctctctccctttccaagtcgtactaccttacgctgttccacaatctgatgctcccttcccccttactgagaatctacaaggtacaaccccttccctccacctctgcctccctgtggtttagcccaggaatctcacacacccccggcttcgcaacatggtacagtccacacccccccccccccatgaagaccttcaagtagttcagcctactgctgaatctggacgtcccgattcccccctcctattggcttcttgtggttcagcccagtgcttctcgacctagtacattctggttccccgctcgcagacttccgacggtagggcccagcgcggcgcagcccacgccccctgcacaccccccgccccttccatcctatactgacgccccctgccgttgttctctgtcttacagtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaaccaatcttcctctttctaaacctccgctctcggtattttggcttcctgcttctcaaaaccatctttaggaccgcggcccctttaagcggcgccccttttccccccatcacccccctcgccatcaggcagcacgagcagagccatgtgcttccccctcccgcctgcctcattggcccaaactgggtcacggtcccgccccccagtaccgcctcccattgggcaaatgtaggtcagtgtcccgcctcccaccgaaaggcaaggcaacttcacgcgctgagcccctcacgcgccctcctgggccctggcggacccagaggccccattggctgtgcgtctcaaggtgtcggagacgattggtccgtgtttgcagccggagggaggcacgcggctggggtgcatgcccatagaggctggcggggctggacgcgccgggcggggacccggaggaggggcgcgcgctgtggcgtcgggtgttttggtttggatttttttttccgcgaaagaagtttgctttggccacgcctcaaggcggccgcctcctcctgccccctcctccgcccctccgcgcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtgagttctaacccccatctcacccacttcggacaccctacccccttagggactcaggtgccgtggggtggggtcccatagaaacctgcgtgcggggagtccatcttcccaaccttaatctactcaattactcaggtgtttaggcccctagatcccttagcgcccaggacccaaaagcgccggctctgaagcccgtccaccctaaggacccaggcaccaacgtccccaacgtcctccccgcttagttcacaagagtgtaggccccagcctcctcttccttttggtccgggagtctggacccctggggtcccagggagggggtgtgtcgggtgctcacacggtggtgacacgggcttgggcggggcgtcatggggtcacatggagtctagggatgagggatgtgccccaggaatagagccccttcctgccccttacagatggtgggggaggggaagggggtacagcgcgcaggggatgggggttgggtaattacagtgaaattacagagctgtcattttttctctcacctgcccaaccctccacctaccctgtccctgcccccctattcctgaacttccgtctctctttctctggttcgctgtctttctgtgtgtctattccttcccggcattctgtccccatctctgtgaatctgtccacctgtctctgccacccccgtctccattctttctgggtctctctcccactctgcgtctccgtccctttttctcccgtctctcctctccgaccccccgtcccctctttctctggatctccgccctgtgcctctcggactcggggtctcttctccatctctatctcccccacctcaccctcatcccaacccgtctttcccggcccgcaggtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggtgcggcgaagggggcggggcgggtcctgacggggcggggcttggactcagggggcggggctgtgcgacgctgggggctgggaccgtgggacctggctgcggcctcgaattctgtgtccagttgtcgagaggtgtcgtgggagggggccagattcggtgtctcttaatgggtcagggaccaatggatccatgggggaggagagacttggaaccctaaattccaggaagcctgcccaatgagattttgtgggtttttctgtgggacttggggacaaacgatgtggatactcgtgaagccagaactggaagtccggaacaccagagttatttactggggagtggactgacccccgaatctgggcccataatcgatggaactgggataggactggagcccctaggtcctttacaggggcaaaggcaaaggagaggcacagaattctgtttacccaggacataagagactggcagcccaggtccctgggtcccccagtggggcgtgctgcagccccgggtcccagagttcttcagaagggaaaacgttagggatcttgtttctggatcctccaattggggctggggccaagcttcctatattcctaggagaggcctgggatcccagaatcgtggtagcccagtggcgggggttctgggaaggtccaggaggccgatgctccccggagagcagggggttgggaatctttggaggttgagtggaactaagtgactggaagagcaagaggaaagatgtttccctttgggcacattgaggtctccagggacggactgcaggtcggggattcctgggcacacctgctccaggtccgacctccgggccgaaccagggccctacccttcccagcggcacattcctgcgccacgtgagtcctcccatccctcctccgcgcttcgcgcaggcgccttcaagcgcgaggggggcggggccgggggaacgtgagggcgccgatggcgggggcctgggaggaagggaggaggagggaagcaggcgtcagcacgtgactcggccctgaacctgtgtccttagctggccccggctggctggtgcttaaaggtacaggcgcctcctttcgaaccaatcttctggaaccttagagcagcttctcctcctctttccagcgagtagctcttagactctaacttgagagcttttcagtgcagtagattctttttctctggacagtctggggtctaagcttaggtcgtggattcggtaagtaggattcaggctagactgtgcatctgaagtcctgaggttttagaagcaatagccccatcgcttctcggccttttggctaagatcaagtgtagaagcaatagccctgattcgtgtgttacctagggcaagtcagttatgactgggactcagtttccttgtttgtaaaggtggatatggctccatgatctctaagcatctttatggcttaggggaaccttcatttttctcgttattttggagacggagtctcgctctgttgtccgggctggagtgcagtggtatgatctcagctcactgcaacctccacctccagggtccgggttcaagcaattctccagcctcagcctccctagtagctgggcttaccggcacccgccactacacctgggcaattttcgtacttttagtaaagatgaggtttctccatgttggccatgctggtcttgaactcctgactaaaggtgattcgccgcctcggcttcccaaactgctggggttacaggcgtgagccactgcgcctggccaagggaaccttcatattttatattagggagattaatccctggccgaatttatgctagatcccagaaggactttccatgtggctatgataccacagcaaaaagtagcttcaggaaaccccctccttaaaatacacactcagctgacacgtgctgtttccccaaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggtgagcagagctggatgtgggagatagacttggctggagacatgccccacagccagggaggggccttttctcacagtcaagcctgggcttctccttgggattagtgctcagcctctcctggcctgcagccacagattagtcctccttggccacggggcacaagggggcaggggcctgaggtttatgaagacagtgtcaactgggcgaggggcctcactcgtgtaatcccagcattttagggggctgaggcaggaggatctcttgagctcgggagttcaagaccagcctgggcaacatggcaaaaccccatttctacaagccacttgggaggctgaggtgggaggactgcttgtgcctgggagattgaggctgcagtgagccaagattacaccactgcactccagcctgggcaacagagggagaccttgtcttaaaacaaaagacagtgtcactgtggggtgctgactcagccagctctgctaggtctacttgtagagacttggagcttctcctattacttgggtccagagctccaccaggcacacttgcaaaggacagtcttcctttggcaatgggatatcagcctgtggcctgtctctccttactcagcaggcctttgatctctgatgtgggacttcctttggagtgattgcatttggctaggatgaagactgtgccagcccctttaggccttgtttcctgggcctggacttctcactggtgggagacttcaggcttctgttagcagccagtgccactttctgatttggggtgatttgagcagtcattgcatctttgcatgattttgttttttgccattactggagtcttccctagcaagagttgcttgggcttctgttacaagactttgtcattccgggccaggcgcgttggctcacgcctgtaatcctagcactttaggaggctgaggtgggcggatcacttgaggtcaggagtttgagaccagcctggccaacatggtgaaacctcgcctctactaaaagtacaaaaatgttccgggtgtggtgtctcacacctgtaatcacagcactttgggaggccgaggcggacagatcacgagatcaggagaccatcctggccaacatggtgaaaccccgtctctacaaaaaaatacaaaaattagctgggcatggtggcactcatctgtagtcccagctacttgggaggctaatgtaggaaaatcgcttgaacccaggagacggaggttgcagtgagccgagatcgcgccactgcactccagcctgggcgacagagtgagaactccatctcaaaaaaaaaaaaaaagaacaaaaattagccggacatggtagcgggcacctataatcccagctacttgggaggctgaggcaggagaatcgcttgaacctgggaggtggaggttgcaatgagccgagatcatgccactgcattccagcctgaacgacagagcgagactccatctcaaaaacaaacaagactttgccatacccttgcgtaacacatagctacttgaagcacctaggactggcctggaagtcagatctacaccagtggtttctccttctagagggccctgttgctagggactggatttaccctcacaagcaggaactgggctttaattaaatagtggagtagagagcatctttctgagccccgtggtccttggttactaaggaggagtcttccttaggaaccaacttccaggatgggaggactttaggtataatcctctggggaggtctcaggatagtcccctttcctaagagacagctcttctctcagtcaggtcctactggggaggaggctattctctggcctcagttcaaggccagcaggtcagaggctggccacagtcattgaaaccacttagacctcacttttgtttgccaaggatggatgaggttgccttggcaaccaggtcagaaggccccagctctgcgaggattttatgggacaccaaaccccatcaccagggcaccaagctttccttagcaaccaggatctggaaaggcaatgtgcagggcagggcagtgctcttcattgggagaagccctcagaccatgaaggccttgttgctagggaacaagcatccttagcaagcaagagctaactgcatgcaggcctttatcatgtggggagggctggggtccgctttgcagagtggagacttgaagcgagttgcttgagggtggggggtctatctcatgcctttactgttgctaggggcccaatctccttagcaaccagggccctagaaaggcagacccttgggtacctatcccagcagagacctggtgtggtttaggccccgctgctggggctcccttcctctctcgctgggacctgggtccctctggacctcagtgctctccccctcttctcctgcaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaagcgagcctcccccctcccttgcgggggcggggagggttctctgtgtgtgtccccggcacgtcagggaccctatcctcccaccgcctccgttaacacgatcctgaataaatcttgagaaccccagagccagctgttgtggaagaagagggcagctccctggcatactggctgcagcccgtgggcagctccgggctgtcgtccatagagggcaggcgctgctggaagtgctggagtctgagtcctcccgcgggctgtcggatggaggaagggcagaaggtctgagaggaatgaagcgactgcctttattgcatagaccttttcaattgctttttagattggggacggaggacgcgcatgagacgaacaggggatatgaatttccccgcccccacccgcggggagaggaacattagtgcaaatcctagcgccggccccggggaacctgcccctcctgggctgattggccagctaaatggaggcaccggagtggatggggcgaggctgcgggccctgaccggccgactcactgaggcctaccccagccagtacattccaggtcctgtcattgggcgacgcgtaaaatagactccgccctcagccatcctggccgggtaggagcaggtggcaagcgtcaggactgagccctgccccgtaagggcggccccagatcagacgccaggccccgccctcattgatcaggcactaccctcgggacgagcccatttctctttaaccgtgacgacgcccaccttccagcatcacgtctggtcccatgaaagcgagcgcaatcctgagacggggccagggcccctgccaccacaactctagcagccaggccacaccccctagctcaggctccgccccattggaatgtaggccccgcccccggcgggtaccaagcttgtttagtttcagggctcccgccccgggcagccaggaggcccagtgagcagtgtaccgatgccagggtgcatctgtgcctgtagcggcccatactccacctgctccccgtccactgtgagcacgccgcgtggtgtgagcggctctaggcggaaggcacgggccgcggcgtagcccagctgcggacagcccaggctgaagtggctaccacgctccatggccaagaaaaggcgcagcagcgcagcccgcgagatgccgctacgcacccagcacaggtgcaccaggccgtcgtcgaagcgcgcatgcggagctgccaccaggtcagcgcctaggtggctgggcgagatggccaacatgagcacaaagtccccctccagcgtcacccagtctgggggcagcggggtgcccagcggaggcagcaggtggtcgggcgggccgcaggtggaggcccctacccgggcatcaggggtgggaagtgggagcccagaggatgggggaattacgggggccccttcggagacgggtgagtgtagagctgccttgggagagccaggaggtgaagacagcagtgggtccggggacagcggagcatccccagccccaccccagtccccagccagctctgggcccccaccgttgagggacaggatgggcaggggttctggcgagccaggagaggccagggcaggctggggcaggggaagaggcaggtcagacacagaacgatgcaggggtgagtgggccatgggcggggctgggtctggggttagggtcagctccgacttggcacgaggcaggctatgggcaggggtgggcgaggcaggttccacagtggcggggaggtaggagaggcgtccgcggtaggtgtgcagtgtggcgaggcccagcaccgtgcccagtgtgaagcgggcactgcccaaggccctgaagcgctcgctctggatatccacatctgacacgaagccccaggccacagacaggaaggagaaacagcgggagcccgaggccagcgtcacggagagcaggtccagtgggtggccaccaccccggcacagcaacagtgagcagttgagcaacaggtcgaggcccagggctggctcaaatcttcacagccggagatggacggacacacagaaggaaggagcaaacaggggttggggaaagagacaggtaggaaagcagctggcaatgagaccacgaaggccatggcccaggcccacca

SEQ ID NO: 17082 - DNA, 27909 bp, Human
ggctctgcgctcaggcccagagagtggcagggtcgggggacatttccaggagcgggaacagcagctccaggggcccagaggtaggactactgctcggtgcatttggaggtcttggctggactgtggcgttcatggggaaggagggactgagtctacagggctgagaggccaccacagcttgggttcaaatcccagctctgttcagctcttgtgtggccacagtcaaatcgcttccctccttgaagctccatgtcctctctgtagcaatggaagctacagcggagcccaattctaccccacccactgcacgacaattggtttgtttctatgtttgttactagagtcagggtctcactctgtcacccaggctggagtgcagtggcgcaatctcagctcactgcagcctcaaactcctggctcaattgatcctcccgcctcagactcccaagtagctgggactacacgtgtatgctaccacagtcggctaattttttatttttaaacagagacagtgttctcgctatgttgctcatgctggtctcgaactcctggcctcaagtaatcctcctgtcttggcctcccaaagtgctgggactacaggtgcaagccactgcgcccagcccttgaggagttttcaaagtatccacagcacccagggctgagaactgctacagcagctgaaagccataagtgtctttgactttccttttgtcctggtaaaccccttcattccttccttccttccttcctacactcattcaatcaaacactggttgaacaccaacaagtcccagcactgtgggctccaccctggcctctggggagtgggggagggacccccgatttggagattgtaggtgccaagaggaacgggcaagatgccctcctattcattcatttattccttcagggcctctccaagggcacagggtcttttcttgttggcatctgggttttcctctcctgtaagctgggaaggagatttctccctcaaggagctgttggccagatcaaagactaaaataatgctaaacagagcttccgtttcctgataaatgtatcaggagccaagcacttaaaatatattatcccgttgaatccccaagtaggattaaaacctcaaagcagagattgctcttatcctcacatgacagatgaggaaactgaggatcaaagaagtgaagtccgctgcccaaggcacagaaaggacaagtaggacctatggaagcccagccaaggcccagcaggcgctcagtggctaatcctcctgaaaactaattacctcactgcgcctgcccactggactaaatttgcctggtaaccgatgacatcatcactaattccgcgcccacgctcaacctatgggataactgatgacatcactgaacaaacaaagtaactgcagtttattgaaggcctactgtgtgcgcaaggctgtgctaggcaggcctcctctgagttcacataaggccccgtggtgcctgctactgcatgaaatagccataataattttaactcaaagttatggaatgcagactatgagctactctctgttttaaccttttttttttttttttttttttttttgagacagagtctcgctctgtcccctgggctggagtgcaatggcacagtctcggctcattgcaacctccacttcttggattcaagcaattatcctgcctcagcctcccgagtagctgggattgcaggtgcccaccaccacacctggctaatttttgtttttgtttttgagatgaagtctcactctgttgcccaagctggagtgcagtggcgcgatctcagctcactgaaacctccacctcctgacctcgtgatccacccgccttgacctcccaaagtgctgggacaacaggtgtgagccaccgcgcctgggatctttattaactttttaaaattaaaaatatatatatatatatatttatatatattttgagatggagtttcactcttgtcgcccaaactggagtgcaatggtgccgtgatctcggctcactgcaacctccgcctcctgggttcaaacgattctcctgcctcagcctccggagtaactgggagtacaggcatgcgccaccacgcctggctgatttttgtctttttagtaggggcggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccagcacccacctccctactctccctcatggcgtctcccccacctttccacagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggtacctgccgggctgcgggcgtcgggggctggggagagtggggagggggtgcggcagaggacaggaaaggcacatagagaaggaggggaggaggaaaagtggggccgggtctgttcagagcggtgcccctgccagaagtagcctcccagggatacccacccggtgcccagcctctcccctccaggtcagttctcaacacttcaccttccctgacctccctggctgaaatagcgtcctcgttctgttcctccctttcccctttaccctctacttctctttttttttttttttttttttttttttttgtagagatggggtctcgctacattgcccaggctggtcttgaactcctgatctcaagtgatccttctgccttggcctcccaaagtgctgggattacaggcgtgaaccaccacacctgaccatttttatttttatttttcgagacaaggtcttgctctgtcactcaggctggggtgcagtggtgcaatatcagctcatcaaacctcccaccttggcctcccaaagtgctgggactacaggtgctggtcaccaccaaattgtatactttttttttttttttttttttggaggtcttgctctgctgcccaggcttcagtgtgatggtacaatctcggctcatttcagccttgacctcctggactcacatgatccgcccaacctcagcctcctgagtagctggaaccacacgtgtgcaccaccatgcctggctaacttttgtgttttttgtagggacagggtttcatcatgttgcccaggctggtcttgaactcctgggctcaagcgatcttcctgcctcagcctcccaaagtgctgggattacaggcatgagccaccgcgcctggctaaattgtatactttaaagtggtgaattacacacaatttgagtgtttgagtttgagaccaacctgggcaaaatggcaaacccccctctatttttttttttttttttttttttttgtgacggagtctctctgtcgcccaggctggagtatagtggcatgatctcagctcactgtaacctctgcctcctgggttcaagcaattctctgcctcagcctcctgagtagctgggatcacaggtgcccgccaccatgcgcggctacttctttttattttattttattttatttttgtatttttagtagagacagggtttcaccatcttggccaggctggtcttgaactcctgacctcatgatccaccagccttggcctcccaaagtgttgggattacaggtgtgagccactgagccgtcttttttttttttttttttttttttttttttagagacagagtcttgctctgttgcccgggctggagtgcagtggcgtgatctcggctcactgcaatctctgcctcctgggttcaagcgattctcctgcctcagcctcctgagtagctgggattacaggcgtgtgccactacacccagctaatttttgtatttttagtagagatgaggtttcaccgtactggccaggatggtcttgatctcttgacctcttgatctgcccacctcggcctcccaaagtgctgcgattacaggtgtgagcccggtcaataagtagcatttaaatgaccaaagggaaataacaaaaactcttccttcccttttttctcctctcttccccacctcctccaacaagtatttattaaacacatattatgtgccaggcagtgttctaagtacaaagaaggctgcaactctccagacagactgaaatgtctccctttatggagctcacattgtactggggcaacccagaaaataaatcaacaaataaaaatatgacactatgattggtggcaataaatgctgtgaagaaaagtagagggtaggcggggcatagtggctcatgcctgtaatctcagcactttgggaggctgaagtaggaggatcacttgaggccaagagttcaagcccagcctgggcaacatagcaagaccccatctctaaaaaaaaaaaattagccaggcgtggtggtgtgcgcctgtagtcccagccacttgggaggctgaggcaggaggatcactttagctagagaggtcgaggctccagtgagctgcgatcacaccactgcacttcagcctgggcaacagagtgagaccctgtctcaacaaatagaaaaacgtacaattcaatgactttgccatgtgcgtggagctggtcatccatcaccacaatcaattttagaatattttcagccgagcacagtggctcacacccataatcccaacattttgggaggccgaggcaggaggatctcttgagcctaggcgttcgagagcagcctggccaacatggtgagacctcatctctacaaaacatacaaaaattagccaggcacgatagtgtatgcctgtagttccagctacttgggaggctgagatgcgaggattgcttcagtctgggaggtggaggttgcagtgagacgcgttcaccccaccgcactccagcttgggtggcagagactgtctcaaaaacaaaaaactgagtgggccaggcacggtggctcatgcctgcaatcccagcagtttgggaggctgaggcgggtggatcatttgaggtcaggagttcgagaccagtctggccaacatggtgaaaccccgtgtctactaaaaatgcaaaaactatccaggcgtggtggtgcgtgcctgtaatcccagtattcggcaggctgaggcaggagaattgcttggaaccggggggtagaggttgcagtgagccaagagtgcaccactgaactccagccttggcgatagggcaagaccctgtctcaaaaaccaaaaacaaataaaaataaaaataaagaacattatcatcatccaacaagaaactctggacctataagccatcacctcccaatcctcatatcccctcccccctgggccctggtaaccaccaatctccgttctgtttctatggatttttctattttgggcatttcatggaaatggaatctacactatgtggcctcttgtgtctggtttcttcctgagcatcacgttgtcaaggttcaaccacattgtagcatgtgtcagagtctcattcatttttatggtccaataatattttatgttatgtataaactatattttatttattcatcagttgataagcatttggattatttccactctggggcttattatgaatgaagctgctacgaacattgcatgcaagttctttttttttttttttttgagacggagtctcgctctgtcgcccaggctggagtgcagtggagtgaccttggctcactgcaaactccgcctcccgagttcacgccattctcttgcctcagcctcccaattagctgggactacaggcgcccaccaccatacccagctaattttttgtatttttagtagagacggggtttcaccgtgttagccaggatgctctccatctcctgacctcatgatccacccgtcttggcctcccaaagtgctgggattacaggcacgagccaccgcgcccggcctttttcttttcttttctttctttctttctttctttttttttttttttttttttgagacgaagtctcgctcttgtcccccaggctggaatgcaatggcgcagtctcggctcactgcaacctctgcctcctaggttcaagcgattctcctgcctcagcctcctgagtagttggaattacaggcacctgccaccacgcccagctaatttttgtatttttagtagagacggggtttcaccatgttggccaggctggtctcgaactcctgacctcaggtgatccacctgcctcagcttcccgaagtgctgggattacaggcgtgagccactgctctcggccttgcatgcaagttcttgtttctatttttattttttgaggcagggtctcgatctttcgctcaggctggagtgcagtggtgcagtctcagctcactgcagccttgacctcctgggctcaagctatcctcccacctgagcctcctgagtagctgggacgacaagtgcacaccaccacgcccagctaattaaaaaaactttttttttttttcacagacgagatctcactgtgttgcccagactggtttcaaactcccgagctcaagcaattctccctccttggcctcccaaagtgttaggattataggagtgagcctctgcactgggccctgcacacaagttcttacgtggacatatgttttctttgttttttatggagacaggttctcactgttgcccaggctggagtgcagtggcgagatctctgttcactgcaacctctgcctccacaggttcaaacaattctcctgcctcagcctccggagtagctgggaccacagacatgcaccaccacgcccagctaatttttgtatttttagtagagacggggtttcaccatgttggccaggctggtttcaaactcctcacctcagtcaatctacccacctcagcctcccaaagtgctgggattataggcgtgagccaccgtgccagcccgaagtggctttatcttttttcattcttcccagcaatagatgatcctctattgccccacatcttctccagtgattagcatcaacagagatttacttattggagacaaggtcttgctcggttgcccaggctgaagtgtagtgggaagatcatggctcactgcaacctcgaactcctgggcacaagtgatgctcccaccccagcctccctaatagccaccacacccagctaatttttgtagcgataagggtctctggttggtctcgaatgcctgggctcaagcgatcttcctgcctcagcctcccaaagtgctgggattacaggcatgagccactgtgcctggccagtttttttctaaagctattttgataggtgcctactggtgtttcactgtagtattaatttgcatttccctaacagctaatggtgtttgagcatcttttcatgtgctcattagccatcatatatattccttttttttttttttttttttttttgagatggagtttcactcttatttcccaggctggagtgcaatggcgcgatctcagctcactgtaacctccacctcccaggttcaagtgattctcctgcctcagcctccctagtagctgggattacaggcatgtgccaccatgcctggtttttgcatttttttttttttttagtagatcgggggtttctccatgttggtcaggctggtctcgaactcccaatctcaggtgatccgcccaactcggcctcccaaagtgctgggattacaggcatgagccaccgcacccggccatatattcctttttgtttgttctattacttgccactgacttgaagctcacaaatatattatttggtaaagtgttgaaatatttttcctcttttgaattggattgttttcttatcattgagatttgagagttttttttttttttttttgagacagagtctcgctctgtcacctaggctggagtgcagtggcgcgatctcagctgcctcccaggttcacgccattctcctgcctcagcctcccgagtagctgggactacaggcgcccaccaccacgcccggctaattttttgtatttttagtagagacggggtttcaccgtgttagccaggatggtctcgatctcctgaccttgtgatccacccgcctcggcctcccaaagtgctgggattacaggcgtgagccaccgtgcccggccgagagttctttatatgatgtgagtacagatccttgatcagatacttgttttgcaaatattttctcccaatctatggcttgtcttttcattttcatatcagcgtcttctcagagtatgttttattattattattatattattattattattattattattattagagatgaagtctcgctctgtcgcccaggctggagtgtagtggtgccatcttggcttactgcaacctccgcctcctgggttcaagcgattctcctgcctcaacctcccgagtagctgggattacaggtgcccgccaccatgcctggctaatttttgaattattagtagagacggggttttgccatgtgggccaggctggtctcgaacccctgacctcaggagatccacctgcctcggcctcccaaagtgcagggattacaggcgtgagccactgtgaccagccttgattttgcttatgtttttctttctccttataccttgacattgtcccatcttggaactttaaacaaataagtttctggtttttttaaatagttccgtggtatttcataacataggatatacaataattcttgcttaaccagtttcctagtgactgatattaatgttcaatcttttgcctatgtatatacaatgtaaactttaaacacaatgccttgtacatgcagtacttggcattgaacacacttacctctaggacaaatatctggacaaagaattgcttggtcagagtctgtacatttgtaattttgatatgtaatggctacatttccctctatagaaattgtggaagcttgttctctgagccgggggtgtggttaacacctgaaatcccagcactttgggaggtcgaggcaggcggatcacttgaggccagcaataggagaccagactggcctacatgaccccatatctactaaaaatacaaaaattagctgggcatggtggtgcgcgcctgtggtcccaactactcggaaggctgaggcatgagaattgcttgaactggggaggcagaggttgtagtgagccaagatcgtaccaatgcactccagtctgggcaacagagcgagaccctgtctcaaaataaaatgaaaaaagaattatttgcagtcaggcacggtggctcatgcctgtaatcccagcacttgggaggccaaggcaagtggatagcttaagcccaggagttcaagaccagcctgggcaacatggcaaaatcctatctctacaaaaaaaaaaaattagccaggcgtggtcgtgcatgcctgtagtcccagctacttgggaggctgaggcaggagaatcgcttgaaccctggaggtggaggttgcagtgagccgagatcactccattgcactccagcctaggcaacaagagcaaaactctgtctcaaaaataaaaaataaaagaaaaaacagaagaaaataccaagtgtggcaaggatgttgagaaaatggggcccttgtgcactgttggtgagcatgtagaatggtacagctgctatggaaaacagtttggcagttcctcaaaaaattaaagatagaattaccatattaactcagcagttccacttccaggaatatgcccaaaagaactaaatactaggtgggggcactctgacagatatttgtacaccaatgttcatagccacattatttgcaatgaccaaaagctgaaactatccaaatatctgccgttcatgaatgaatggataaacaaattatgctatattcatacaatggaatattattcagctgtaaaaaggaaggaaattcgtccgggtgcagtggctcatgcctgtaatcccagcactctgggaggccgaggcgggcggatcacctgaggtcaggagttcaagaccagcctggccaaaatggccaaaccccgtctctactaaaaatacaaaaattagccgggcctggtggtgcgcgcctgtagtcccagctgcttgggaagctgaggcatgagaatggctggaacccaggaggcggaggttgcagtgagtggagattgcgccactgcactccagcctgggcgacagagccagactgtctcaaacaaacaaacaaaaggccaggcacagtggcttacgcctgtaatcccagcactttgggaggctgaggcaggcagatcacgaggtgaagagattgagatcatcctgaccaacatggtgaaaccctgtctctactaaaaatacaaaaattagctgggcatgctggcgtgcgcctgtagtcacagctattcgggaagctgaggcaggagaatcacttgaacccgggaggtggaggttgcagtgagctgagatcgcgccactgcactccagcctggaaacacagcaagactccgtctcaaacaaacaaaaaacaccacacacaggaatagctaaaatagggtgcagccacttcctctagggctgaagccaaactcccaagaaagaaagaaattgggaagaaggacttccctgcccaaccggctccccacacaagattagagtttcgctgcagaggtatggtcatgacccactgggtgactgagaagttcactgaagtgcaacaggccactgaaatttgctagggggaggggtaaacgtcactgcgtgtctagtgcagggctggcccctgtccatcacaagatcccgctaagaggagcccgtgagaatcaggaagagccccatcctcattcagtgttcctccagcgccctctgctgacaaggtttaacactgagctagctggcagaggagaaatgtttacagggtccagctccaatatcacaaaaacggcagagaggcatgaagttggagccaccagcctgtaaactgataactggtacaaggtggttgttagaatgaaatccagtgaatggattggatgtggtggcttacgcctgtaatcccagcactttgggaggccaaggcaggaggatcgctagaggccaggagctccagaccagcctgggcaacacagtgagaccccatctctacaaaaattttaaaaattaggtgggcgcaggctgggcatggtggctcatgcctataatcccagcactttgggaggccaaggcaggtggatcacctgaggtcaggagtttgagaccaacctggccaacatggcaaaaccccatctctactaaaaatacaaaaactagccaggcgtggtggcacacttctagtcccagctacttgggaggctgaggcaggagaattgcttgaatccaggaggcagaggtttcagtgagccgagatagagccactgcactccagcctgggcaacagagtgagactccttctcaaaaaaaaaaaaaaaaaaaaaaaagctgggtacatgtggtctagctactccagaggctgaggtgggaggatcacttgagcctgggagttggaggctgaagctgaagtaagctgtgactgcaacagtgcacaccagcccaggtcacagagcggaatcctgtctcaaaaagaattaaatgcaatgaatactaacagaaagtaattttgaacgtaattgtttctcttctgaacagcctgtggtctcctgaaattcaaaactgtgaattgggtccttgatgaggtccctttccactaggtaacattctgtggctccccacagaaataaagaggtgaacctcagccgggcgcagtggcttactcctgtaatcccagcactttgggaggctgaggcaggtggatcactggaggtcaagagttcgagaccagcctggctaacatggtgaaatcccatctctactaaaaataccaaaaattagccaggcgtggtggtgcatgcctgtaaccccagctactagggaggctgaggcaggagaatcacttgaaaccgggaggcggaggttgcagtgagccaagatcgcgccattgcactccagcttgggcaacaagagcaaaactccgtctcaaaaagaaaaaaagtgggggtaggggggagggatagcattaggagatatacctaatgttaaatgatgagttaatgggtgcagcacaccaacatggcacatgtatacatatgtaactaacctgcacgttgtgcacatgtaccctaaaacttaaagtataataaaaaaaggggtgaccctcaaaagtgggcagtgaaaagtgaaaagagcagagatttttatgtccagacacctgggttcaattccagctttctccatgtattaaaggagtgcctgctgggcatgatgcctctgctcccagcaccttgggaggctgaggcaggaggattgcttgagcccaggagttcaagaccagcctgggcaacatagtgggaccgtatgtcttctaaaaataaaaataagaaattagccaggtgtggttgtgtgcacctgtggtctcagctactcgggaggctgaggcaggaggatctcttaagcccgggatttcaaggctgcagtgagctgtgatcacaccactgcactccagcctgggtgacagagcaagattctgtccccaaaaaaataaataagtaaagcaattctggctgtactaatagatcagcctcagaatttcagcggctgaagccaagtttgtttctttttcctataaactgtagttggtgcaggaagggtggaaggaagttggtggggggatatccatgcattcccagacatttggttccttccatcttatggctctgccatccccgggagtcccagattctcccctggagtctctgtatccagaagcagagagggagtggagagtcacgtggcgtgcgtttatgggccaggcctggaaatagccgcacatcacatcgccgccacctacacttccttggccagacccagtctcttggccccacacatagcagcaggggagaagagaaaaggtcatcacgccatattcccagcagaaaaatgaaatggggttgggtggacagctcaccagtctctgccctgcaccactttcctagctttgtccccttggacgagcgacatggtttctgtaaggctcagtttctggctccgaaaatgaggttaagcaaccttgccttctctgccagctgtaaggaatcagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggttgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggttgggaggaggggtgtgtgtcagttgggaggggctgcatgggtgtatggggtaatggggggacggagcataactcattgattcattcagcacctatttgttaaacacctactatgtgcctgactctgatctagcacagtggtcaatatacacacagaaatgcctgccctttggcagggagtgatggctcatgcctgtagtcccagcactttgggaggctgaggcgggaggatcactttgggccaggagtttgagaccagcttgggcaacatagtcagaccacatcattacaagaaattttaaaaatcagtcagacgtggtggcacacacttgtagtcccagctacttggaatgctgaggtgggaggatcacttgagcccagcaggtcaaggctgcactgagctgaaatcaccttactgcactccatcctaggcaacagggcaagactgtctcaaaaaaaaaaaaaaaaaaaaaaaaaaaaagccggtgctggcatggtggctcacgcctgtaatcccagcactttgggaggcagaggcaggcagatcacttgaggccaggagttcaataccagcctggccaacatggtgaaaccatgtctctactaaaaatacaaaaattagtcggatctggtggtgggtgcctgtaatcccagctactcaggaggctaaggcaggagaattgctggaacctgggaggtggaggttgcagtgagctgagatggcaccactgcactccagcctgggagacagaccaagatttcatctcaaaaaaaaaaaaaaaaattacagccaggcgcagtggctcacgtttgtactcccagcactttgggaagccaaggtgggcagatcacctgaggtcaggagtttgagaccatcctgaccaacatggagaaaacctgtctctactaaaaatacaaagttagctgggcgtggtggcacatgcctgtaatcccagctacttgggaggctgaggcaggagaatcgcttgaacccaggaggcggaggttgtggtgagccgagatcgcgccattgcactccagcctgggcaacaaaagcaaaactccgtctcaaaaaaaaaacccccatatattatactacatattataataatttaatagtattacaatatactttaattatatttaatatttatatgtttaacatataataacataatacaatataatataatacataaaatgtctgatgggataaatttacattggggggagagggctggagatagagttagaggtgggtgtggggctgcaattataaataaggaggtcaagggggcccccagtgagtaaaaacccgggaggtgatggtgggagccacagaggtttctagaggaagagcatttcaggcaagagggaaaagcaggtgcaaaggccctgaggtgggtgtatctgaggtgcaagagggaggtcggtgtggccggagccaagtgagcaagtggggaaaggagtggagatgaggtccgggtggggaggcaacaggggccaaaatgtgcagggccgcgtgggcccggtgcggacttgagctctgaccgagtgacgaggcagcgcggcagggatcgcagcagaggaggagcccgagcgggcttaggcttcaccggcgccctctggcggtcagatggggaccgactgtcgagagagcagaagccgggaagcccgagaggcggcgctggccggggtccaggggaggggacggtggctggactagggtggtggtcacggaggtattttgaaggtgagaccgggaggatttgctgacagactggatgtgggtgtgagagaaggggatgagtcaagggtgactccaaggtttcggcggaagcaactgtcagggtggggcaactgggaaggggaggagggaggggagcaggcgggggaggaagacacgggctctgcggcggcccatcccacgtccagcagaggctgccggtgggcacagaaatgcacccatcgggatctgaggggagagacttgggctgacacgtccatttgcaattccttggcacatatattctgtaattaatcgaagctccaggactgggtgatatcgccaaggaattgagcgtggacagagcagagagggggggctgcaatcaggaagtccccaagaccaccctcaggctcaacgacttagcaaaactcatagtgttcagcaaagctgctggactcccgggttatagtcaattacaatgaaagcaaacgtgaaaatcaggcaagggggccgggcgcggtggctcacgcctgaaatcccagcactttcagaggccaaggtgagcagttgattgagcccaggagttcaagaccagctgggcaacttagaaacacccatctctacaaaaaagtttaaaaattcgtcacgtgtagtggcatacacctgtagtcccagctacttgggaggctgaggtaggaagatcacttgagcctgggagtttcaggctgcagtgagccatgattgtgccacaggcactccagcctcaaggacagaacaagaccttgtttcttttcttttttctttttctttcttttttctttttttgagacagagtttccctcttgttgcccaggctggagtgcaatggcacgatcttggctcactgcaacctctgcccctctgcctccagggttcaagcgattctcttgcctcagcctcccaaatagctgggattacaggcgcccaccaccatgcccagctaattttttgtattttcagtagagacggggtttcaccatgttgaccaggctggtctcgaacacctgacctcaggtgatccacccgccttagcctcccaaagtgttgggattacaggtgtgagccacagtgcctggccgacaagaccttgtttctaaaaaataagactaggctgggcatggtggctcatgcctgtaatcccagcacttggggaggccgaagcagatggatcacttgaggccgggagtttgagaccagcctggccaacatggtgaaaacccgtctctactaaaaatacaaaaattagccaggcatggtggcacccacctgtagtcccagctactcgggaggctgaggcaggagaattgcttgaacctgggaggcagaggttgcagtgagctgagatcgtgccactgcactccagcctgggagacacagcgagacttcgtctaaaacaaaacaaaacaaaacaaaaaaatccaagggattaggaaatacctctcaggacctaggggcaagggccaggcctttctctgggcagaaaggaatcctctacagcacaggaatcaggaaggagccctggaaagcaccaatgttattacaagacctcacaccagcagccacgtttctctaagtctgttttcatttagtttttggtggatctgggggtgttttgttttgttttttggtttatttgtttttgaggcagggtctcgttctgtcatgtaggctggagtgcagtggtgtgatcacagctcactgcagcctcgacctcccgggctcaagtgatcctcctgccttagcctcccgagtagctgggaccacgggcacgcaccaccacatcagctaatttttgtattctttgtagaatgggggtctcattatgttgtccaggctggtctcaaactcctgggttcaagttatcctcctgtctcgtcctcccaaagtgctgggattacagacatgagccaccgcagctggccaagtgttctttctcagcctccctccctttatgcctttgtcattccctcaagcaatttccagaacctcctgtgtgtggggctctgggctaaggctctaggaacgtgtaagaccttgcctgtcctcaaggggttcctcaatctgtgagtaaccaacatggtaaaaccccatctctactaaacatacaaaaattatcctgatgtggtggcacgctcctgtagtcccagctactcaggaggctgacacaggagaatcgcctgaacccaggaggcagaggttgcaatgagctgagatggcgccactgcactccagcctgggcgaaacagagtcagactccatcgcaaaaaaaaaagagtctgccctgagtccttcctgcttcagggtcagaagagaggggtctccagggcaggaggcctcaggggctggggtcttgcctgtgtctgacgccttctcccctctcctcaccatccgcacacaggtgatctacatgggccgcaacccccgggacgttgtggtctccctctatcattactccaagatcgccgggcagttaaaggacccgggcacacccgaccagttcctgagggacttcctcaaaggcgaaggtggggacagggtaaagcggggcaggaggggtggggaggagccccagaggaccctgatgggcagagggacagaggaggggtaagaaagggagagagacagagacacagggcatcaaaaggggcaatagagacagagagcaggtggccaggagaagaagagacggagggagagaggctgagagaccgaaagacacaggacaggcaaaggacagaggagacagagacagggagagacacagatacaaaaagactgagagagagggcaacaaaagagacaggggcccggcacggtggctcatgcgtgtaatcccagcactttgggaggctgaggcaggcggatcacaaggtcaggagattgagaccatcctggctaacatggtgaaaccccgtctctactaaaaatacaaaaaattagccgggtgtggtggcggtgcctgtagtcccagctacttgggaggctgagacaggagaatggcttgaacttgggaggtggagcttgcagtgagccaagatcgtgccactgcactccagcctgggcgacagagtgagactccgtctcaaaaaaaataaaaaataaaaagagataaggaaataaatgcagaaagagagatggagtcagagagagacagggagagacaaggaaacaggaggagacaggcccctggtactaagaaaggcagcgccctttggccacgtgttcctttctctgctgctgtcagagaccctggctttggagggaaatccaggtgtgtggaggcggactggatggacagatagacaaaggccccccaagatgggcaaccaggggagaagcaggttggaagagccccagaacttggtggaaatgtgggggctctgggggagggcatccagctctgggggctggacctgggggtttgtggggcacagctagttagacccatgagccccagtggggctgggggaaccccgccactcagccctcaccccacttgtccctctgcccacagtgcagtttggctcctggttcgaccacattaagggctggcttcggatgaagggcaaagacaacttcctatttatcacctacgaggagctgcagcaggtgagtccccacctcctccaggtgcagcgtcccccccataccctctgctcacaccccacactctccccttcccgagggtctcaggacccctccgcttccccatgcaatgcgccagcccctggggatactgcaggaacagaacagaggccctgagcctgtgagcaagaccacagacaaaatccctaaaccacacagcaggctggcggggcagaggagctaaggagcaaaggcgagtgggaaggaagataaggaatggtcaggggcgagatttaacccaggagggttggccggacacagtggtagtggctcacacctgtaatcctaatgctttgggagcctgaggcgggaggaccccttgagcccaagaggtcaaggccacaatgagctatgatggtgccactgtactccggcctgggcagcagagcaaaaccctgtctcaaaagagagagagaaggccaggtgtggtggttcacacctgtaatcccagcactttgggagcccaaggcaggtggatcacttcaggtcaggagttcaagaccagcctggccaacatggtgaaaccccatctctactaaaaatacaaaaattagccgggcacagtggcacatgcctgtagtcccagctgctcaggaggctaaggcaggagaatggcttgaacctgggaggtggaggttgcagtgggctgagatcacaccactgcactccagcctgggcgacagagcaagaccttgttccaaaaaatagaaagaaaaaagattgaaccacatgaaatgcctgtattcaaccagtttttatttatttttatttattttatttaattaatttatttatttttgagacagagtttcgctcttgtggcccaggatggagtgcaatggcatgatctcggctcaccgcaacctccaactcccacgttcaagcaattctcctgcctcagcctcccaagcagctgggattacaggcatgcgccaccacgcccggctaattttgcatttttagtagagacggggtttctccatgttggtcaggctggtcttgaactcctgacctcaggtgatccacccacctcggcctcccaaagtttttatatttggaccagttatatatttatataactggtcggccccgccaactagtttttattttaagatggtaattttggctgggcacggtggctcacgcctgtaatcccaacactttgggaggccgaggtaggcagatcacctgagctcaggagttccagaccagccttgccaacatggtgaaaccccgtctctgctaaaaatacaaaaaaattaggcggccatggtggcgggcgcctgtagccccagctactcgggaggctgaggcaggagaatcgcttgaacctgggagctggaggttgcggtgagccaagatcgcaccattgcactccagctgggttatagagcaagactctgtctccagaaaaacaaaaacaaaaacaaaaaggtaattttatatggttttcccaaatgttgttattatccctattttatcgacgaggaaactggaggtttgtaacttaagagagggttgataatttgcccagggcacatggctcttgcctgcagactccatgtttattttttcccaacctggtaactttcttttaatggaaagctccagaagaggtgtcggtgctactcctccccctcttttccagcaagcattcttctccaaacccagaactgggccacagagcctaacagcttctgggctgcccctgggtgtgaggcgccgcccacatgttagaatttctgggacacgtcagtggttcaagaaggtaaagagatggaaggttatgaaaccaggagtgacctggaaaatcggagccatggggttggcggagctgaccagagggctgaccatgctgggtgctgcatatcagaaggtagtgatggccgggcatggtggctcatgcctgtaatcccagcactttgggaggccgaggcaggcagatcacttgaggtcaggagttcgagatcagcctggccaacgtggtgaaatcctgtctctattaaaaatacaaaaattagccaggcatggtggtgcatgcctataatcccagctactttggaggctgaggcaggagaatcactggaacccaggaggtggaggttgcagtaagctgagatagcaccactgcactccagcctgggtgacagagccaggcttagtctcattgtaatcccagcactttgggaggccgaagtgagcagatcacccgagggtgggagttcgagactaccctgaccaacatggagaaaccctgtctttactaaaaatacaaaattagccaggcgtggtggcacatgcctgtaatcccagctactcgggaagctgaggcaggagaatcgcttgaacccgggaggcagaggttgcggtgagacgagatcatgccattgcactccagcctggacaaaaagagtgaaactccgtctaaaaaaaaaaggcagaggggcacggggaggactaagggctccagggacctgagctcctctctggctgtgtggccttggacaagtgtctctccctctctgggcctctgtttaccaattgagataatgacacttcccttgcaaagctgatggtgggatcggcacaaatgtatggggggcttggatcagagcttggtacatagtagacactcggaaaggaaggtgatatttgagctgtagccgtggcaatgggcccttctggaagccccatgccaaggcccagagggaggaatgtgtagggaatggtgagtcccagaaggagagggtgggaaaggtattggaagagctgtgaccagaccacatctgttttttgggtttttttttgttgtttttttttttttttttgagatggagtctcactctgccacccaggctgtagtatagtggtgagatctcggctcactgcaacctccacctcccagttcaaacgattctcctgcctcagtctcccgagcacctgggattacaggtgcccgccaccacacccagctaatttttgtattgttagtagaaacagggttttaccatgttggccagactggtctcgaactcccgacacctgtctcagcctcccaaagtgctgggattacaggcatgagccactgcacctgccccacatctgtgcttgaaagccgggtctgggtctgggactgtgtcccagggcactcgggagccacggaagagttgggagccagtgaggagcagggtcagctggggtgtgggggatgagctggagggggatggagactggaggcaggaaggctgtggagcagccggctgctggggcatggatccaggaaggggaggatgaggcctaagcagttctaggctacagggacacagaggaggggatatggcaaggggaggcaggtggggagggacagggctcatgacggacaggttttgggggtgaggggtacccagagagggaggccaggctcctgggtggatggtggggccatcctgcaatgggggcctgggggaggagcaggtttgagatgtagaccagccaatgcctgtctctaacctgaaggagggtgattccaggtaaggtgatgcactgacctctgcccccggatgtgacctctgccccccactgtgacctctgcccccggctgtgacctctgcccccggctgtgacctctgccccctgctgtgacctctgccccaagcccacctattccctcccacctagagaaccctccaaagacagaaactgcaaaaacccttagaggcgatatagcccaacccctcagtttggagttggggaaactgaggcaaagaggcagcgtccctcaggcagccccaggttaggacccagacatgcggatcccaggttccacgctccttccttggccgagtgccctccctccgctgacccctctcccctgcctgcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggtgcgggggttctggggttcagagcccactaggccactgcccggctgtgtgacctgggagagttacttaacctctctgggcctcagtttctcacccagctgtaacattgggtgaacagggtcactgtggccccagggttgatcacgcacggggcttagcactgactcagcacacgtgccagccacccgaggcgtccccatccagagaactcccaacgacagcaaaacatccaggagtactgccaacgccaggtttacccgagagagatttagagtcttcatgagtcctcctcgacggccatgttcacggcagaaatactcaagccctgggttacggggcgcaggcggtagcatagttgtttcctcttcctgctgtaacaaaaacaccgcaaactccatgactcaaaacacgtttactcttttttttttttttttttgaaagagtctcgctctgtcgcccaggctggctggaggttgcagtggcgtgatctcggctcactgcgacctccacctcccaggttcaagcgattctccttcctcagcatccttaagtagctgagactacaggcacctgaaaccatgtcaggttaatttttgtatttttagtagagatggagtttcaccatgttggtcaggatggtctcaatctcctgaccttgtgatccacccgcctcggcctcccaaagtgctgggattacaggcgtgagccaccgcgcccggccttttcttttttcttttttttttttttttgagacggagtttcactcttgttgcccaggctggagtgcaatggcgcgatctcggctcactgcaacctccgcctcccaggttcaagcaattctcctgcctcagcctcccaagtagctgtgactataggcacccaccaccacgcctggctaattttttgtatttctagtagagacaggttttcaccgtgttagccaggatggtctcgatctcctgaccacccgcctcttcctcccaaagtgctgggattataggtgtgagccactgcgcccggccaagtgaagcatcttctaatctctgaccctcctcccttctatagggacccaggtgatgacactgagcccacccagatacttcagggtcctctccccatctccagatctttagcttaatcctatctgcaaaatcccttttgccacataaggtcacatattcacaggttccaaggattaggacgtggatatggagggagtctttattcagcccaccccagggaacccctccccacaacctcattaagggtgctgggtaacatggggcacgtgcacttgccaaaaggcaaactacggtcctctgaatgccatgagccccaggtttccaggtgaggggtgatgcccctgtgatagccccacaatgagaaaactgaggcttgggaggggtgccgtggctcacacctgtaatcccagcactttgggaggccgaggcaggtggaccacctgaggtcaggagtttgagaccagcctggccaacatggttaaacgccatctctactaaaaatataaaaattagccgggcgtggtggtgcgtgcctgtaatcccagttactcgggaggctgaggcaggagaatcgcttgaatcggaggttgcagtgagccgtgatcacaccactgcactccagcctgggcgacagagcgagactccatctcaaaaagaaaaaaaatggaaaactgaggcttggagggttcctgaggctcgcttgctgcgccaatcagcaaattgtttgcaagccctgagcacagagcctgcagaagggggtcccttccatgtccaagcagtaatggctgcagcatggagcgttgtgggggcattgagacaggaggccttgttctagcaggggaggtttgggactggtcgcagaggaggtgacacaagctgtaaggtgggcaggaattcagggttggaggcagaggttctgggcagagacttaaagggtccgggataaaggggaggactggcaggaatcctgcagtagcagaggcagtgagggcggaggtgagaacggcgccaggtgacaggccaagactctgccaccataggacacaaagggggcaatgtggagggtagggaggacggtgtttctggcaaagggaacacctcgccaaaggccgggaaggggaaggaggttgctggaatgttggaggtaggggcgcagtgctccccagaggctcctcaccccctggtgccccctcttctccaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtccaggttccttgatgcgctgtggcagggcaggcagcggggcgtggagaatcctcaccacaccaaggcttccagaggccggggtccccgactcagagtcccgcccagaggcaaaggtgctgcaggaacccagcgctgggcatctcacttcccggggtgggggcctgactccccagtctgagggaggagggggctgggggcctggactcctgggtctgagggaggaggggctgggagtctggactgccgggtctgagggaggagagggctgggggtctggactcccgggtttgaggaaggaggggctgggaggctgcactcccgggtctgagggaggagggtctggaggcttggacccctcagtctgagggaggaggggttgggggcctggactcccgggtctgagggagtagtatctgggggcctggagtctcgagtctgagggaggaggagctgggggcctggacccctgggtctgagggaggagggggctgggttgtggactcttggattcagagccagtctttagtaacgcacgtttttggcataaagtggttttattccgagcagaggtaaacgggagctccggcagacccgccctctcagcgcccacagaaagtcccaccacccaccctgttcccctgtggctgtaccacattccactccctcagtattcagctccttgcctcagtttccccacagctcctgaacacagtgtgcctggcagcgactccccatcttcccctccacagctctagcagctctagctcggggcctcacccgggcccctcatcaggaaggcctgaccctcgggagctgtgtgtgtcttctttaggatccgctgcctggggacgctgccagcccatcttctgggttgtgacactgaggtctggtgcaggcaatgggcttgcccaagtccttttttttgtttgagatgaaatctcgctctgtcacccaggctggagtgcagtggcgtgatctcagctcactgcaacctccgcctcccgggttcaagcaattctcccgtctcagcctcctaagtagctgggattacaggcgcccgccaccacacctggctaatttttgtatttagtagagatggggtttcaccatgttggtcaggttggtcttgaactcctgacctcaggtgatccacatgcctcagcctcccaaagtgctgggattacaggagtgagccacctcgatcagcctttctttttcttttttcttttttttttttttttaaagagatggcctctcactgtgttgcccaggctggagtgcaagggcatgatcttggctcactgctgcctccacctcctgagctcgagggatcctcccacctcagcctcctgcgtagctgggaccacaggcgtgcgccaccacacccaactaatttgtttttttaattgtagagatggggtctcactatgttgcccaggctggtctccaactcctggccttaagcaaccctcccaccttagcctcccaaagtgcagggattacaggcatgagccaccactcccggcccaagttgcagaacaagtgacaaacatcccttctgcttgacagacgccgaggccagaagccttgtccaaggcagggcattgaggcagagggctctgagccgacagttgtccggcactgctccttgggtgggccagcagatttggcttgggctcctgttcagggttgccccccaagtcctgcccggggggcccagtctgacggcctgacgcctctgggctcttgaagtttgaatgtagcatccccaccgaaccgccttcgggctggggacagatagcggaggcggtgggcggggggcaggggcagggcaccgccccacggaggtcgggagtccacttccccccaggggcctcctccagtgccccgctgcctcatcagagccttggctggagtgtccttggagccccaggatttcttgagctgtggagggaaagagagggaggtgagaggaggctggggtggggccctgggggcatc

SEQ ID NO: 17083 - DNA, 7927 bp, Human
aaaaatacaaaagtagctgggtgtggtggcgcatgcctgtaatcccagctacttgggaggttgaggcaggagaactgcttgaacccgggaggcggaggttgcagtgagccaagatcgtgccattgcactccagcctgggcaacaagagcgaaactccacctcaaaataaataaataaataaaaataaaaaaattagccagccatggtggaggctacttgggaagctgaggtgggaagatcactttagcccaggaggttgcagctgcagtaggctgtgattgtgccactgctttccagcctgggcaagagtgagaccctgttttttcttttttttttttgagacggagtctcactctgtcacccaggctggagtgcagcgcgatctcggctcactgcaacctctgcctcccgggttcaaatgattctcctgcctcagtctcccgagtagctgggattacaggtgcgcatcaccatgcctggctaatttttgtatttttagtagagatggggtttcaccatgttggccaggctgatctcgaactcctggcctcaggtgatccgcaggccttggcctcccagagtgctgggattacaagcttgagctaccacgcctggcctccaattttttttttttttttttaaagaaaagcttcagattttgtctttccacagtatgaggatcttggcttttagatggtcccttacctggtcctgctgctcctctgcttcaaggtgtccattcatctgctggtcctctgctctgttacatcaacgggaccctggccctgggtcttaagccatagtaggctggtaggagcaaggagtcaggtctcactgtcctggcctgaccttcagctctgtggaggagaggtaagtgaggagcagcattgacagccaactgcaggaggcccttccaggctcaatgtgcctgagaaccaagaggcaggggcctccctggcgggtggggggaagagtagataagtcattttaatcactgccccagccagtccatctggttgcacacaatatgtatgctataataggagtgaaggctaatttttattgagcacttattatgtgcaaaatattgacctcagcagttttattaactttcataatcctgaaaaacaccctgtgtgccaggcctgttgtcatcccctttttgtccataaggagagtaaggcccaaagaagttaagtgattttcccaagatcacagagaggttaaatgacttgcccaatcaccccattagtaactagcagagccaggatttgaatttggttatagccttgcaaggccccatctcaccatctttctttgccactacttctccctgggtctccatctcacccctctttctaggtctccttcctaccctttgggcctccattccccccacccccaagccacggagtctccattttgcctcccctatgaaactctgtctccctctttctaggtcagggaagggccatctaggggccgggggagaaggagaagcggaactcaaaggatgggaatacaggatgctatagattgaggtgcagcaagatcatctcgggttagaccttaagtaggacttcccaagcagcggctgcgcctacgaagtgcagcgcgagatcagggagcggtgaacctgataaggaaacgcccgaagcgtggggtcggaaatttccagatgccccgactagccctgccagccccgcctcctcacctccaacactgggcccgccgggtcctccgggagccactgagaggccgtcggcgtcgggccagagcgtcaccgcgcgacgcatcgtgctagctacacgcatctcgctcccagatccctttcttccggaaagctatcgagaacacggcctgggtagggccagagaggcccccgacgtgctggcccttccctcttggacgttgcgcttgttcctgcgctctatgctctctgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatcatggtgagctcgctttgcggcgttcggggctggataatccgctgccatccgccgtggttttgggctaggggcacgctggagggcggcagggggtctgcggctgcccggagggagcaattcccgatactggggacctactctgggggccaggagagcagggatgggtcagtcatagcctaccgcccccacttagtagatgaccaagtggaggtactcggaggctgatatgactgggtttacaaagccaggaagtggcagagccaggattccgacccaggtggctggacccgcagccactcttagttatttggctttgctgcctttatctggacctgtcactttctagtatgaaaagtcgggttcgatgggggccgcggcgggtgagaggatcgagagccgaataactggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctattaaatagttcttgtaattgtcaacacagtctgaaaaacttaagttgctcagaaaggcagcagggcggtaggagcctggcgaggcggctcacgcttgttatcctagcactttgggaggccgaggcgggaggattccttgcccaggagatcaagaccagcctggccaatattgtgagaccctgtctccactttaaaaacgatgttttaaaaagacactatttggtaagggttgttggattgactgatgctgtaggagaggtggttctagtagtattgctaggttctgaataaggattcgttttcatcattactgccattggtttgatatttttggttatccctccgggtatgggaaccagttttgataacattgttgcaaaatacaagttgtaaagaattgacctttttgtattaagttaatatgattgctgtgttacgatgtttcagggttctgtgtgccatgggctgaaggctttgtaaacagcccctttttacagagggatcagtggcagcccacaggtctcctggtggtgggcctgggatttgagctggtgtgttcagacctgggcttgtgtcccagctctcagtttcagaaataagtaataattggctatggttgggggtaattgggtccatggttgcctcttcacccccacagggagtggacatccgccataacaaggaccgaaaggttcggcgcaaggagcccaagagccaggatatctacctgaggctgttggtcaaggtgaggctgggccctgaggtctttgggaagggtcaccccaggtctgacttgcagatcctccattctagtgctggcaccaagctcctcccaggggcctgcagagcagtctcgggtctctggttctgttccagggtctcctgcatttgtattttcagcctctaggctgtgtacagctcgggagtggagccaggattttctaggtccttggccaggaaggacctgggccagctttctccctctaggtcggtgggttgggggaaagggataaagattcttttagtccagatcatcatgtgtttgccccttcactggaaggctgcgggggagcaggctgtcccagcttctcactgtcttcccgtccctccagttatacaggtttctggccagaagaaccaactccacattcaaccaggttgtgttgaagaggttgtttatgagtcgcaccaaccggccgcctctgtccctttcccggatggtgagtggctggtccagagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctccgggtagtaaacgatagtgttggttaccagggctctgctgcgccaaggcagtggagggtgagtcctggcagcccctgggtgaccacgcaggggtctgacccgccagccttgtcctctccaccaggtatgtgcactgcgcgtgaccagccgggcccgcagccgcatcctcagggcagggggcaagatcctcactttcgaccagctggccctggactcccctaagggctgtggcactgtcctgctctccggtgagtgatacgtggtcgacgggtttggactgagctgtgtggctactggcagccttcaccctcctggatctgggaggccagaagctgggcgccagatccctgtctcacccggttctccttccccttccctaggtcctcgcaagggccgagaggtgtaccggcatttcggcaaggccccaggaaccccgcacagccacaccaagtgagtatcaggcccccagccctgccctctccccagactcagcctgcagggccaggcctggccacacttgggctgcttctcctatccctcgtaccagccagccccaggccttctggaactctcagctgcctcatcctgcctgcttttcccttcaacactgcttggagctgtgttttccagggcctgagcaggcatctcctggggagcatgcagttcaccggcctttgccagcccaggctgggaccctccaggtggtggggcaggtgcttccatagcccctcctggctccttggcttcccactctgccaagcttttccagcagcattgactctcctggggctgaatgtgacaggcttgtggtgttcctgtgccactccacaatggcctcctttaagagggcccccctctcactccctcctctccccacagaccctacgtccgctccaagggccggaagttcgagcgtgccagaggccgacgggccagccgaggctacaaaaactaaccctggatcctactctcttattaaaaagatttttgctgacagtgctctgtgtgtgttattgggggatgggttggagaattggttcctgcgggtgagaatgcatttggtttggggacagggacgtcatgccagtgaagaccagccctcttcctgcccccactgccccggaagctccctgcctccttcccaacagccaggtggcaggtgttcccacaccggcttccttgggtcagccacgcccgcccctcttaaaggatcctgtgcccctccctggtgctgggatggcgggtggggcgtggaccgggaagtgcagggtgcaggctggcagggctgtggggagggagagactgcctgggaacaggtgaggcaatctcaaccccccggggaccgggaagcctgagtctagaggggcgttcaccccctgggagagcacaggtaaagaaagcgtgtgagccgcacccccggacctcctccaggggcctgtgggggccctcctgtgtttacacaaggggccgggctccctggattccaggtcgaggcctgatgagtgaggccagaagccgggaagcaccgcagaagtagaagccggggagccacagcctacgttctcggaaaaagcaggcactggaagggaggccattgagcccggcactagccggtgtgggtgagccccggcgatgggggggatgggtgagggtggggcggggaggctggcctgccttgactcctttcttctctttgcagctccctgctgtggtctggaggaagcagcggcctgggttggtgggattggaatgaagggcttctggtttgcagggatcaagggtccagggtccccgaggttgggtcaggagcctcaaggggataactgaggcttgggagggagacagggcgagatagagactggcccctgtccgggaagaagcgtccgggtagctggcaggagatagcatttaggcagaaaccaggctgggggcagcttgggtagggctccccgcagatcagaggacggcctggaacaggtcccagggccaggccccaggcaggggcagccagcctgaggagggtggctggttaggtggcactcacacctagatgggctgtgaagatcatagacctgtcccatagtaatggagacccctgtagcgcatttcaccctccactgcagcagctggaaggagtgtgaggagggtccagggagcagggtcccccattgacagggtagggaagggtttgccaagccttcggcctttaaggctgagcgagcaggcccagtggagaggcatcctggctggtctgcgggtgagagctgatgagcaggagaaactcgtgggggctgtcagatttggccagagacagatgctccaacaggcagatactgcgactgtcagtcggaagccattggcgtttgccagacagtggaaggagagggtcagttcgtcgtgctcttggccgggggcaggcaggcaacctgtcgtgcctttaaggacctttgggtgattagagacaggcaggcagcttgccacctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgtggcaggggctgctgcagggagccatttggacatctgcagggccccgccggaggcctcggatggccacgtagggtctgcctatcaggagaacccccagatgatcacagtccccagagacagccagacccccggggacccagcctctcacagtcagtcctcccacccgagtgaccccgatggcggcctcccagctggcggcgctggaaggagtggactcc

SEQ ID NO: 17084 - DNA, 11982 bp, Human
  misc_feature (1)...(11982): n = A,T,C or G
tctctgtgtctctctccacctgtactgatgtatgtgtgtctctttctatgtctctctgtctcgttaatgtttggtgtcaggctggacaaggtggctcacacctgtaatcccagcactttgggaggccaaggcaggaggatcccttgagcccaggggttccggaccagcctgggcatcatagcaagactacatctctacaaaaaataatttttaaaaattagcctggcatggtggcatgtgcctgtagtcccaactatttgggaggctgaggtggaaggagtgtttaagcccaggaggtcgaggctggatcaagccatgatcgcaccactgctctccagcctgggtgacattgcaaggcttgtctcaaaaaagaaaataaaagaagacaatgagcagtttcactaccattagacggggtgaaaaataataaataacaacaacaacagtaatatgtggtctctctgaggctgggtatggttgttcatgcctgtaatctcaatgctttgggaggccaaggtgggaggatcccttgaggacaggagtttgagactagcctgagcaacatagcatgaccccatctcttctccccaaatacaaaaatgtggtgtctctctctgtctttggatcgctctttctctctttttgtctctccccaccccatctgctgcttggtctctgagtttctgtctatctctaagtgtgtgtctctatgtctccatgtctgtctcgctgcgtctctgtatctccttttctgcctctatctgtatctctctcattcattccttcctctctccctccccctcctcctctccctacgtccctactgtccttcccaatttgctatctctgaatacctctgtctttctgattcctttgtagtctctcccatcatgtcagttggtctgcttctggtcctctctccctctatctgggtctctctatctctgtccatctgttcctctctgttgatgtctctttctctgcacgagtgtctctatttatagatgtgtgtgtgcctgttcccaggtctctgtctctagctctgtgtgtgtgtttctttctttctttctttttttttttttttttnnnnnnnnnnnnnnnnnnnncctccccctcctcctcactcctgcctggcggtttgttcttgcctctctaaccttctgtccctccgcccttcctctccgtatccatctcaggctcccttcccctccccagcctacgcagatgtgggtcctcacctcccgctctccgcctctgccctcccggctcctcctccccgcccctctctccctcgccaggtctctgcctccccctccaggcgagcagccctcactgcacttcaggctcctaggggatcccccggccccgttaaggcagccccaggcagagacccagtggagccctggggcggggaaggggggctgcgggcgctggggcggctccaacctgggtcccagcgagcagggggaccctgcatccgccaaggccggcggcccccagcatggagacttccgaagccactcccagctccaccttaagcgcccccccttccccttgctgcggaggatggaaacagcctgctcccggccccaggtgtcccggccacccccgcccgcgtggccccagcgcggctgggagccgaggaccagccccctacctccttccgaatcctgccctttcgcacatcccaccccaagccaacccgaggagtgtttgccgctatgagatcacctgctcccccagcccaacaacaaaattaaataacaccacgggagaggagagagggagggggaggagggaggaagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcaggtaagacctggggttcccgggaggagcccccgagggagggtggaggtggggatgccaaggagagggattcaggctgctctcttcccagctcacatcggaccagcacctgaccccgaggactggtggagctacaaggataatctccagggaaacttcgtgccaggtgccgccaaggcggggacccaggagtccggccctcccggcgcctccttcttcagactcaggaacctgggttcccagctccctcctcccccccaggaccaggagtcccagccccctcctctgtccctcaggagtcgggccagcttctgaaccccaggggctcaccatgggacattatacatgcgcatttcaagtagtgagtgggagtgagtggaaggaaagtgtgggggtggagattatgtgtgtgtttgccgggagaggaaggtcctggctcctgctaggaaccagaggctgggtggccccgtcccccaccttgtccagccttctcttgcagctcctctccccaacacattaataataatccagctgtgggataagagcgattaaaaaaaagaactacaactcccacggggctctggggcaggtaggcagcagaggggtaggctggtagcactggggcctgctgggagttgtagttccatctacagtggcttaagatgggtttgatcggctgggcgcggtggctcacgcttgaaatcccagcactttaggaggccgaggtgggtggattacctgtggtcaggagttcaagaccagcctggccaacttggtgaaacccgtctctgctaaacttggaaactattccaagattcttctaggacccagaattctggatctgagcccagtcctccctcagacccaggagtctaggtccctagcccctcctcccctgggatctgggagtccagaccacagcccactcagcagataccagccctgggatccagtctctatttctgactccttgtcctcctactccgaccccacccccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaaggtaaggggcttggagggaggagctattgaacccactggggatgggcatgaatagaggctggggaatggggtgctgaggtaggagagcagccttgggggaggaggggacacccagtgggtggagaggaggctgcttacactgtaaaatggatcacccattcttcccatcccaagcatggtcccctagtctccccatctctgcagaagcaatgaaaagcagaacatttcctgtgccaggcagatttaaaaccttgataagcctctcatctcataaccaccccacaaaatgggtacaattattattattgttattattattattattattttgagatggagttttgctcttgttgcccaggctggagtgcaatgatgtgatctcagctcactgcaacctccacctcccaggttcaagcgattctcctgccccagcctcccgagtagttgggattacaggcatgcgcaccatcacgcccagctaattttttgtatttttagcagagatgggttttctccattttggtcaggctggtcttgaactcctgacctcaggtgatccacctgcctcggcctcccaaagtgctaggattacaggcatgagccactgcgtccagccaaaatgggtacaattattaaccttattatatacatgcagaaactgacacacagaggttaagttacttgcctaggatcacacagagagccagcactggcattcaaaccaagcagcgtagcatgaatgctgggacctgctttatagtaccatgctgggaaccatactttttttttttttttttggaattgggatctcactctgtgacccaggctggagtgcagtggcccagtcatagctcactgtaacctcaaattcctgggcccaagtgatcttcctacctcagcctcaaaaatagctaggacatgcctgggtgtggtggttcatgcctgtaaccccagcacttcgggaggccgaggtgggtggatcacgaggttaggagttcgagatcagcctggccaacatggtgaaaccccatctctactaaaaatacaaaaattagccgggtgtggtggcatgtgcctgtaatcccagctacttgagaggctgaggcaggagaattgcttgaacccgggaggcggaggttgcagtgagctgacatcacgccactggactccagcctgggtgacagaacaagactccatctcagaaagaaataaatacagagagagagggagagaaaagaaagagagagagcgagaaagaaagagagaaagagagaaggaaggaaggaagggaaggaaggaaaggaaggaagaagccaggactgcaggcacatgccagtatgcttggctaactttttaagttttttgtagaggtggggtctcactatgttgtccaggctgatgtcgaactcctgggttcaagtgatcctccttgccttggcttcccaaggtactggaattacagctgtgatccaccgcgcctggccaataccatttcttataagagccggcactgcctttcatttagctgccccagccaaaagcctcaaagccattccccatcctatcctctctccctcatgtccatttccaatccatgttctttctagccttgctgctaaatattattcaaatcctttcacctatcacgccctctactgcccccagtctcatgtaggcaccatcatctcccacctggactggtggcgtaccctcctcactggcctgcctctcaacttcctgcaatctattcaccccacagctagagagatgtttaaaacacaaataagatcatatcactcctgctcaaaatcctcctattaggatatgtaataacagcaaacatttacatagcacttactatatgtttggcattctggcaaatgtgttatatatatgcagtttatttatttttattttattttattttttgagtcggagtctcgctctgtcgcccaggctggagtgtaatggaatgatctcagatcactgcaacctccgcctcctaggatcaagcgattctcctgcctcagcctcccaagtagctgggattacaggcgcccaccgccacacccagctggtttttgtatttttagtagagatggggtttcaccatgttggccaggctggtctcaaactcctgacctctggtgatctgcccacctcagcttcccgaagtgctgggattacaggcgtgagccaccacatccagcctatatatgcagtttatttaaataaaaatacaaaactctctactgttttccacaaggtcctgcaccattcagcccccataacctctctctcctctgttcactggactttgatgaagtctctttgctgttactcaaacaggccacctcagggcctttgcacttgctgttccctcttcttggaatgcccttctctttgttcttttgcaagtcacccctgcttatccttcaggtccccattaaaatgtcacctttggccaggtgcagtgcttcatgcgtgtaattccagtatttttcagaggctaaggcaggatgatgacttgagcccaggaatttaagaccagcctgggcaacatagggagaaccctctctaccaaaaaaaaaaaaaaaaaaaaaagaaaattgaaaattagttgggcatggtggtatgtgactgtggtcccagctacttgagaggctgaggcaggaggatcgtttgagcccaagagtttgaggctgcagtgagctgtgatggcaccactgcaatctagcctgggtgccagaatgagactttgtctcaaaataataaataaataaaaataaaatgtcacctttgcagggaagcttttcctgacatcccccatctaagctgagctccccatgacacctcagagctcccagttcccccaaacatgagctcaggatgtagttaattaagcagttacttatgtgattcacaattgtctgtcttgccttcattagaacataaactccataaggcccaggacttttgtctacttgtttattgctctattcttgcatccacggcacatagcaccagctcagtcaatatttgttaatcaaacaaattcaccaatattgggcaccaacttacaaactggcacagagcctggaaagtggtcagtgttcaaattatgttgaatgattaaattactgttggaggccaggcacggtggctcacgcctgtaaccccagcactttgggaggccaaggtgggcagaacacctgaggtcaggagtttgagaccagcctggccaacacagtgaaaccctgtctctactaaaaatacaaaaattggctgggtgtggtggcacacacctgtagtcccagctactcgggagcctgagggaggagaatcgcttgaacccaggagtcagaggttgcagtgaggcgagatctcaccactgcactccagcctcggcagcagagtgagattctatttaaaaaaaaaaaaaacaaaaacaaaaagccgggcgcggtggctcatgcctgtaatcccagcactttgggaggctgaggcgggcggatcacgaggtccggagatccagaccatcctggttaacacggtgaaaccccgtctctattaaaaatacaaaaaattagccgggtgtggtggcgggcgcctgtagtcccagccactctggaggctgaggcaggagaatggcgtgaacccgggaggcggagcttgcagtgagcggagctctcgccactgcactccaacccgggcgacagagcgagactccgtctccccccagaaaaaaaaaaaagaccgggtgcggtggctcacgcctgtaatcccagcactttgggaggctgaggcgggtggatcaccagaggtcgggagtttgagaccagcctgaccaacgtggagaaaccctgtctctactaaaaataaaaaattagccgggcatggtggcgcatgcctgtaatcccagctactcggaaggctgaggcaggagaatcgcttgaacccgggaggcggaggttgcggtgagccgagatcacgccactgcactccagcctgggcaacaagagcgagactccgtttcaaaaaaaaaaaaaaaaaaaaaaaagactgttggaatcagaaaatgtaggcgtgggaaacgagagataaaagatctctccctgccccctgacagctcccgcctctcccacagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtagtggccactgattgtttacccgccaccctccgccctgagtcaccccaattcctcccacctcaccctcttagtgtctcaccccatcctcctccacagaactggcctcccaccctaagcactaatcctcagcctgattcgggcccccaaagctggggtcatgctctcctccccttctgctgggggaccccatgctctgtgctacccccaggtgcagctcattcacttcaaccaggaactctacgggaatttcagcgctgcctcccgcggccccaatggcctggccattctcagcctctttgtcaacgtgagcggaggcgagattcggagggagggagcagttgggtgcctggaacccggggtctgagggaagcggggtgctgggaggcccagactcctgggtcctgggggaggagaaggttgagggcttggacttctgggctcctgtgtcctcacctcgtacccccacacaggttgccagtacctctaacccattcctcagtcgcctccttaaccgcgacaccatcactcgcatctcctacaagagtaagtccctggcgtgctgggggcagtggtcacacacgagggggttcaagagtgccatccctctttactctggcctgatattcccgcagatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcaggtgaccctctgtccgcaccgcccttcctaggcctgggtactccactcactggcctgggcatccccttgctcacctgccctccctctcctcatagactgaactcaagtaggtaagagggtcagaccaccttgggggtgggtggggctgagaacagaccccgcccacctgctcccaggggcggggtttcctgcgtgacgtcaccaagaccattcactattcactcccagtttcccaccctccttccactgcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatggtatggtccagtctgcaccccctctaagtcttgggctaaccctcttatatgtgtctccccttggtgtctcagtgtgattcagtcccatcctccttcctgcgtctatatggtctagcctcgtgagctgtctctttttctctctttccctacatgtctatgtggtacagtccacctgccagccctaggccattgctagcccacgatttgtctttcctcttcactgctttgtaacttggtctataacccttgacccctgccttcctatggtccaattacctactgttctgtgcttcctattactgtgaatttccaaaatggtacaatttggatcctctctccctttccaagtcgtactaccttacgctgttccacaatctgatgctcccttcccccttactgagaatctacaaggtacaaccccttccctccacctctgcctccctgtggtttagcccaggaatctcacacacccccggcttcgcaacatggtacagtccacacccccccccccccatgaagaccttcaagtagttcagcctactgctgaatctggacgtcccgattcccccctcctattggcttcttgtggttcagcccagtgcttctcgacctagtacattctggttccccgctcgcagacttccgacggtagggcccagcgcggcgcagcccacgccccctgcacaccccccgccccttccatcctatactgacgccccctgccgttgttctctgtcttacagtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaaccaatcttcctctttctaaacctccgctctcggtattttggcttcctgcttctcaaaaccatctttaggaccgcggcccctttaagcggcgccccttttccccccatcacccccctcgccatcaggcagcacgagcagagccatgtgcttccccctcccgcctgcctcattggcccaaactgggtcacggtcccgccccccagtaccgcctcccattgggcaaatgtaggtcagtgtcccgcctcccaccgaaaggcaaggcaacttcacgcgctgagcccctcacgcgccctcctgggccctggcggacccagaggccccattggctgtgcgtctcaaggtgtcggagacgattggtccgtgtttgcagccggagggaggcacgcggctggggtgcatgcccatagaggctggcggggctggacgcgccgggcggggacccggaggaggggcgcgcgctgtggcgtcgggtgttttggtttggatttttttttccgcgaaagaagtttgctttggccacgcctcaaggcggccgcctcctcctgccccctcctccgcccctccgcgcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtgagttctaacccccatctcacccacttcggacaccctacccccttagggactcaggtgccgtggggtggggtcccatagaaacctgcgtgcggggagtccatcttcccaaccttaatctactcaattactcaggtgtttaggcccctagatcccttagcgcccaggacccaaaagcgccggctctgaagcccgtccaccctaaggacccaggcaccaacgtccccaacgtcctccccgcttagttcacaagagtgtaggccccagcctcctcttccttttggtccgggagtctggacccctggggtcccagggagggggtgtgtcgggtgctcacacggtggtgacacgggcttgggcggggcgtcatggggtcacatggagtctagggatgagggatgtgccccaggaatagagccccttcctgccccttacagatggtgggggaggggaagggggtacagcgcgcaggggatgggggttgggtaattacagtgaaattacagagctgtcattttttctctcacctgcccaaccctccacctaccctgtccctgcccccctattcctgaacttccgtctctctttctctggttcgctgtctttctgtgtgtctattccttcccggcattctgtccccatctctgtgaatctgtccacctgtctctgccacccccgtctccattctttctgggtctctctcccactctgcgtctccgtccctttttctcccgtctctcctctccgaccccccgtcccctctttctctggatctccgccctgtgcctctcggactcggggtctcttctccatctctatctcccccacctcaccctcatcc

SEQ ID NO: 17085 - DNA, 56616 bp, Human; identical to SEQ ID NO: 12462
  misc_feature (1)...(56616): n = A,T,C or G

SEQ ID NO: 17086 - DNA, 20374 bp, Human
cgcggggagcctgcggggtgggactgcatcgggaaaggggaaggagtcagaggcgagaagggggagagtgtctgtttggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgcccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcccagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccatttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaggacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggagcaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagataggaggagaggaaagataaaaaaactaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaacaaacaaaaatgcaagatagtttcttggcaatgaggacattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcatggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcagcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattccggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagaaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaagcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagggggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccattgaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggtgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaatcgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaccttctgctaaattgcatgaccaggctttccaaaaacaagacattctcatgtcatcaggtgatccatctcctggggaccttagaatcaggttaccggtgcctacaaaagaattttgagcagaagggcctcgagacatcgggaaaggggtgcgctggctccattctgctacctcccaccggggggcagctctccagagcctgccgggttctgcagctgcagaggtggcagcaccgagctccctgtgggataggactggtgctggggtctggcttctctcaccccaggaaccaaagatgctctgaaagttgggtgtcggccgggcgcagtggctcacgcctgtaatcccagcactttgggaggccaaggcaggtagatcacctgaggccaggagttcgagatcaacctggccaacatggcgaaaccctatcactactaaaaatacaaaaattaacctggcgtggtggcacgcgcctgtaatctcagctactcgggaggctgaggcaggagaatcacttgaacctgggaggcagaggttgcagtgagccgaaatcacgccattccactccagcctaggcaacagagcgaactctgtctcaaaaaaaagaaagttgggttgtaggctgggagcagtggctcatgcctgaatcccagcactttgggaggctgaggcaggcagattgcttgagcccaggagtttgacaccagtttgggcaacatggtgaaaccccctcttctacaaaaaattagccaactgtggtggtgagtgcctgtgatcccagctgctcgggaggatcacttaagcccgggagatggaggctgctatgaggtgtgattgtaccattgcactccagcctaggtgacagagtgacaccccatctcaaaaacaaaaggctgggtgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggtgcctgtaatcccagctactcaggaggctgaggcaggagaatcgcttgaacctgggaggcggaggttgcagtgagccaagatcgtgccattacactccagccaggggaacaagagtgaaactcctactcaaaaa

SEQ ID NO: 17087 - DNA, 6527 bp, Human
gcaggggtgggggcttggctggccctcctgtcagcttgagctggcttgagcccaggcagggccctgacagcctgggcaggctcagagggagggaggtgggaaccaagagacccggggagggctcccggggccaagacccaggtccctgccctgcacatctgccaagggacttcctcagaagctgctgatgttaggctttggcttcctgctgtggactgaggggatgaactccgacgggaggacattcaggccttggaggaaatgagagcttggctgacaggagggcctggactcacgaagacacttggacacccacaagcacagagacatgggtgtgtgacaactgaccaaggggcatgcaggtatgtatgcgtggtgcacacagacaccctgggcacagcccactggcaccagcgtcaacccctgcgtggtgggctgcatcccacccttcaggcaggccctgtggggcaggtttcagggaggaaggaggctgagtgggcagagtctgaggacgcggccaccatcgctccctggcactacatctgtgtccgggatctaggaggcagtcctccatcactgagccccaagatgactgtcacagcttggtctaaagcaggggccgggcctgagccctggcccctgccctggaggagctcacagagcccccagctggggcatatctggtttccgggggcaggggcgatacccagaggaggaagaagggattctgagagagcccaacaggctccgagcctcaggctggagctgagcttggggcagcaaggaaggaccaggtgcgagggcagaaccatgcggcccgacccctgcagcacggcctgtggcctcccccagctcctgcccgtgcttctgggtcagtctggactttgccacttctgaccaaaagccaccgcaaacccactcaagccaaaagaggaagtgaccgttaggcccaactgggaaggctggcggccaggggcactccaggcagggcgaggggggcggccgggggcgctccaggcggggcgagggagacacccagaactccaggcaggagtcctcgggtgccacctttcctctccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacgactaaggctggcaggcatgaggtttcctgaaggagaaagagcttgtggggcccagtgtggctgggggggcgctgggactccattctgaagccaaaggcactgggaagggcttccgcagaggagggtttggcaggggttgccaggaacagcctggatggggacagggaacagataaggtgggtggaggagttagccgggagcctggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggctgctcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgggctggttcctatctaggaagagggtgggccttagatccctacagcttgccctctgccccctaggcccaggtggagggcagaggtggggactccagcccaggcccaagctggaagagggtggggactttcagggaactggggggcacctggctgtgagagctgtaggacttgggggtggcaagggtgccaggacaaatggtaggatagccatgggcttggggaagctgatctctgctctttccagctgtcccctctctgggcgtcccagcaagcggcccccattccctggctctgcttcaaaggcacctccatactgggaccacgtggagcagggtagaggtgggactccttcctccagccccctaaaaagagcctgcttaatgcctttctcagactggccctaaaggacacattccttggccagatatccttgccacctaagagacaccactactccacagtgtgtgggctaggataaggcacagcctggggagggggctctgaaggggctgaacagacaggccagcctgacctccagctgctcctgcactgagctggatggccaccctgtgacacccatctgcagagggcccagaaccaaaggtgccagggctgcaggactcagggggagatggtccgacgggaggtctggggagggagcgcacagccagcactggtctgtgtgtggtctggcctggcctcacctgaccaagagaagggctcctgcccacagagaaactttagggccagcccaccctctgcaactaccccagccctggggtcctggggttaggctaggagagtcccagctgcaacctcctgggagcaggagagaaggtgtctgtcagatttaggcctgggaccggaatgcaggaacagagaaactgaggtttggaggcacagggacgcaggctttagtgatcccggcctgaggcagggtcagagggccctgctggtgggcgctggtaggtgggtgaccagggactgttagctacagggagtgtgcttccttgcacctgggaggatgcagccagctctgccctcagactcccgaggcacttcctggccagggacctgaaagctgcatttgcctgtgttttgagagtgaaatgattcagaaacaaggactcaagtggtctctctcgcggagcaggtgtccctgtgcctgaatcactcaccctcccccatacactcacaggttgggacagggcctctctgcgccccaggcttcagccctgccctcctcgctgaatgtcagggacacagggcaggccagggatgggtgagacgagaggtctcctcgggcggggagggggcggggttccgccttagggaggagaggacacggccaagtgaagggccagattgcaggatccctcccactcccatctctggggcttcgggtgtccagacctgactcccgctccccctcctcccccagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggtcggggtgtggggcaggggcgcacgcgctggacccccgggacccgcgcagggcgctcaccaggcccgtgcgtacctctcgcaggggcggcggccctgtgcggcctggtctacctgttcgcgcgcctccgctacttccagggctacgcgcgctccgcgcagctcaggtgagggccgggcggggagcggggcggggccggggaaagatcgcgggcgggcggggctcctggggagcgggaccgaagctgggggcgggcgacgggccggagcccagcgcctttggggattcggtgggcgagccctggcggcggccagaggaagtccccgtggggccagggttgcggcggggaagaagcgggcctcctcgcgccacctccccgctgaccgccgcccgcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagacccgggctgcgttctctgggtccgcgggggtggcgcaccgcgggctacggagcctggaggggcccagcccgagtccgggcagcccggggcgggctttcctagtggcggcgtgagagtggctgcgaaggaacgagccctccccctggggcgggactggatccggtcttcacctcctaccccactccctactcagcctcggggtcacaaggccgcccagtcctgccggggttcaccctcctagcgctcagcggtctcctcaccggtccccctcctcaggggccttccctcgactctcagccgccgcagtccctcgtcccctggccttcacagctgacactagatagagcctgtggctctctccccaggtgagggcaggggtttttcttttggtcagcactggatccccctcgttaactgtaggtgttcagggcagccctccgaggtccgcagagctgcgggcaccatgggaacgaagtgagtcagtgacaggcggtctcaaggaaatgtccagaagccttggggatccaggggaggcccacagaaacaaagaagtgacttttagccaagtatgcaggagaaacggagaaaggagagctttccaaggaggggcaacagtgtgtgcaaaggccctgaggtgagcgggagaccctaatgtgccagaggagtgtcggggacccaggatgaggaccaagctgagacacacggaggggaacaaggaggctgggaaatgccttcagcttgaggagctaagggaaggcctcatcgcaggccttggacatgggggagacattcgggggacctgctataggcattgtggtcccagattctgagctggtttcaccagtgacagactttgcggcctgatcctaggaaggggggtacgctggcgccgaggtggcactgcagctgcacagccaggggctggaccccgcgcctgcaggccaggctggctccttgacttagcagggaaaggtcgctgctgatgctggctggggaggcccagtgccaggcttagttggcatgttggggcacagaccaaatgaagccaaccgcaggggcagagggagatgcccagggcgctcacatttgaggcacacacttcattaaccctttattacaagtcacgctcttatagaagtatatgtggacttacgtgaaaaaatcaaatgtatccaagaataaaaaacacagcacataaagtagtatatgcattccagtgttcgcgccagagacggcgggcgcccaagtaaaagctcttctaaaacggcctgactggggcaggccgggtgcgaacggttccgggcctcaggcacagtgtgggggccgcctgcctcctccgcggcccggcgggcgggggcagcaccagctcctagggcctccgggccagcggcggaccccaggccggcccaagcccgacgccaggcagaaccctttgggcggggccgtatctggccctccggggacggcagtgacgacacccccagaaatgtgggcttcagggctggccacagggtaccctcagaagcccgcagcttagtcggcctttttcaggaagatctggaagagccggacccagggtcagcagggcctctgagctccgccagggtctccctggctgctccccgtgcctggcctggccctgcccagcctcacctcgctcagaatcacccacacaggggagtccgtctggatcgagaggcgcagtgcttccagagggccgaaggctgggtccacctctccctctgccactcccttgtagaaggagcctgtgggagggcagtggtgagagggtgtccctgaaccccagcccacgctctcccccaaaccctacccaccgatctggaggtagccgtcggggctccgagggtaccggagggtggcggtgcggccctcctgcagggcctccttgtctgactgagggttctgggggcagaatcaagggctgaggcaggtggtcacaggaggcccggcttcagtgcacaccacacccaccgaactt

SEQ ID NO: 17088 - DNA, 48313 bp, Human
  misc_feature (1)...(48313): n = A,T,C or G
gacacagtcagtttgagctctgtggctctactgtccatctctggcaaaagagtctgagggcggatgccgcctcctccgtgaagccgtccttgtcttctgcccctgccagtgggtaggatctcttttgccttttgattttgtttacattgtgcttatggcccttaccgcactgtgacttgtaatatagataatggactcactgctcgcgcttctcccccaaatagtgaagtacatgttgtttcaagactggttgctagctgactatggcatatcttttgctatacttaccactttcgtgcataaaggtaccccctaaatgttgagtggaattgtttcagcctcttgcaaactgtaaataagctaatctttagaaaggatcttcctttagatatcagtaaaatggagcagcactgtggggaatcagatcaacaaaggtttattgaatgctcacggtgccccaaagaccagcttcctgtcctcctgtccttggagtatgagatgccatgagcaagacagacctgcctcgcacctcctatagcttagagcacagtgacctgccagcctggagagctcctgagtccccttctcacagcagtgtgggctaggcaggtgttccagctcactcagccctagattgctcccaggtaacacgggactgagactcctgcggtgcgggttgtatgagcagctgtttgtccagcatctaagcgctgtggcgtcactggagtcactccctggctggcacgctaacacacctcggcaggagtggtcagagtggcagccacactgcagccaccacccagaggacggggagaagaccgtggggcagtggtcacttggagaaattattaatttgactcagttctttatttagacttgttattaatccattttttccatgtttaaggaaaatcctagcatttgtgttgaaatataaatcatcaccacaaaaatctcattaggttgacgttaaatattagatactagaacataaaggcaagggatttgacagagctgtagaatacattctgtagtcttaaacggtatagaatgtttacctatatgattttattgttggctatgtagttttaaaagaccaaaataaatagcttgctgacttttaaataagcataaccagacacgagcctaggaaccacttgccaatttgtttgcttgttttctgtataaaatcatccaggctcctgcagagcagcagtctcagcctgtgcctcaaccacagaaaagctgctttctgggcctgctggcctacactcagacatagtggatagacttcctagtgttactatgatggactgtcagtcacagcagagttcttcatatacagatctctaccctgaagtccggtggtgatgtgggactctggggctgtgccagctgatgccagctctgggacccacctcctgaggcaggagcacgtgcttgggcacatgcagcacactgatgccaccaggcctctgacagcctgtcactttggcgtatgaatcttgctttttggttcatcatttcaaccagaatctatacactgagcagaagactggtccgtttgcttctctttaggcattctagaagtgatcatttttgaaacaatgcctccgtctctagacagctaggtgtaaatgaaccatttacacctagcttgcccacagggggcaagctgatgagacgcacagagtgatgtagtcttttcatagccagtagtaatgcatacattcttttctccaaaggtggttattttctagtccagccccttaaagtgtggtcttgctgggcctcaaaattccttcctttcataatggtctggtaccactgaaatgtctgcatttttttgtgtcttgcttaagttcagaacttggtcagattgactttatcaacttacagccacattgtcttacataccaataagttcagaactctcttacgtgagctgcgtatgtacttccggtaagaatgcacgttcattctgtttttctttgaagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggtaagtatggtctgttttaatagcgtggattgagtttttgctgtaataaaaagtaaaactaaagtgtcaggatttagaaacattgatgattaaaaaaaaaactctgttataggtttatgagctaaattgaatcaactgcttgctctagttctgtgtagtcaggctgtagggtacaaacccatattcttagaatgctgcaggaatttaaataggtagcaagttttcttttttgtttgtttctttttcctttcattttttttttcatttctcctgtcattatgatatcagagtagtaggtatgacagtgagttgtaacagaaatttggagttttattcatttcttcatcatggccaccttttcccccctccccttttattcccgatcactcctgttcatttccaggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaaggtaaagctcttcacatgtttcctagactgcagctatcagcacttcccacactttttaccccttatttttctgggcagaacttttttttttctttttctttttctttttttttggtcaatgaaaacaggattacctttgcgcctaaagaaaccgtggtgcagttaaacatcgcgtgtttacagctggtaggcagagggggttgagggagaagaaagctcttttcgatgctctagtagggtagtttacatttccttgtagagatgttgggtttggagaatctttaacgatgatttttaactgatcctttgttgcggagacctatgatcagggaaacagttgtttttttcagccctggcggctgaaggccctgggagctaagaggaaattgcagtccagagcttctttgagaagctaaggcgggaaagggactgtttggaaggaatgcccagcttgcatctaaagtaatggtgatcttaacttcctgatgacacatgctgtatcggcacttaaatccagtgtgccagaagaagtgttaaaggtggccgggcacggtggctcacgcctgtaatcccagcactttgggaggccaagctgggcagatcacgaggtcaagagatcgagaccatcctggccaacatggtgaaaccccgtctttgctaaaaatacagaaattagccaggtgtggtggcacacacccgtagtcccagctactcgggaggctgaggcaagagaatcgcttgaacctgggagatggaggttgcagtgagccaagatcgcgccactgcactccagcctgggcgatggagcaagactccgtctcaaaaaaaaaaaaaaaaaagttttaaagttagtggaggatggttcaaattaggaaactttgatggtaatggaaagttataaacaacaaagcattcttttggtttataacccatctcctatttggaattagatgataatttgacagataatttgatgtgtgcatgcgagagagagagagaaaaaggagagagggggcaagaagggagaaatgtcggaggtcttggggagttgtttgtggctatagacaggtagctgttttatttatttatttatttttttgagacagagtctcactttgtcaccaggctggagtgcagtggcgcgatctcagctcactgtagcctccgcctcctgggttcaagcagttctcctgcctcagcctcccggtagctgggactacaggcgcacgccaccacacccagctaatttttgtatttttagtagagacagggtttccccatgttggccaggatggtctcgatctcttgacctcatgatccacccaccttggcctcccaaagtgctgggattacaggcatgagccactgcgcccggcctacaggtagctgttttaaatacgtgcttcatttatcccagctggcatgtcattcacttgcttttgaaggttggtagtaatgtgaatagtgtatattgtagaatcaccatgagctctgccataaccctcactggtggtgaatcgaaggactaggaaggctcacttgcttctcccgtctcacggggtgttagtggtaggcctgggaccaaaacaagctgtgggcctttgggaccttattgcctgtaccacggagagacttgttgaagactttgaaccactgatactttgataggtcaaggcctctgacccaccttctgtttagaatcttagtaataatgaacaaatattcactaaacacctattaaacaattttcatttaattgtatttatctctataagacaattgttacattcaagaacagtttcaatttttatagctataactgactttcagttttatggtatccttctatcttatgttctaatagggaaagtaaacactttataagtgattttcgcttccttttcacctttctcttttctctgtatccttcaccaggctatgaggcaccaagtagaattgggaaataatctagttacggcacattcccgtttcaaaaaagaaaaaaaagcttgcttttccaaaaataagctcaacagtagattagctaacactgacaagaggaattggattttctatcatatttcgtattaaaatattggcattatgtagttaattgatgatctgaaacttcctttcatcactattgtacttgaaaatcatctgtcagtgattctttggggagtgtagcatgcagaataatggtcccgcctgagatgtccacgtcctaatccctggaatttgtatatttctttacatggcaaaaggaatttagccggtgtgattacattaatggtcttgagatgggagggttatcccaggtttagttgggtgggtccttcttacaaaagggagacaggaaggtcatagtcagagatgtgatggcagagcgaagtttggagtgatgtggggccacagccaagcaatacaggaagcctccaaccagctgagagaggcagggagcagactccccccagagcctgcagaaggagccacgcagccctgcttacctcttgaggcataagatgcattttggacttctcacctccagaactgtaagatagtaagtttgtgtggctttaaagcagtaaattggtggttacttgttacaatagcaataggaaactaattcacaagcatgtgtatttctacatttttgagaaatataacagcaacagtgtatggtttatgcaactagttaatcttctatttaaattagagctttatgaagggcaggtgtgcagataaaccaacgtgcaggtagggcctgtgacctgtacaggattaaatggaagagctggagccagaagaaaatattctggttcctaattttgaattgtttttatagttgtctttgatttgtttatttgtttttgttcctttaaatatgttagtaaaatttattaggaaataagtttttaaattttaaaatattttattttatttttgagacggagtcttgctctgtcaccaggtggagtgcagtggcgtgatcttggctcaccgcaacctccgcctcgcgggttcaagtgattctcctgcctcagcctcccgagtagctgggattacaggtgtgcgccaccacgcccagctaattttttgtattttagtagagatggggtttcaccatgttggccaggatggtctccatctcttgatctcgtgatctgcccaccttggcctcccaaagtgctgggattgcaggcatgagccaccgcgcctggcctaaaataagttttaaaatataattttgaagtattcataaatatcaactgtgttatagtacaattaaataattgtaagattttgaagctctagtggagaaaatgtatgtacatttctttcatacatatattcagtttttctttctccttcaaaaatctcaagtttggccaaaatagtaaagattatttgctttacgaaaccattctatgaaatgcttaacctttaaaaaagtgttcaatattgagtctggcggttcttagaagtaacagttacagccttaacatgaaataattggtatagcgtgttcctttttgtgtcctcaagttctgtataaacatgagtactggcctgttcttaacatggtttattttctattaatataaataaataaaaacataacaatgttcacaacaaaatttctgtgataaaggagacatggtttgaggcacaggatggctgtgattcagaagacttgagttctgagtccagctcttttcctcagcgaagagttctttgtgagcagggcaaatcagtttctttatgggcctcaatattttcacctgtaaaatgagtggtttggaacttctcatttaagatggtggcccgaacacctgtacaaagataagagggcagtaataagtggaagacagttttaacaaatttatgaaatatagaaagtagcttgaatcttgtgatacagataaaacagcagataaagtgagaataagcagctgaagtatgtgcgtaaggaagagaacctagctatagtaaaactacagaggctgtgggcatagagatgacaatgaagaagagatgaaatgagtggctaaaactagggctgttaattaaaagtgtgcctgtgaaacagctgtgccagttttctgccaacattcccactgtcccccatgctcagcattttcccctagagagctagtaagttagtgaggagttactaggtcaggatctggggaagcacagaagcctagtgaggggagcttcagcatgtggggctgtctttcccttgggggcatttgaaaattctggaaggggctgttgagagagtgttttggactgccctgtggctaggagacagggatgagagtccagggccctctaatattgtgtggcaaacttcttttacttgtgttgggaccaataaaaggctgcttcctagaagtaaaggtaactcagagattggcccttataggcactgccactcagcttcagattatcatctcatttgctgaacttgtatgggggtaaacaaaaattgctagtgcccccaggtacctagtagaaataaatttaaattctttgtggaagaagacagcatcatattagataaaattatttctagatagcaaacagttttatacgtgcaaggcccagtctaggcacacaaggagatatgacaacatgaataaaatcctgcagaaacagcagacaaaagaaacagatccataggagatattggcattattagatccacatttttaaatagctatgatattacgttcaaggtgataaaggcaagattaaaagttttggtggagaaatgaaaacttcttttaagaggaataaatcaaaattctagaagtaaaaactatagtaattgaattatgaatttaatatgtgtaacagcatgctagatataactgaagagagatttagtgacctggaggagaggtcagcaaaaagtatccagaatgaaagctgcagaggcaaaaatggtagaagagcccaaaacagagaaggtgttagttttctattgctgcataacacattaacacaaacttagttgtttaaaacaacacctattgattatctcatagttctatagtcagaaacctgggtgggtttgcctgggttctttgcccagcatctcacaaagctgaagtcaagatttcgactgggctgggctcagctcacagatggaggttctggaagggtatctgcttccaagctccttcagcctgttggcagagtctagttccttacagctttaggtctgtggttcccaatctcttgatctctttcagtcaggcgctgctgtctgctcccagaggctgcatgttttccttctcaagtgacctcctccatcttcaaggcagcagtggcatgcccagtccttcccatactcacatctccctgattttccaccctttccatgagccagagcaaactctgcctttaaagggctctcgtgataagaataggcccacctggataatctgcgttttgttaaattaatgagtacgtttagcccttttgcaagatgcagggtcagtatatgtacccctccccctgcaaaattgcatatttatatactagcagcatatagaaaatgaaaatttgaaaaggataccacttaaaataggataaaaacttttaaattatcatatctggaggaaaaatctaacaatatgaaagacttgtatacaaaaagctaaaaaaattagaaaaaatagagaaaactgaaatcgtggtgggatgtctgattttcagagttagaatatttaataccatgaaggtcatttttcagacttgtctagagtgattgcaatcaaatctcagtcgtcttaaaaaacaaagaaatgaacaaactgattttaaaatttatatgtaaaaataaaaaccctagaatggtcaagacacccattaagaagggaggaacactccctctgcgagatgtgaagacttaccataaaactggtgatcaagctggtgtcgtgtggtgcaaggagaaacagtggactagccctgaaacagagtcatgcatgtgtgggcttctgacttatggcagtggtggcctgtggagcaatgaggaaaggctagccttttaaataaatggacataggaatgttcatgtagaaaaaagtgaaatttgaccccaacctcatattatacacaaaagtgaatgtcagttgaattgctgtaaatatataaggcaagccagtaaagctatttgaacgtaatataggagaatgtcttcatgatctttggggtagggaaggactcctttaaacacaacataaaaaaacatttatctgctggatgtggtggctcatgcctataattccagcactttgggaggccaaggtgggaggatcgcttgaggccaggagttcaagaccagcctggccaacataatgagactccccccatctccactttaagaaaaaaaaaaattatcatagaagattgatcaattttgtattaaaattaagaaatgttgtttattttaaaaaaccaagatcaagaaactgaaaagataagcatagatgtgagaagatatatgactgaaaaaaaatctcttgttcagaatatgtaaagaacaacagtcaagaagattataaagatagacaaacaaatagtcaataggttgtcacaggaggatacccaaataacctataaacaggaaaagtgctcaatgccgttattcatcaagatagtgcaatttaaaactgcgacgaaataccattccacactcagcagaatggttagaaactaagctgttggtgataccaagtgctggtgaggatgtggaaccacccagaggcagctctcagatgtgacccctcgtgtactggaaccacgcagaggcagctctcagatgtgacccctcgtgcactgctggcagctgtacaaatttgtagaaacgctttggcaaagagtttgacattatctactgaaatacaatggatacgttcccactcttagttgtctactcatcagaaacacatgcataggggatccggagctgcgtacaggaatggtgatgactgtgtgttctgtaatagattgaaaactaaaaacaactgaaatatctatcaacgtaatgtgatatagttatacaaaggaatcttatagcaatgatggaaggagttatagctacatacagcaacaatggatgagtcccataatattgagccacagaagtcagacacagaagatttcaaaaaacaggcaaaaataaactgggagctccagggtgcatgctttagctggtaaagcaagaaagtgattattgtacatgtcaaagcagttatcactggtggacaggagggacagtaattagttgggggtgtgagaagcttttgggatacagagagaacatgactgataaatcattgagctgggaaacaaaaaaagaagcaaaggaatcagtacagtatcgggcataagcctcctcactgtcagcactcagtgtggaaatcagtggaaaagtgccttcaaagttctcacagaaaattgattttaaactcagaaaacttattatcaatcaagggtgggggcagagcaataccatctatcttccatgcaccttttctgaggaaattccttgaggatgtactccagcaagagaggcaacacaagagcgtaatgcaagaagcagtggggactgtgaaaagaaatcccaggatggtggctgcatggcaggtcttaaggaagctgcaagaagagtgtctgcaaatcatgtggaggagatgccagacaacaataatgtaagaagctaggaagtgccagtgataggctaaagagtgtctgcaaatcatgtggagtaggtgccacacaacagataatgtgagaagctaagatgtgtcaatgataggctaaaactggcattttttattagtaaaaactaataataatctagaatgtaataaaatctattatttattagaaatgtgtggggaaaactagaaaaaatcatggtctaattatgaaacaaagaggacatgatgtttgagcagttgatgaaatataagagaatcctttgtccttgatcctggaaatagtctcaccctcttatgagtggcagcaagagccatgtgatctttagaaaatgaaatgtaatcccaactctggccgttagtgatatttacattgtacacatacacacctacactccatgtattgattttcaacttctagaaacatcctaaagaagaaatacagaagacttagttatgaatatatggtaaatggaggagaaagggatggaacagtctcattttacgtaagcagaagtcaagacgttcccttcagagttgaagaagcgtgaagattaggggtgttacttaaagacgtaaccagggaaaacccaaaaagcagaacaacaaaaaaaataggaggtgttggcgattggggatttcaaggaagtggccaaatactcagttttcgtaatggggagtaggtgaatcatttctaaagctgataaatgaagagatagtgataacaatgtattctttgagtgaccgcaataaccacaaccaggaataactgaaggtagttcctcatggagctgagctacaagtggggaagcttatgcccacttagatgcttagacttggtccatttgccttgttttagccaaaaacttttttaaaatgacaaataaaaattgtatatatttatcatgtccagcatattgttctgaaatatgtatacattatggactagctaaattgagcgaattaacatatgcattacctcacatactttttaaaagtttctgatgagaacaaatctactctcatcaattttcaagaatacaatacattgttattaactgcagtcaccatatctcacagtagacctcctgaccttattcctcctatctaactgaaattttggacaaaaacttttgataccaaaaaagtgtgtctgttttcaaattctttttttctttttctttttctttttttttttttttgagaccctgggcaacagggtctcagtctgtcacccaggctggggtgcagtggagggatcagtgctcactgcagtctcgacccccggctcaagcagtcctcccacctcagtcccctgagtaactgggtctacagacatgcaccaccacactcagctaatctttgtattttttgtacagacaaggtttcactgtattgcccaggctggtctcaaactcctgggctcaagcgatctgcctgccttggcctcccaaagtgctgggaatacaggcataagccaccacacctggcctattttcaaattcttgagtctgagaagtatataggtataaatacatacatggctacatgtatgtcaatgacttgtttcacaagtggatatatccttctcattttataattcatataaatggtgcaatttgcatatgaacctgtggatttacatatgtatatagacagacacataatatgaactgaattaaagtaaggtagcttcttaaccaaatgctacaacagatagccttcaactttaaaacagattgaattaggttcgagtttggcaaaagcattaatagaagagaataaatgtaaacaatgttataaactcaatggaataaagaaatagaaacagtatttaaatcagtgcttaggttctcaggtggcctttagtagctgttagccctcatgagtagcccagaggtgataatacaaatgatactatttagtaccagtttgaaacctaaaaatgtgtaatcaggctacttgattcttcatgtctattttctggaggaaaatgaacagaatttcaacaggaaacgagatgctggaaacacagcctgtagattttattcttactatagtagtaggaggagatagttctaaaagaactttatatagcagttgcttacgttagagattttgtatcttgaacatttaccatgagctgaaattttggcttcttttctttttagatactgttatttgtgaaaaaaacacagtgattcaaaatttagatttattctcctcatgaattcagccatttcctctactgtgatattccaaaatatacacattttaagacaggaaacagtgactttgtttccaacttcttgtcatgtttaaactgaagatttcatttcttgactggttttatgcactctatattaaattacctggttttgaatgtaatctaaactatgaaaccttggtgtgtgaaggattgctgaaccccatcttaactgtggctgaaatgtgcctctgcaaaggagttagtacatgctgtagtcttagacaactcactctgctcttcatatgtgcaagtaccttgaatgaaataagcagatttttccttgttacttattaaaaagatgatatattcaatgtatattctggcattgctgtattttccaaaaccgttctaatggattgtgcattatatttcctaattctagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatgtaagttatgtatgtattttgtctgtgtgcttccatattgtcaataatgtggtaatcttcagggttttctggagatacattgagttcagacctaggataagctaaggataaaaatggctattaacattggttttttgttttttgtttttttgtttttttgtcgcccaggctggaatgcagtggcgcagtctcggctctctgcaagctccacctcccgggttcatgccattctcttacctcagcctcccaagtagctgggactacaggcgcctgccaccacgcccggctaattttttgtatttttagtagagatggggtttcaccatgttagtcaggatggtcttgatctcctggccccatgatccacctgccttggccttccaaagtgctgggattacaggcgtgagccaccatgcccggcctattttttattgataacattctttttttttggagacggagtctcgctctgtcgcccaggctggagtgcagtggtgggatcttggctcgctgcaagctccacctcccgggttcatgccattttcctgcctcagcctcctgagtagctgggactacaggcgcccgccaccacgcccggctaattttttgtatttttaggagagacagggtttcaccgcgttagccgggatggtctcgatctcctgacctcatggtccgccagcctcagcctcccaaagtgctgggattacaggcgtgagccatggcgcccggctgataaaattcttaataaacattgaggaaatcaaagctagaaagaggcatcattatggtgcataggaatttaggtcacttaaccaaagtaggaatatcaattgatactctgtttctataaaataggaacagtattgatctaacaaattgagaaacaactaaatattttgtggaaagatgttgttctataagtagctttttaccttgtatatgacacaccagtttcaaatacacgttattagatgatgttacatttagagtagctattcttggaagctccacagaaatcaaagcactaaattttacggagaaataatgtttctagaaaatgaagttgggttcaatcaagcacattgtttgttctcctagtggtcgctgagcattatgttgataacgttgccatgttataaaattacaaaatgttggccgggtgcagtggctcacgcctgtaatcccagcactttaggaggccgaggcgggtggatcatgacgtcaggagatagagaccatcctggctaacatggtgaaaccccatctctactaaaaagtacaaaaaattaaggagggtgaggtgggagaatggcatgaacccgggaggcagagcttgcagtgagctgagatagcaccactgcactccagcctgggcgacagagcgagactccgtctcaaaataaataaataaataaataaataaaatataaaacgtgaaatctggttttttttgttttgtttttttgagacagggtctcattctgtcacccaggttgtgattctcccacctcagccctccaagtagctgggaccataggcgtgcgccaccatgcttggcaatttttaaaattgtttgtagaggtggggtcttaccacattgtctaggctgatcttaaactcctgagcttccttcttttgagtctgtggcttgagttggtttaaatttctctaatgcatgctttattttactttttctttttttttttttttttttgagacggagtctcgctctgtcgcccaacctggagggcagtggcgcgatctcagctcactgcaagctccgcctcccaggttcacgccattctcctgcctcagcctcccgagtagccgggactacaggtgcctgccaccacacccagctaattttttgtatttttagtagagacaggggtttcaccatgttagccaggatggtctcgatctcctgacctcgtgatctgcctgcctcggcgtcccaaagtgctgggattacaggcgtgagccaccgcacccggacttgttttacttacttatttaaaaaattttttcaggttacaaaaaatatatattatttttaaaaattcaaacaatataaaaaagtaaaaactcctgaataccgccacccacagattactagcattaacagtttggtgagcattcttatgcatacatgtgcacaagtacataaacaagattaatcgtgttattcttcatcctgcttttctcctcgtgcaatgttggtagacctcatatactttaatgaacatagatatgagccagtttttaaatggttgcatagcacagatgcacagtaatttatttaagagactgccagccgcctgttgttggatagattgttttgtttctcactgttataagcagtgctgcaatgaacattctaacgcctgaatttttgcatactcgtccaggtgaatttcttggccaacattgtcaggtcagagtacacacacttctagtttaaaatatactgacaaattgacctcaaggaagactattagtttgatattttcattaagagtatttgagaagctgggcacggtcacttcacctgtaatcccagctacttgggctgaggcaggagggtcgcttgaagccaggagtttaaggcacacctgggcaacaaaacaagaccccatctcctaaaaaaaaaaaagtatcagccgggcgctgtggctcacacctgtaatcccaacactttgggaggccaaggcaggtggatcacctgagtcatgagtttaagaccacgttggttggccagcgtggtgaaaccccgtctctactaaaaatacaaaaattagctgggcgtagtggtgggcgcctgtaatcccagctcattgggaggctgaggcaggagaatcacttgaacccaggaagcataggttgcagtaagccaagattgcgccattgcactccagcctgggggacaagaatgaaactccatctcaaaaaaaaaaaaaaagtgtctgagaacgtctgttacttcagaatcccccagcactacatactgttgattttttttgttttgcttttgccaatttgataaataaatgatattttatttttattggtgaggttgttacttatttttatgtgttttggtaatttaatttttatggcctttatccatttttcttttggactgctggtctcttctgcatttgtaggagggttttttttttaaatattaaaactattgccctttacttttttttttccatttgacattatttatgttgttgacatactgattttttatcacccattttttgtttcattttaatgtaatcagatctcttaggtttcctgtcatgtttagaaaagattttctacactaggattatataaatgtttatctatattctgaggttttatttcatgttttagatttaagtctttgttccatttagagtttttcttggtataaagattgaaatatggatgcagttttatttttgtccttagctaaccaatcaccccaatcctgtataatggataattcatctttccctcagtcatctggaatgactgaggttatgtgtttggtgcctaagccgtgggactcgctgtttacaccatgggctgtgtactggttcgttcccgcactgccataaagagatacccaagacagtgtaacttataaaggaaagcggtttaaataactcatagttgcgcatgatgtgggagacctcaggaaacttgcaatcatggcggaagacgaaagggaggcaggcaccttcttcacaaggcggcaggagagagaaaagtaaagagcaaagtgggcagtgctccttagaaaaccatcaggtctcctgagaactcactcactgtcacaagaacagcacgggggaaaccgcccccatgatccagtcacctcccaccaggtctctccctagacacgtggggattatggggattacaattcaagatgagatttgggtggggacacagccaaatcatgtcagggtgccaggatggaggcctgccgcaggatcagctctttaaccctctttaggtaaaaatatgatgctacgaggcctttcactttatcacaccaaaaacaagagcttagccttcatatttcaaacctttttagaaatttgtgcgtagtatttaagttttcagagttaacatactgctttaatgtctttttacctgtaaattctacttttttatgttcaaaaagacattatgtgtttaaattctgtaataattaagttactagggacacataaaagtgatttgattaaaagtgcatctttcctttaattgatgtttaacttttctcaaatgccatgtaattggtaaaagcagtaataataagaagtactgaattctgctgtgatttttttcccgtcttaatgcatttcaatattaaacttaatttttgtaatcaagtaatctgacatattgaagtataattaattttctcttttcagataattagtttgttaaatgtgtttacaccacaaaaaactctagaagaatttcaagatgtgtaagtatcatttttattcagtaatgcactgtacatcaaagaatgaacatctagaaaagacagcaactgctttttatacttaggaaatgtaggtggcaatacattttgtgacatcacagataactttctctgttgcagagaaatatttagaaaatttgatagttatatttaattatttgtaccacatgggttttcatcttcataacagataaaggatgactggaaagaattcttcagagcagaccaggatcactaatgtgttttgctgaactataaaatgtttttctcaaatccctgatagccaggattttagggttcaggagtttatgagtattacttaaaatgattaagtcactaattctatttaagattctgtatttccagaatcttaagtagaatcatcttactaacagtgaaatgaagtattaatctattgagaggcataatgcccaacttcatcctgaatttattggtgtgttcagtcattaacaaatatctgattgccctctgtgtgctgggcactctctgggacttggcctacctggcttccctggagcctgtcagggaagatagacaagccacatgataaatgaggaaagcatgtagtccattagaatgtgctaggtgctgtggacaaagggtggagctgggtcaggggatcaaaagtgctgagggttggacttgaggctgcagttttaaataaggtggctggggaaagacctccatgagttggtgacattcgaagaaagccttgaaggggataaagaagttggtctggccgggtgcggtggctcacgcctataatcccagcactttgggaggccgaggcgggcggatcacgaggtcaggagatcgagaccatcctggctaacacggtgaaaccccgtctctactaaaaatacaaaaaatcagccgggcgtggtggcgggggcctgtagtcccagctactcaggaggctgaggcaggagaatggtgtgaacccgggaggtggagcttgcagtgagccaagatcgcaccactgcactccagccagggcgacagagcaagactctgtctcaaaaaaaaaaaaaaaaaagaatttggtgccgcagatactttgggggcaagtagaatggagatagaaggaacagacagcgctcaggacagcagtggatgcccgcctggtgttttccaagaccatcaagaggtggcgtggctagagatgagggagcaggggaagagaagagggtgaacaccacaagcctctaggccgttgtaaggatgtcttttgctctaaggcaagtcagagtaagagtcttagcagagcagtgagctcacctgccttctgtttgaaaagcgtaactctggcatctgggttggtaacccactataaggggtgggggcatggaacatcagttactgctgttgcagcagttctgttaagggatgacggagggtccatttggcccagaggggtaataggaagggtgagaggggaagagactggatgctgaaatggttctaaagatagagccatggtattagctgatagatgagatgtgtggtatgagagagaggaattgagaatgacacctagatttttggcctgagcacctgaaggatgagggagctctcaactgagatgatgaaggctgtgagaagagcagactgggctagggatggaatcaggagttcagttctggagatggctttaagatgcctgttagacatcaaggtggaactgggaatagggaggcagaggaatgagcctggagttcaggagatatgtctgaattgaacgtaggaatttgggagctgatggcctgtaactgagatcactaagaaagtgagtgtggttacagaagagaagagggtcaaggaccagttgctgggtattttgacagcgagaagttagagacaggacagggcagggcccgctgggattataggactggccagtggatttagcagcatggaagacatcagtggcctcgaggaggacagtttcagcagaatggtggctgcacaaacctgatccaagtgggattaagaaaaaaatgggagaaggctgagtgcagtggctcatgcctgtaatcccaacactttggaaggcccgaggtgggcggatcacttgaggtcaggagttcgagaccagcctgggcaacatggcaaaaccccgtctctactaaaaatacaaaaactatccaggcatgatggctgtttttttttttttaatttaattttcagttctgggagtccgaggcatgagaatggcttgaacccgggaggtggaggttgcagtgaggcgagatcacgccactgcactccagtctgggtgacagagtgagaccctgtctcaaaaaaatttaaaaaataaaaagaagggagaagaattggagatagcacatgagacaccctttggggagttttgcttgcaaagggagcaaagaatcggggcgttgctaagcggggagtggggtcaagtgtcctttttgttgttgttgtataatcacttttaaaaacgtatatattgtagagcaatttagagccacagcaaaattgagcgggaggtactgagttcctgtctgtctccagccccttacgtgcagagcctcccccgttctcagcatctcccaccagagggtacatgtgttgtgattgatgagcctgtaacagcatggtctttaggctggtacggagaatttcagccaaaaatgtaagaagtaggaaaatttgtgtttgagattctatttaccatgctataaaaggttgttgtttttttttttaatttttaacttgtaagacgttaagtttgttatttatatattctttggaaaatttttagaaagttccattataccaagttatctttttactttagccagtgcagtgattggaagtaagttacagtttcatgaaatttagtcataaaggaactttggataattttcaaataaataactgaccttttctccctcaggtatttggttatggaattaatggatgctaacttatgtcaggttattcacatggagctggatcatgaaagaatgtcctaccttctttaccagatgctttgtggtattaaacatctgcattcagctggtataattcatagagtaagtggtgatgtattaattttatttttaaaaacaatcatttggttgtcataatcctttacatacaaaataacatttaaaaaaaattgttaggcttgaaaatccaaatagatgatggaatcatatggtgttttaagagagtcattctaggaggcatctgtggagccgcctggcctgccaggctagaccagctgctgtggacacagccaggtactgcgctctcagtcagatactgcgcaagaatacattgttttaaacttttcattttaaagtaacttaaaacttagagaaaaatttcaagaataggacagagaacttccaactaccatttatctacattcacctgtttttaatatatttgccatatttgaaatcccatttttaatgagcaaggaacttaaaggccaagtagtcagtgagacagctgcttgagaactctctttcttaaataatgacccacatatccatttctcttatcctaaaattctgccgtgccagcttccctgcatcactggtgggagtggccagaccctgcaccgcaagggttcagagcaggcctgtgggctcagcagaggccgggatttgaataacagtgtgactgtactgtcaggaaaaacatttaataagctagggagcgataatataattaatataattctctctaagctgattttacaattttttgttattattacttgtacggctgtgtaagcagactatcatgatagattttttttttcacaatttgataccaatacttcagtagcaaagaaaatgaaataaacttcttcctgccaaaaaacagtacatttttcataaaaaagaaagatggaattgatgtaataggtgaagaacaattaaaacttgtcaaataaggccagtaagaaaaccccaacagttaacaaaatctgttttcaatgacatattacagaacaattaaaaagctacataaaaatcagtgttacctacttattagaaatacattttaattcacctgtagatccaaaaacatttagacatacagacaaaattttgtattaactgacaaaaaaacccacactacctattggattcatgttgcttaaagggtatctacagaattctcacctcaatattttcgtgttaaataaggtggaaatcaacagtccagagatggtcattagaaatgagccactgacaaacacaatatatttataacttgtataacatttcattcatgtgcatgttttgagcattgtggaatatttaatttgcatcaggctttccaaattccttaaatttataagatttgttctcagtgggagttctcagatgacttttgaaataattattaaaatgaaaatttatttgcaaactactagggtttagatacagaataccttcttgtatttaaagatccatctccagtttgcatacatcatgtctttcaatgtgccggagagaaacaaaggcatccccacgttctttacatttatagggttttttagaaatgagttcttttatgtcttcaagtagaactggaaagactgaagacactaccacattgtttacatgcatagaatttttcctcagtagtagttttgtttcgtattttcaaagggaaatggaagagttccatgtgctttttaatgtgctcagaggtaactggaacatataaaggcatcatcacattcctcatatgcatgttatgtaaattatacggttttcctccagtataatttctttcatgttttcaaagataactgaattaactgaatgttttccccaaatccttacattctcaggatttctacagagtatgagttttttcatgtttacatacaggactggaatatctaaaggctttgccacatgccttacagtcatagggtttctctccagtttgagttctttcatgtttacatagagaactggaatatctgaagacttcaccacattgcaagtctgaagacttgaccacattccttatagtcaaagggtttctctccagtatgagatttttcatgtttacctagagaactggaatgtctggagacttgaccacattccttacagtcaaagggtttctctccagtgtgaaatttttcatgtttacatagagaactggaatgtctgaagacttgaccacatcccttacagtcaaagggtttctctccagtgtgagttcttccgtgtttacatagagaactggaatgtctgaagacttgaccacattccttacagtcaaagggtttctctccagtgtgagatttttcatgtttacatagagaattggaatgtctgaagacttgaccacatcccttacggtcaaagggtttctctccagtgtgagttctttcatgtttacgtagagaactggaatgtctgaagacttgaccacattccttacagtcaaagggttcctctccagtgtgagttctttcatgtttacatagagaactggaatgtctaaagacttgaccacattccttacagtcaaagggtgcctctccagtgtgagttctttcatgtttacttagagaactgaaatgtctaaagacttgaccacattccttacagtcaaagggtttctctctggtatgagatttttcatgtgttcaaagggagctggaatgcctgaaggtgttaccacattttttttttttttttgaaacagagtcttgctctgttgcccaggctggagtgcagtggtgtgatcttggctcactgcaacctccacctcccaggttcaagcagttctcctgtctcagcctcccaagtagctgggattacaggcacctgccaccaaatttggctatttttttttttttttttttttttagtagagacgggatttcaccatgttggccaggctggtctcgaactgctgacctcatgatctgcctgcctcagcctcccaaagtgctgggattacaggtgtgagccactgcgcccagccacattttttatattcataaggtttctctccagtatgagttctctcatgtgtttggaggtaactgaaccgactgaagcctttatcccatttttgacattcattgggtttctctccagtatgagttctttcatgtcttctaagggaactgtgttgactgaaggctttgccacattttttacagttataggatttctctccaatatgtgttctttgatgtcttcacatggagcggggatgactgaaggctttgctacatttcttacatttatagggtttctctccagtattatttcttttatgtttctgaatggaactggaaagagtgagtcttttaccatatttcttaaacacatggaagatttttcacattgtgagctctttatgtctttgaaagtaactacaaaaactgaatcgtttcccacatttcctacattcacggggtttctcttcagcatgagcacctttatggttatgaaggtaaccagaatgtccaaaggctttctcacatttctgacatttataaggtttttccccactgtgagttcttttatgtttttgaaaataactgcaaaatctcaaggctttaccacctttcttccattcacagggtttttctccgttgtaaattactttgtgtctttgaagtaaatagagaaacttaaatgtcttcccacatttcttacatttatgaggcctgttaccagtgtgtgttaccatgtgtctttggacatttgtgagagaaatgaaggttttctcacattgtttacatttgtatggcttcaccccacgtttctcccatgcatgtagtttgtgtccagaatgagataagatgtgcctattaagggatgaaggacatgtgaagacttgtccacacacactgcattcacatgaatttacatcagcagaaattttcttcttcaggttcagatttggaatctggccgaatatttctccacaatgactaccttctttacattcacagagtctttctcccataggacttcataaattttttccagaattattgaaatgactttcactgttctggtcttcccatttgtttccatttcctggcttccaggattctatggcatcctgcttagggatctccaaggtcacagggtgacagtctgtggcagagccacctagggcctcctggcccgaattttttctaaaaaacaattaaaatactgagtgagactagaggcagagataatataattttatcggaaatagatattcttagcattccctggattattactatactaattttatcaacagattgccattagattttatgttccaacagcaagaggtcatctttttgctgaactgaaatctgtggggaagaagctagtgagagacaagaacagcagagcctgttactacagaaataagcagatgggttttagatggtggagtggtaataattttttcagatctcttttgccaggaaagattggttccatcacagccattgaaggcctcccttgggggtagagcccaccgacccacagagggcagggttgtctcgtctcaagcctcaggtctgtggcccaagggcagcgtcagggatagctcttgtcctcccagggctagctgacagcctcccatctgccatctagtgtactgttttttaaaatagaacctttgctgccatcagatggtcagttaaaataatatattggtgactttgctttaaaaatagtaacactaggcttctgaattaaagatctcctgatgtaccattctatttctgttcctgaagtttccacagaccttcatataatttaaggtactcttgatatctcttaaatacattttatttatgctttagaataatttcccagattattagtcttactacattaggccttattcattttataaggggaaatggtttgtctgacttgttcccccttgggccccaaggtaagtgggaaacaatggcctcctgtcactgggggctttgtgagagctgcagcgtcggcaggccttttttatggaatagccggtgcctgcagcctgagtcagatggggcccaaaggagtgtttggtttgcccagcacgaggtatagaaacctaagaagccttcagaaaatggccccgttgccatccctgcctcctgctcaccatccccacccacctggcatcttgctgtgtcctctcctccctgtcaccttgttccctgctgcttcccacatccatggccttgccaggctctccccacatctgtgtccatgtgggagagtgatgcatgctcactgtggggaagttccaaacattgcacaggtgtataaagcaaagggggaaactccctcttgccccctgcccccctgccccacccctgcccacatcccaggaagggaggagccctaagttaactgttctgtgtggactgcaccatcctttgttccatctacagtaccatgcacagagatagacacacttttaattttgcctattaaaatggtttaatacaaaacataaattttaagtatttgaaagataaagttttgcccatgatatcccaccgaagtatatactttatataattcaaaaaatgaaatgcaagtaacccagccctctgttagcacctggagatggccagtgagagcacgctggtgcatgtcctgcctcactctgcatggcacctctctgttgactgatgttaacaccagcatatctgtacttatgtccttttgaacttacatccttcaaagacaggatcaccttgcatataactgcgtagcaacttcctaaacaggtagcttggtttgtttttttaaatcaaggatcaaatatttctataaatatttatgaaaaacagatacctccacctctccctttatttctctctccctagaagcaaactccttcagttcatttagctgattattttggtctctatttccatattgaaataatatgcttagctctttcttcattgatcctttctcagtttggggcataagatgctgatttagcttcttaccaacccagccctcaccctcggccttcctcgccctcctcccaggctggtggatgtgatggtgtttggctcgttgcgtcatcgtgagcgtgtaaatgctttgcacagcagaccttcccctttcaccttttgttccctggagttaacaaacacttatactctatttgtgtgaggtttttgtttgttttggggggtagtttctgtgttcttggtggtaattcaaccctaactcttccatcaggcatctgaattttctctcagcacatgtagatgtcttgggtatttcatcagtttcatcttctcaggaacctctcccaagcctcagccctgttcccctctgcactggctgccactgcacctgctcgaaggggctgtcctggatctcccttggtgattttgtgggggtttccttcatctgcctcccatgttggattccttgcttgctgtccttgtctctcagattacccccttgttttggtgggacgcatcctccaaaagcttcctaaattgccacaggggagagaaattttttgaggcctcaaatgtctgaaactctttattctgccctctcacatgatgagtagtgtggttgtgtgtagatgtgtgtagaattcttagttacagatcagttgcgctcagaatggcggaggcagtgcctgtggtagcaaggcatctagcatggctccggagtttcttagtgccatctgatgtttttttagatggagtctcgctctgtcgcccaggctggagtgcagtggcatggtcttggctcagtgcaaactctgcctctcgggttcacgccattctcctgcctcagcctccctagtggctaggactgcaggcgtccgccaccacgcccagctaattttttgtatttttagtagagacagggtttcaccttgttacccaggatggtctcgatctcctgacctcgtgatccgcccgcctcggcctcccaaagtgctggattacaggcatgagccactgtgcctggctgatgactaaccttttttaagtgctgtggttttgggttttggtttggttttatctctggaaacttttaaactcagttatttattccttgtattctgagatgttttgatgtatgccttgatgtgggcattttttctttagttttgctgggcacttggccttcagtctggaagcacatattatagaggtctgagaaatttatatcatttctttcagaatgtcctcttaactccattctttattctttttctctgaagcacgagttaattgacactcatttgctcttaaaagttcctttttacagcattctgttcttgttgcatgtatatactatcatctctgaggataagcttttgttgaagggttttatcactccctgcattgtctttctctactgagagttccttttttagtgtgttaggtccctccctgtcacacgcaaggctttccccaaatgtctggttggatcatgtttaagattgaaacattaggccaagcacggtggctcatgccagtaatcccagcactttgggagactgaggcgggcagatcacctgaggtcaagagttcgacaccagcctggtcaacatggtgaaactctgtctctactaaaaatataaaaattagctgggcgtggtggcaggtgcctataatcccagctagtcaggagactgaggcaggagaatttcttgaacccaggaagcggaggttgcagtgagctgagatagtgccattgcactccagcctgagcaacaagatcgagacttcgtctcaaaaaaaaaaaaaaaaaaaaagagattgaagcattaaaggctgactggaagtactgagtgaatgggtaaattgttaaagaatgggtgtctcttggaccacaggcagccacaggtgtcaccttctgtaggttttttctctgggcaccatttaatttctctggaaaaggccccttcagtcccttggtggagggatgtaagcctggctgctggggtacagggctgtgcttctcatgtggcagagcgcaaactcaccaggcagccctgttgcaggcaggcctcaccgtgccttccctgttggtacccacaggactgtgcatgcggcgcctgtggccctgcacctggaagctgggcatcagtttctctgcgtgaagggccagcaggagtgaggaaggagtggagcctcacttctgggatggagatggggatctgggacatctactacgtacttggactttcaataaaatgaaaacttctccaagtgctacccttgcctcttctgcctccatagcacctgcatttcacttgctgagcctttcctgggtgtcgtggccatttatagaggttggcatttccttcgctcagctagggcatttgggcggccctgcagcttcctgtccctgtagcgtggggcttttcgtgggcggcttccgcatgccacggtgggttagacaggcgagggactggccgggaggaggcctgtgcgagaaggaagggggagcagccagaggaggcagcaaatgctagctgaacgcagtgcagtcctggcccctcagaggcctggtccagactgcggtgcagctctgagggcctccggtgtcacacaggaacgggcctgcctcagcatccctgcccggtcggcccctggctgacggctctgtgggaggtgtgccctggcagggacagagggtaggtgcagacaccacactgggccatctgtcactctcactcctgtggcgggagaccaaggagtgcatttccgtggaccccacagtccaccctggccccctcagctctacttctccacataagttgggaatggctttcctgtggcgcccatggttctctcttcctcaggggaaatctggaagacagaggttagtgggacaccctgtagtccctgtcactgtggtctctctgctggctctttccctaccctttcctgttattcataccctcagctctcacattggcaggcctctgtggcttgcctggcctgtgtcccaggccttcattcctgagccgtctgtgtctggtggctctcagtgggccacagggtcccaggccacccagtggccgtctccccagtcctcagtgtgtagccggagcggaggcgcttggcaggtggagtaacgcccacacgagttccttggcctgtgagtaagagtcgtcacagtgggaaggccaaatggaaacctgaaactgcccccaagatagtaaatcaaaaacaagatcacaccctgcagggcccggggtgggtggaggagactagggccaccatggaagcctcaggggagcagagacagtggtatcttgcatcccagtctaactcgttagtccagcccttgaagaagctgcatggattctggagaatgaccccagacggccacaggcttacggcactggcagtcctggccgcagctgctgtgcatgtcaaggtgcagttgttgctggagcagattaataaggcctcaggtctggcatgttgatggggcaaatgcatcctccacactgattagaagagaggcccagacagcgcccacactgctgcaggctggacagcaatgttctctcacagccttgctctaagcctttgctaacgttcccaccctcccataacatggccgcaagagacctggcccagacttcacttatgccctgacccctgacccctgaccccacgaaccctgcaagtggaggagccctgagagtgtttggggtcttcgggtttcagtgtctacttagagctgtgtccattcatcctcaagagtgcctggctgttcttacccggtgggtggccacaggtacctgtggggaaggaccggcaaggccagacagtggacacctgtcatgatgtgctccttcctgggatacctctcaagcagtgggtctggatcccagagttgagcgggcagtgggggaggtcagcacctgccccactcatgctgcgggtgctgtgggtaccctcactgctgcccacagggtagcgttgggttccaggcattttgggagccaagccccgatccaggcgtcacttggatctgtacttggcatttgtcttctttgttctgagtgattttcaagacttgaaggggcagaactgtctttcctctgctgtcttgaaattgaagtgaggtgttgggaagctgcctcaggttgtatttcgggggtgactagagagggtcccagggtgcggggagagcacctccttagccacctccccattggccacacagagcacccacacaagcttgggactttatcaccacagtcttccagcagacggcagtaaagtgtgcttttcctgttaaattagtatgtgatgacagttttttgacagatggcagtgtcttcagatgagcgtgtttctggcgcactggggttcacagagctggcaggcagcccgtggagatggttccactgctgcgtctgtccttggtagaaccaggctgtccttgtcttccttgctcctgcggccgtgctgttagttctgggtgggctgggcttcagggcctgctggctggggaagtgtgtgcatttcacacctcagaaatcagcctcctggagagaaagtgcccactgcacaccctctgtggcctgaggaagcgcctgtttctgcttctcccgccagcaccgagtctgcttgctttccatcgctgccaagtgatagactaaaaatgggcattcattttgggtttttaaagaagatttttgtgagattgagcattattttatctgttagtaatttatgttctaaaatgcctgttcttgtcatactctttgattttaaaaaaggaaacaagaagcgaattcgttcatttggtcttagctccctgacttggtcctcacagcggagcgtccctggttgaatgtgggctgcttctccctggctttccttcatgcagggaggcagcccggtttcttcctctcaggcctttctgggaaccgggggtgtctgcacagtactctaaggtggaatggaggggctgggggcctctttttggggccaggtagagattgtgactgcatttttaaacattatatgtttatcatttaaatcttacagaatctaggaagcctagaaacaggtcacttagcagcatggcagtgtaattgtacctgttgtcaatgtcgaaatggcttcctgcttgccctgatgacagccccacagccttcactgaggcatgccgcctgcaaccccccttgtggcccatcagttgggatgtcttacaggcaggtgctaggcagtgctactgaacctgcaacttcctgggtaaagtatcctcatgccttacgccatgtcagtggcttggcagtttgacattgcaggtgcactactcttgtgaaaagaatgggtgtgggttgtttacaagtcacagtttctcaagtgagtttgcaggccgaagtccccaggcaaaagtcaaattcctaaggcctgaggaaggggctagggtggaggatcagcaggaagaaaatcccttagttatgagggaaaaggttgcagaagttgtgttaaggctttgcaagtcaggtggaatatgatgcatgtcttcattctgcagacacttcccaagtgtctgctcgcgccaggcgtgcttctgagtgctgagagctcacacagagtcagcactggggagggaagagaggtggcaaccagaacatgagcaggtgagtttttgtgccacgtacagatggagacagcagcaccagtgctggcgtgtctttgtggcgaaggtgagaagattggaggtggatgatcatggaattgctcttccaaggagagaaagaaccatgggaagattccaggatcagacgattctagacctgtgctgtccagtatggcagccactaaccacaggaggctgtggagcactcaggatgtggccgtgctgcagttgtaaaatacatactggacttcaaaggctcagtactaaaaagagaatgtaaaatatctcagtatttttcttatgttgattacattttgaaatgataatattatggatatattgggttaaaaaaatatactgtatgattaaaattaatttcacctatttctgcatgctgttgagcatggctagtagaaaatgtaaattatacacatcgttcacattatatgacattgtctgtgggacagcactgccctggactgacagacagcatgaggaccttagcaagagagagtcagagtattggggaactcaagtccaggcgtggagagcaggagggggccgtgtgtgctggactgacagagagcatgaggaccttagcaagagagagtcagagtattggggaactcaagtccaggcgtggagagcgggaggggggcatgtgtgctggacgtgtagatgcatggatggagggtagataggacagcctgagggcctgcgagaccacagaaagggcaaatgggggccatgaaggtttccactgggggtaaggggcaccatctgacggctttaggctgatttgttttagtttcaatttgagagtaagattttccaaagttgttcccaaatctcagagttcagttcactccctacactctcacactggcttcacgaccctcacggatgtgaagtagtttatttagcatgcttcattcattttactaatttaagccatttctttcctaggatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacggtgagtatagccggggctggaagaggctgggatgtttagaaattgctctagcggtggtctcgagttttttctctttcctttgaaccatatgatatatactgtggggactgttacacccagaatatagcatgatccagagataagaaataattaattgtgtttttccattggttaaaatcattctcttttaaaaattcacttttaaaattgttatttttgaactttttaatcagagttaagctgtctatagccaagtgtgcaaatcctgagtgtgcagctcagctgaggtgagcacacccacagcagcagcagctctggcctccccatggcccctcctcgcagcccacgaggctggccaatctcctgatctccagtaccatggatcagctttatttgttggtctgcatattgtttttttgaatttgatgtaaatagaataacacatgttttcatgtaaaattggtgtctttttacatcaaaacttagcttattctagcaatatcagagctctttgaaacttggcttttagcaaatttgttgaaaataacgaaatcacgcttacttatttttaaaaagactgaaagtttgcccgggtcatctgaaatgagttttgctacaggttcatcttgctgcgttgtagcttgtgttcccaccctgaggggcacagcttcatgtgcttcctgtggaggggagagaaaacttgatcccctgttcacttctcccctcggcccgccagcagggcacttagaggcctctgctgtctgtctgaggccccacagatgagggtgggcaccgtggaagtctgggcccctctagcagggcctcacctgcagtcctgcaagccagccagcctgtgccgccagtgagtgctgctgcctttctgacggggcagtctagaaaatgatcgctcaggaggtgtggtatcaacaacgcacagaggctcccgccggcaagctagtgacgtgtaccgggtttgtcctgggagggggtttgaagaaaaaagatgggggactctagctggtttttaatcccctggtgtttggtagtggacatctggtctgtcgggtgcatcatggcagaaatggtcctccataaagtcctgttcccgggaagagactgtatccttcacaggggacccggtacttggccatggaggctggggtgggcgtgtggccctgaaaagctttgtgttcacaggcacttcttgtttctggttttttgtttgtttgtttgtttgttttaagctataaagtattggactctttggcactaaaaccccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacagtagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatgttcagtttgtctcaattcttactcattttgtgccattccttgttttattacaaaatgttttcttcaaaaagtacaaaaatgaaaaatgtgagtactttttggtgcattttagtaagtaaaattaaaattcctgctatacatatgaacattaatgtcagtaattaatagtgttatatataaggttacctaatgttattcccaaaagccacacagagtttaacatcattttctaaagaaaattttgccaactctttcaaatattagattgaaatttgggagatagaaaaaagttgcagaaatcagactgagggtctcagagatttgctttaatttgcgacccggggtagaaaaggaactcctgtccctgcggtggtctatgagaaagagaaagctttagcccggccacctcgggccccagctcagactcctccccttggcagccatgcatccttgagaaatttagggcctctctgagccttggtttccccttctgtaaaatagacctgtggtctgcctgcagcttcacgagagttagacaacagggtccactgggcttgtcggaattattgttccccttcccccgtccctctcatctgtcccccatccctcccacctgtaggatgctggggtggagtcctctcggggaatctgtgggtctcctctcacaactggtttaatttctagtcctttatcattaacccagcagatatttctctcacctgcccatttctgggtgcctagtctgactgagatgcaaagaggctcctcccagctgctgaattgagggtggatcgtcaagggcagggcagagcaggagaacagagcagaggctgccatcatccagaggagaggtggaggcccccagcaggcgggtaggggtgtggccggggagatgggcttgtactctgctttgaagctggacccttcaaggagccttgctagggtttggagatgtctgttagacagtggaatttaggggcaaggtctgggatagagagatcaaagtgggtgtcatccgtctgtcggtagccttgaagcctaggactggtagcgagcatttgcaggggaggaagagaccaggacccgggacttagcccccttgaggtggagggacaaagggaatagggaaggaaatggagaaggcactcacgtgacccctcctcctagagtgtggtgactgagggaggctcattcacatgaggagatgaggacgggggattggcccctgggccttgtgatggctgctggcagccatgatgggcacagcatttatggagtggagggaagaaagcctgatgggagtatgtttgagagaaaatgagaggctgggaattagagacacaagtgtagacagctcttttttctttcctttttttttttttttttcctttgagacagagtctcactccattgcccaggctggagggcagcgatgcgatctcggctcactgcaacctctacctcctgggttcaagcgattcttctgcctcagcctcccgagtagctgggattacaggcgcccgccaccacgcctggctaatttttgtatttttagtagggccagggtttcaccgtcttggccaggctggtcttgaacacctgaccttgtgatccacctgcctcggcctcccaaagtgccgggattacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatggtgatgtaagttcatttttttaagacatgcctcagtgagcacttttttaagctgctgttgatgctatttttttctcacttgcattctcttgtatagcgagtacagtttcagtgtcactttcccacatgtaatcctaattatcccaagcctaacaagcaccctgtggaataggcaaagctggtaatgtctgcattgaacaaataaggaaacagaccccaaggaagcctgactttcctgacacactgagtgtttaatgcagagttgagtctgaaacccaggtcacgcactttgaaaggaaataaaatgcattacctagggatcgcagtgatggttgggaagagtcagttccaagtaaaatagagcatcatttgaaagctgtcgctgggctcagtctaagcccagttgcttggttcccagctgtaaactgaggaggtcagataggtctctccacaggtcccttgagatcctctgttctttagagagctgtgaatgaatctaaggtagcattagtatgaaaactgatttcaatttgcttatgtaatgtttatctaatttcgtgtttaatcatttttgctataggtattcttagttataagataaactttattttgaactagagtgggaaggtgtgtagacttcattgtgttgatttaataaactgtgatcatagtttatgaagatgcagagtgtgagagttttaaaaaatagtgtaacttggaaacccaaaccttatttgaatattatttcaaaattccgctgctgatccagtggggtggcctagtcgataggtttaaatattattcaagtgatgctgccgcatgtactgtgaatacaaggtacttcagttgtattttcctcaagaaactccttagatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaagtaagatatcctttttttcttatacttgtgttttgtaattcaggtggtgctttcactctttcatgtttgtattctaaaaacctgtgttttgggagagaaagtcattttaggcctgaagtctgaggtacgaaggcactgaggagagaaagcttaaaggtctagaagctttatcctctataagacggcttaattgaagcctttggccaaaataaaaataatcaaatcagtctgaaagaatcttatgttacagttacagcaactggaattcaaaaagttttcaggtaagaagaacacttaatgcagattctagagtcagaagcgatgtgacagttgttcgatgaaaaaggtccttcctccccaccttctcctgcaccctttactacagtgtgattgtttaaggaaaaagaaaagatttgattctgtccgcatgaaggtaaactgtgccttaatcagaaaagccccagtctttgcttattcaggttgtgaactttaattgacaaaacctaggtgagccttatatttaactaagttattgaacttgtttttctttttcctaaataccaatctgtagattaaaaaaaaaagtgtaagttgccagcactgtatacagctaggccagccagaagcatctgtgagtgttttatcctgtgggaatgtgagattgttgtgtggtttgaaaagtctgttctaatttcatttcgatgtgacttagagaaaaatactcccccgtgcctcatgcccacactctgggcagtgccacccgcagctcggcaattgccaccttccttgctgtggtttcccagccttgggccctgcccagacattggtctgaggctgcctggtgctcttccccaccaccctgggggcccaggtttctcttccccttgcagatccagaggcgtaaaactacatttggaaacctggtttgtcatgaaagtggacatttgactttttcttaaaaatgtttgggttatggctgggtgcggcggctcacgcctgtaatcccagcactttgggaggctgaggcaggcggatcacgaggtcaagagatcgagaccatcctgcctaacacagtgaaaccctgtctctactaaaaaaatacaaaaaattatccgggcatggtggcagacgcctgtagtcccagctgcttgggaggctgaggtaggagaatggcgtgaacccgggaggtggaacttgcagtgagccaagattgcgccactgcattgggcgacagagcgagactccgtctccgaaaaaaaaaaaaaaaattttgggttatattcatcttgaacctatcaaacatttctcaaaattaatatatctttgttctatctgtgttgtcatatttagttctttattgtatgattctgtttgtttcatattaacagcattaatttaatatttgttgtcaccctagcaagtcaagccagagatctgttatcaaaaatgttagtgattgatcctgacaagcggatctctgtagacgaagctctgcgtcacccatacatcactgtttggtatgaccccgccgaagcagaagccgtgagtatctgttttgaaaagatttatatagagaggccaggcttatatttccttggatcttgtctgtccgtccagagtggctacatatgggtagcaagttctccatttgggggctcccagttacagaaaggccaagtgttgtctgagacctgggtcgcttgctcttttgctgctggagccccagctcagagtacctcgggaatgaacttccgctttggtgctaccagtctccattttgcaaatgctgctgtgagctcatagtttattaagcatctattctgtgccattggctttggttacatcctcttgtttaggccacttaaccagagaggctgagcaacttgctgaaaaatcacacgtctgtttatccttccctaaaggcattgtagctcctggttcccccgctggaggagctccactctgagtttggtgctcacgtgcgtgtttctgtgtcagcactggtgtgagtgagctttagctgtgagggaaatcactgcgtagtggcaggcttccttcatgccatgagtgaaatacatgtttatgtcatggcctgtggttttgccatcagtttaaacattgttttatataaaaagaatccaatttataagcagacttttataacagtccatttatgagttggacattggatttgggagttctcccatgaagaaaatgtaaaatttgttctaagaaacaacagtaccttccatagctgccagcacagtgccttgtccataatgggtctctgggaaacagcctgtgatgatgagtttctaatgacatctgggcagatgtctgcgttttgaggtcaggtgattattaagaggaacataataactcttctttggttaactttttcataattattttgattctaaagttgatataatatcacatgacaaatctttattaaaccacgtgttgaattaaactaaatccatatcataaatagactagaagtcttccaagcaattttaccttttttagtgcctcatttttttttgaggcattactgttgactttacatatgatttaatttttagccaccacctcaaatttatgatgcccagttggaagaaagagaacatgcaattgaagaatggaaaggtaaagatggagcttattttgatccttccttttgacatttcttccaatcctgtagagcagaggcttttcattttgtgacatttcccttcaggaaggggcaagaaaccctgcgacccacttagcctctttctccccagtttccagtagaaaatgaacttgaagagaacagagttagagaggaacatttatgaatttcttatcatttgcttcaagagggaaaaataatatttttttcatggcttttcacatattgatttataaactgagcttagtaattgtatcatacttatattgattgatatgtttttaagccatgtagttgtacatatgttttaaaatctagtttgggggaaattgcagattgaaaatatgcaaataggtattattaccactataagattaaccaaacaacccacaacaaactatacctgtaatgaagaggttgaactaacaatttttcattaagaagcaggatcagtagtaactgagaaccacagtcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacatattcaaatgggtgtgagaatatccaatcccctacagtgttctgtgggagccactccacttcataaagcccccttatggatccagaaccaccctacatgttttgctgccttactagttgcattgaaaaagatgtaatgtagtccaggcgcagtggctcacacctgtaatcccaggactttgggaggccaagtggggcagatggcttgaggccaggaattcaagacaagcctagccaacatagcgaaaccctgtctctacaaaaactacaaaagttagccaggcatggtggtgaacacctgtaatcccagcaatttggatggctgaggcatgagaatcacttgaatccaggaggtggaggtttcagtgagtcaagaccatgccactgtactccagcctggatgacagcatgagactgtctcaaaaaaaaaaaaaaaaaaaagaagaagaagaaaagaaaagatataatgtatcaaaacatgaatattttggtccaggtagactatattactgaattgactctgtcttacaattaaaaataacaaatcgcaatgcctttgttccagttgatttggaagcagagtttagagatacagtgaaactgtttagaaactgattaagcattttaacttgtatttttattaaagagctaatttacaaagaagtcatggattgggaagaaagaagcaagaatggtgttgtaaaagatcagccttcaggttagtgattgctttaattgattgtatgatatttttctttccctattcaactttttttttttgagacagagtttcgttctgtcgcccaggctggagagcagcggcgcgatctctgctcactgcaacctccgcctcctgggttcaagcaattctcctgcctcagcctcccgagtagctgggactacaggcacgcgccaccatgccctgctaatttttgtatttttagtagagacggggtttcaccatattggccaagctggtctcgatctcctgaccttgtgatctgcccgcctcagcctcccaaagtggtgggattacaggcacgcaccaccatgcctggctaatttttgtatttttagtagagacggggtttcagcatattggccaagctggtctcgatctcctgacctcgtgatccacccgcctcagcctcccaaagtggtggggttacaggcgtgagccaccggcacctggcgtctttcccgattcaacttttataaatggcagcaacatgtgaaatgccagcctggctagcatcagatttaaaaaccgctgtatgaatagccagcctttttggcttgtcatagtggtggtggtggtggatgacattttactgatgtgccaggcactgaactttgttataagcatttctctttcatctttgcaataactgctgtcacctccatttacagatgaagaaattgaatttaaagccttttcaatgttgataaccctttgtactggtcccacccaaaatgccaatctaagtaaaatggagtatggtattctttttgagaaaattgttgatatcattttcccatttttctgcttgatctactgatcttcatagtggtggaagcctctaatgaccaggtagttgtatgatcatgagactctgatatgagtcgtgttcacttacgtctgaaggattcttcctgtttactaaatgaaacgctcacgttatatcattgtctctctcccactcccactgggaagcatgcacacacatgtgtgcggatgtgcagagagcacagcttactttttattcttgaattttatgttcaacatgacgtatgtgtcaagcatctagagattatataacttcagcaagaacttaggtgcttgttaactgagcacacacgtatgactgcagacgtcgatctcagagagtgcatgttgtgtttttattcaaaccagactaaaatatggatagtaggaagtaggatagtttcatttgctttaaaagattaaaatgtcagttttctggagttataaaaccataaaatatacaaggccactaatttttttcctttttctggtatatagtctttatttattgcaaaagatttctttgaaagttgatgctttttttcctgtagatttagtgtttatgttataaattgttacaattcaagtgtctggtgacactggaatcctagtcaggcttaagcttttgtgatactgcattttcagataaatatagctgtgtccttttgatgtctgcttgaaagcagcaggtattttttaagtagctaacatgattatacatggccacatatatgtttagctactgagaaaaaaagaagaatcttgcaaggaaagacataggaatatgggactcttggcccaaagaaagactcaaggaaaagttcagaaagtccagctgactgacttcttgtctatactcatagttaggattgggaaactgcaaaaggacagagccgagaaatggcctgcagtctcgctgcctggatttgcagcaatgtcgtgcctcagattttattatatttggttttcttagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttacttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgagctgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctc

SEQ ID NO: 17089 - DNA, 14989 bp, Human
acccagtgctccgaaaggaagtggatttcggaagtggagaagggaggtgaccagcggggcccagtgctccgaaaggaagtggagaagggaggtgaccagcggggcccagtgctccgaaaggaagtggagaagggaggtgaccggcggggcccagtgctccgaaaggaagtggatttcggaagtggagatgggagttgaccagcggggccacagtgttccgaaaggaagtggagaagggaggtgaccagcggggcccagtgctccaaaaggaagtggatttcggaagtggagaagggaggtgaccagcggggcccagtgctccaaaaggaagtggatttcggaagtggagaagggaggtgaccggcggggccccagtgctccgaaagacagtggatttcggaagtggagaagggaggtgaccggcaggccccagtgctccaaaaggaagtggagaagggaggtgaccagcggggcccagtgctccaaaaggaagtggagaagggaggtgaccggcgggcccagtgctccgaaaggaagtggagaagggaggtgaccggcggggcccagtgctccaaaaggaagtggagaagggaggtgaccggcgggcccagtgctccgaaaggaagtggagaagggaggtgaccggcgggcccagtgctccaaaaggaagtggagaagggaggtgaccggcggggcccagtgctccaaaaggaagtggagaagggaggtgaccggcgggcccagtgctccgaaaggaagtggagaagggaggtgaccggcgggcccagtgctccgaaaggaagtggatttcggaagtggagaagggaggtgaccagcgggcaccagtgctccgaaaggaagtggagaagggaggtgaccggcggggcccagtgctccgaaaggaagtggatttcggaagtggagatgggagttgaccagcggggcccagtgctccaaaaggaagtggagaagggaggtgaccggcaggcccagtgctccgaaaggaagtggagaagggaggtgaccagcggggccgcagtgctccgattggagcttgttctgattggagcttgtctttgccccgcgccttgctccgtgcggtgggtcctgactcccagggcctgccctatggagcctgagagtgcaaagcattctgtggtgtctgtcctggagatggaccagcttggtgcagtatgtggaactcaggaggcggagtgtcttgtgaatggagctcaggcagggcagcaggtgcctggatgagcctccaaggcgggtcagggttccgcgcctgggggagaaagggtgtcagagggggaggagcaggatgggcccagggcctggtcttgatgagccatccagcccagcatggccgctggttggagggaagtgtcaggttgtctgcagttacaaaaacctcccttatgccgtaagctgggaagagaggggagtgggggtgctggggtggaggtagaggccagtccagaagggccctggccctcagggctcccaggtagagaccatgagagggagagagacagccggtggcggagatgcctcaggagcccaggaggagggtgtcaggagtgatggcccggcttccagggtggggacagtgagtggacagagcgtgcttgtcaggggagatggtgagagtgtgcaggggtgcgtttcatcaggaggctgcgctggaggtctagggctggaggaaggtgtacagtctaccccgatacccctcccctgagagctgggagggagaggggcccagacagacccaggagaacagcagcagggagataccttcaacccaggcagaggaccctgttagggggtgccagagcatctggcctcagccctctcttcccatccaccacgggacacgcttccctccgtctccccatccaccgcgggacacgcttccctccgtctccccatccaccacgggacacgcttccctccgtctccccatccaccacgggacaagcttccctctgtctccccaggcccggctgcccctgaagtggatggcccctgaaagcatcttcgacaaggtgtacaccacgcagagtgacgtgtggtcctttggggtgcttctctgggagatcttctctctgggtgagtgcaggatggggtgccggtggggagaggaggcgaggtcactggcggcaggttacgtgaccggccctgctggagtaagggactgggcacctggaggtgtgtgccaggtcgttctgaagcaggtggtttgtgggccaccaagggccccccacctctccccagcctggcccagcctccgagaggactttgcctccaacgtgggccaccctctgtggggtgcacattgaagcctgagccaggactgagccttttcacatggcagccccagagggagctcagtgcccagtcagcagacgtgcctactccaagagctccaagagctccatgtgggaactcaggccccgctgcgagcatgatgaagtctccaggccagggtagggcagtgaacttgaaaaagttaaaatgtcaccaagtggcaactgatccacgctactgcggaaactaaaggagcaggaagagtgtaggaggcgtgggagctcgggtaagccagaggggcccaaggagggagttcagcagtccaggacggggagcagcaggggttgggaggagcagcaggggttggggggagcagcaggggttggggggagcagcaggagaagcagcgagaggcaagagaggctttgttgaaactgcctgcaggcggctcccccgccgctgatgatccagtaaccatgatgtctaccgtgtcgccagtgggtggatgctcttggcacccctagcaagcaggcggcacagtcctcttttaaccaaatgaactagagctggggagggcagcgacttgcccacaggtcccaggtagagcacagtcgggtgagccatctccaccccaccacggatggggaaagggacaggacggggtgacttgatggggaagggacaggatggggtgacttggggggctgggctgagccgcaggaggcttgctccccacccacctccccttcctgttgtcaggggcctccccgtaccctggggtgcagatcaatgaggagttctgccagcggctgagagacggcacaaggatgagggccccggagctggccactcccgccatgtgagcctccccatggccctgcaggttttggggacagcaagcgtcgggggcgtgggggttgtgtccatgagaaggtggcatcagggaagccagggccagtaggacaggcctgggcaccaccctcaagatacacgggtagtctgtagcacagctgcaccaggaggacaccaggagggaaggccgggcgctgtcggaacagagccgagtgttcagggaaagcatcaccaggaggggacgctgggctaacacttgaaggaggaacgagggtagctggacaagagtgggagacgtgtcaggaggagggcagagtgggtgagagggcccaggaaggctggggcactgaaggtcctgggacgggggtggggtgcatgcagtccagcagcccacgtgatcctgcagacgccgcatcatgctgaactgctggtccggagaccccaaggcgagacctgcattctcggagctggtggagatcctgggggacctgctccagggcaggggcctgcaagtgagccccttccccaccctgttctactatggcctttggcccctgccctgggtccctggcccgagctgcccctccaagcccatctaggctctgcccacctctcagctgctaggctagggtggtggggtcctgggcccctatccacacctcgtccccacacccttgcatctttctgttgagtacacacccgctgcacagctccactgcctgctccaggtgctgtgtggatagtcagagcctgtccctgcgcgaggggaatcctaggctggtcccccccggcctgtgaggcagccccatctccctggcatcgtcatgatgcattccttcacctggtgccagttctgtcccccactccactgaacacacggacccttgacctgtgtgtgctgacatctctccctccccacgtggtgctcctccagggtgggggatggagccggcttgtgacccagctcaaggtggggcctggagcaagaagcagggggtggcctgttgcccaggccttagggactgggatgggtgctgcgggtctagttccatccaaagaagaaggtagggagtgctggccccagttcctgaggctgccagctcagctagggactggaggagggatgatccggctgagccccagcctgccccacctgcctcatccataaatgtacctggaagggctgttgggagaacttagcgaggctggcacagccagcattctgctaccttgaccccttatctgtcttgatggctgagatgtgctggtttctggcatgagctcgtttcctctgtggagcactcacgtgcccgcatggtctgttagggccctatctcgggtcaggagcccaagcagtcccgagggcagagcgagggctgagggcagggcgagggcgggggcgagagctgagtgcgggggcgagggctgagggcgggggtgagggctgagggcgggggtgagggctgagggtgggggcgagggctgagggcagtggctggtggtttctggcctggctgcctctcctgttcccgccaggaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtcagctgtcctgcaggtccaggagtagggtgggagaaagccatgtggacaaggtgcattttatccctctgcgtcatcggggaaaagcaaatcatgcgacgtcagaggccagtgtgcacaaactcagagcacagagtggctttaaatgacccactgcagggtccttccacggccgtgtggcctggctgcgtgcttgtttttgagtcctgtccacccaccagtgtcccctcaccccaacatcaagggtactttttatttatttatttatttttttgagacggagtctcgctctgtcgcccaggctggagtgcagtggcgcgatctcggctcactgcaagctccacctcccaggttcacgccattctcctgcctcagcctcccgagtagctgcgactacaggcgtccgccaccacgcctggctaattttttgtatttttagtagagacggggtttcaccgtgttagccaggatggtctcgatctcctgacctcgtgatctgcctgcctcggcctcccaaagtgctgggattacaggcgtgagccactgcgcccggcaagtgtactttttctcccggagaggtggagtggactgtgtttgggccaagattcctcccaggaatctctgattatctaaatcactgattagtctgggggtgagtccccaagagtccctgggagcagggaaggtctccaactatgaggcgtgggcaggaggagaacgtaacctaattcccggaactctgcccaggctctcttatccctggcatttcacactcaggatggctgtgctggccccattcacagcagtgttgctgagatgcaggctctgcgtcctgtccctctgccctagcatacggcagggctaggcctgggggacaacaacagttagctggattctgccaggctccttccacaaacccctcaacgtgtgccttagtgcacccacgtacgggcagggcagtcggcggcttgcagccccagggctgcctggctggcccagggtagcccatccccgggaggagctccatgccacacggggctggatgccccctcacttcccatcacagagctcagcagtggactcgggaggaaacacagcccagggtgctgctggggctgtggggtagacatctgaggccaggcacacggaggagcccctgccagcactcaggcccaggcccatccatactcctgccccaggcggggggtcctttccaggagaagagggggcacagggacagtggagagaagttcgaggagggttgctgcagcgcgttcctcagcaccttctgatttctccccacaggtattacaactgggtgtcctttcccgggtgcctggccagaggggctgagacccgtggttcctccaggatgaagacatttgaggaattccccatgaccccaacgacctacaaaggctctgtggtacttcacatgaagggtgggggctgcgctctcggctcagggctggggccgcctcaggggaggcagcgtcaggaattcgtaaggcaaatggcagaacccaacgactgtcctttgaaagtgcaagtccagggtgagccttgggcacatttgggccctcctgcgatgccacgactcacagctgctttctgtcctatgccctcgtcacccccacacgaggcctcccctcctcagcagcgcagaaaccccagtggaaggacggctcctcctcggtggcaggttcgggggtcccgggcctggtcagtgagcgctgggcagaggggccccatgggagcccttggccagaccacagggacctgggttcctgcctccagggccacttggagatgttgggggactctgaaaagatcgcagtttccctcccgtgtaattcaaaataaaaaccacaccaagccacagtcgaaggataacaaagccccccaaaccgggaggcagcctcacatggatcgttttttgaactacgagctgccaggttgtgaggcctctccctgcttctcccacggctcctgctcttcacacactgagcatatgcttggccaccgtggaggtccccaagtatgaggcgtccacgggccacacacagcccccctgacctcagtgtctccctccgtggcaggggcatgtgaccctcaccctgggatggaatggacgccttgtttctggctcagcttcccagggacaggtgttaggtcagccgcgctgcaggaccatgccgcactttcctggctgggggtggctgccctgcaggagggcctcaggcgggacccacagcctggcttgtcctctccacacaggacaaccagacagacagtgggatggtgctggcctcggaggagtttgagcagatagagagcaggcatagacaagaaagcggcttcaggtaagggcttcgtgagcctcctgcactgcaggtatcgatgttgccctcccctggaggagggaggctggggtctgggtgtgcccagccctcttcccggaacctttcgtggctccctatggccttttcgcgcgttcaaggtgagctgcctgagacccctcctgacctacagcaccgcgggagcccctccctgtcacatgctggccacgtgggcgctggtcccgacacctccctgtcatctgacagagctcagatgctgtgtctttctgacaccacacgtaacccaccatgcccagggcacacacactctcctccaggttggggaggccaccccagccccagaaccccggaacttcacccagtggctccagaagccgggtagatactgtaatctgaactggctggtgtagggtccggccctgtggggcttagcgggtgttctccccgtgtgtggagataagagatcataagaaagaaagacacaagacagagataaagagaaaacagctgggcctgggggacccctaccatcaagacgtggagaccggtagtggccccgaatggctgagcacgctgatatttattgcatgcaagacaagggggcagggtcaggagggtgagtcgttcaagtgattgataaggtgaagcaagtcacatgatcatgggacggggcccttccctcttaggtagctgaagcagagagagagaaggcagcatacgtcagcattttcttctctgcacttataagaaagatcaaagactttaagactttcgctatttcttctactgctatctactacaaacttcaaagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctgagtaacaggtgccttcccagacactggcgttactgcttgaccaaagagccctcaagcggcccttatgccagcgtgacagagggctcacctcttgccttctaggtcacttctcacaatgtcccttcagcacctgaccctgtgcccaccagttattccttggtaatatgagtaatacatcaaagagtagtattaaaagctaattaatcatgtttatactaatgactgataatgtccatgatcatctctctatctaatttgtattatgactattcttattctattttctttattttatatatatatatgtatgtatgtatttttttttttttgagacagtctcgctctgtctcccaggctagagtgcagtggtgcgatctctgctcgctgcaacctccgcctcctgggttcacgccattctcctgcctcagccttccgagtagctgggactacaggcacccgccaccacgcccggctaattgttttgtattttttttagtagagaccgggtttcgccatgttagccaggatggtctcgatctcctgacctcgtgatccgcccgccctcggcctcccaaagtgctgggattacaggcctgagccaccgcgcccggccactgttttctttattatactgaaacagtttgtgccttcagtctcttgcctcagcacctgggtgatccttcgcccacaggctgggatgtattttggcaacagagaaatacccacatatcccagatagaaagtgaactccatttgcccaacatgacagccaggggaaaaacagttttggccattttgaatgttgaaacttttaagggtatagatttaaacaaagacttcagtgtctgcttaaaagattcattttatttttatttttatttttattttttgagacagagtctcactccgtcacccaggctagagtgcagtggtgcgatctcggctcaccgcaacctccacctcccgggttcacgtgattatcctgcctcagcctcttgagtagctgggattataggcgtgtgccaccacgcccagctaagtttgtttgtttgtttttttttttgttttttttttttagtagagacggggtttcgccacgttggccaggctggtcttgaactcctggcctcaagtgatctgccctcagcctcccagggtgctgggattacaggtatgagccaccacgcccagctcatcaggtgactcctgttagtacctggttttggaaaattaatggtggtcacatttacggaaatagctttgggctaatttttcgtcaccaaacagcatttcgacattcaaaaaacaaggtaattaagtaaaaggtgtcacagagaatgatcgccacgtaaattcaaacctctgcacaccttcgagaaacagcacagctccttgagatcaaagaaggccgctcagcccaggcctgtggctcagctaggagacagactccgtggaaacgtgagttggggactcaacgccaggacccgcacggctgagcctgcaccatggtgggagagtcagatagggccgtcccgtgagaggagagtgtgacgaggtccttggggatgtggcaacacagacccaggggtgacggaggagatggggctgcgaggagagctcccttgccaagcccgaggcactgggcagccatcttgcttctgaaagggcggcgagccaaaagggagtgcagccccttggatgcttggtggtagaggaagaagaaagttccagaagacatgggtcctaaggaagcaagatagtatccagaagtcagaagaagacacatgatggatttgttcatttgagaaactgcaccaccctgtatcggcagcagagggcactgttctttgtcctctgtcgacaatgagccaagaaaaggtgccacaggtctctggcgggtgcatccgcttggcatacagaatgctgtgcaaacaggtgcaaggagagaatgtgccttggtggggtgtggggagaagaaggaggaatctatctgcctagtccttcgctgtctcctgttaaccactggtcggcactcgccccatgggggttcacctcctcactcctgggttacatcatccagccccttcagtacccacttaggatgccagagcccgtacctatagatgtggcttttcacctgcatctgtgggtggaaggagatcaggaaactgggcttgtggtcactcagcatggctgcgtgcagccagtggagggcctagctcttctgggtaagagactagctggcccctggtggcaggatgatacgggacgtgtatgagccttcagaaggaagaatgtgctcaaaggaacttgagatgccaaagatatgggtttgaggtggcacttttaagtgaagaaatgtaggatgccaccaaaatccctagtcccatccacaggagaagtggctatttctggtgtaggaaatcctaacatgaataatcctgaacccccaaaaaagcaccctccatacaaagttataggaataagacagtattagagttaaaacttcccggtagacaattgttcaaaagaaacaggaaaacgagcaaaatgctccaacatgaattaaacatataaggaaacaagcagtggcttgttttgttgaatctgaaattcaaaatttcaggatagaaatggacggacaatgtgatgatacaactgacagcagactaaattcaggaaagaaatcgaaataaaagatagatttggccaggcagtagctctcacctgtaatcacagcacattgggaggctgaggcaggaggatcacttgaggcccggagttcaagaccaacctgggcaacagaatgagacgctgtctctacaaatagtaattttaaaaattagctgggtgtggtggcccatgcctgtggtagcagccgctcagcaggctgaggtgggagagttgcttgagcccagaaggtcgaggatgcagtgagccatgatcgtgccactgcactccaggctgggcaacacagcaagcccccattttgggggaaaaaaacccgataaatcttttctaaaaccagggcaccacagggacaatatgtatgagcagactgatagtgccagacacagaggatggacgtgaaaagaggaaaacaaaactgaaaagaggcaaaaggatcagaaagtgacaggaatagaaaagagacaatatatataaaattgggagtcccagaggaagaaaatgcaaacagtaaaagaactaatattttaaacttacagtcaagagttttcagtagcaccatgcaaagcaccaaacaagaagtcaacatcttcaaaaaatgcaaagaaagtgagcgcttgaggatggtgcatgatagggcaggcagagaggagggcaggggcagaaaccaccccctaggtcaaggcgagaggcctggatttgcttcgtggagtgacgggaagccgttggagggcgtgtcaggaggagaatgacatagtgtaacttgaaggacctctctgaagggtggaccaccaggaggccagggtggaagcacacagcagtccgcgggaggatgtcacagagccggcaaggacacagctggctccgcaggagggccaggaatggagatgcacggatgtgtcctggagttagaatggacaggacttctggatggattggctttgaagagtgaggggaaggaggaagcaaggagaaccccagggtgcttggcttgagcggctgaggggacggtggtgccgttcactgagatgggcaagacagagtgagaactgggttgggggatgaagttggacattcttcacagtctcgggtccaggctaggtagggacagagctccagtgagtgctggatcagatcgatccgctttgctgtttgagtcgagtctgtgtgtgttttctgaagtctgaacgcatgccatgctccactgtgtccttggtggttcccatcagaccctgacagggctccagtccctccttgttttttgttagtttgtttttgagacagggtctcactttgtcacccaggctggagtgcagcggcacgatcttggctcactgaaacctccacctcctgggctcaagcaatttttttttttttttaagatggagtctcactctgacgcccaggctggagtgcagtggtgcgatctcagctcactgcaagctccgcctcccgggttcacgccattctcctgcctcagcctcccgagtagctgggactacaggcgcccgccaccacgcccggctaatgttttgtatttttagtagagacggggtttcaccgtgttagccaggatggtctcgatctcctgacctcgtgatccgcccgcctcggtctcccagcaaagtgctgggattacaggcatgagccaccgcacccggcctcaagcaattgtttcacttagctgggaccgcaggcgtgcaccaccatgcctggctaatttttgtattttttgtagagacggggtttccccatgttgcctgggctggactctaactcctggcctgaagccatccgcctgcctaggcctcccaagtactgggattaccagtatgcaccacccgccacccagccttcttctcttactaacaccaccttccctgtcttggcagctgtaaaggacctggccagaatgtggctgtgaccagggcacaccctgactcccaagggaggcggcggcggcctgagcggggggcccgaggaggccaggtgttttacaacagcgagtatggggagctgtcggagccaagcgaggaggaccactgctccccgtctgcccgcgtgactttcttcacagacaacagctactaagcagcatcggacaagacccccagcacttgggggttcaggcccggcagggcgggcagagggctggaggcccaggctgggaactcatctggttgaactctggtggcacaggagtgtcctcttccctctctgcagacttcccagctaggaagagcaggactccaggcccaaggctcccggaattccgtcaccacgactggccagggccacgctccagctgccccggcccctccccctgagattcagatgtcatttagttcagcatccgcaggtgctggtcccggggccagcacttccatgggaatgtctctttggcgacctcctttcatcacactgggtggtggcctggtccctgttttcccacgaggaatctgtgggtctgggagtcacacagtgttggaggttaaggcatacgagagcagaggtctcccaaacgccctttcctcctcaggcacacagctactctccccacgagggctggctggcctcacccacccctgcacagttgaagggaggggctgtgtttccatctcaaagaaggcatttgcagggtcctcttctgggcctgaccaaacagccaactagcccctggggtggccaccagtatgacagtattatacgctggcaacacagaggcagcccgcacacctgcgcctgggtgttgagagccatcctgcaagtctttttcaacagaacttcacagactgttagagctgctgagaagaatttgctttccgaattcagcctggaaggcgcccagggacagctgtactgagtctagatgactctgacccccgccccaggtcaaggccagcagagcagtcagtgcctctggagaaggcccttgctctcccacctggcccagactccgaggagcctgggtctggagctgccggtctggttcttccctttagagcccggatctgccacctgcggcccctcccaagccgtgaaccagctcatgagagatgaacactgtgggatccactcaggaaggctcggggctggcacaaaggaccacccagcattgccctgtgccacccagcactcagtggacattctggggacctgccttcagccttttcctgccctgtgcctgacatcagcaccctggctggtcagaatgccgccctcccagaggagcagccgagagatcccctgaaggctggaggcattctgctcaggacccctatcccagctcacagtgcccaaccatctcaccaggagaaagagccacatccccacgttaggaccacggagactgaccaccaccctgaccccccaaacccacgcaccagacgcttgcaggacaggcgccgcgcagcgggcaggggcttgcccggccgaccctcccctccccacctcccccactgcgcgttactccaggatatgccgagtgcacgtataaggtcatcttcgtcgtccccgtggacctcccccttcctctgcacgtcgtccaacgtgggactggcgtgtcgggcttccctgggaggatctggaggttgttctctgcagagaaccagcctggctcctggcgcgcacctctgctcccttctcctcactacccacccacgcatgtaccgggaaaaaaactactatgcccttctagaccatgttctgagaaaagatcgaaaatatttaacaagagataataataaatctgatgccggtctttgtgtgtgttgcggacgggagtgttgcttttattgtttttgcttccgtaataaatctaaatgggaatacagaacagcccccacattgggcttttttttttttttttttttttttttgagacagttttgctctttcccccaggctggagttcagtggcgcgatctcggctcactggaacctccgtcttcaagcaattcttctgcctcagcctcctgagtagctgggattacaggcacctgccaccacgcccagctaatttttgtatttttagtagagacggggtttcaccatgttggccaggctgggctcgaactcccggcctcagcctc

SEQ ID NO: 17090 - DNA, 18788 bp, Human
  misc_feature (1)...(18788): n = A,T,C or G
gcctcccgggttcaagcgattctcctgcctcagcctcccgaatagttgggactataggcatgcgccaccatgcccggccaatttttttgtatgtttagtagagttggggtttcaccatgttggtcaggctggtctcgaactcccaacctcaaatgatgggcctgcctcagcctcccagagtgctgggattataggcatgagccactgggcccgtccaatgactgtgatttggtcattacacattatatacatgtatcaaaatatcacacgtaccccgaaaatatgtacaagtacgatatgtcaataaaaacatacacaaagaagtcacttaaaattatcttaaacatcagcattgtgatatatatttgtcaatatgtgtatatacacatatacaactttacatgctatatctaacttttttatttttttatttatttttatttttttttttgagacggagtctcgctctgtctcccagactggagtgcagtggtgcgatctccgctcagtgcaaactccgcctcccgggttcacgccattctcctgcctcagcctcccgagtagctgggactacaggtgcccaccaccacgctgggctaattttttgtatttttggtagagacggggtttcaccgtgttagccaggatggtctcgatctcctgacctcgtgattcgcccgtctcggcctcccaaagtgctgggattacaggcgtgagccactgcgcccggcccttttttatttgagacagaaacactgcaatctccacctcccaggttcaagcgattcttgtgccttagcctcccaagtagttgggtttacaggtgtgcaccaacatgcccacctagtttttgtatttttagtagagacagggtttcaccatgttggccaggctggtctcgaactcctggcctcaagtgatccacctgcgttagcctcccaaagtgctgggattacaggcatgagccaccacacccgtttcttaacaacaaaagagtgtgaagttcttcctcacagaaatattcattttcattatcactgacacagcagcataggattccttgtttggatgtgctgtaactcagtctcctgtgtattagatatctaggtgtggaatctgggctttaatatacatcacacttaagatgcttttatggggcccatgtggctgggcacggtggctcacacctgtagtcttaacaccttgggaggctgaggttgggcagattgcctgagctcaggagtttgagaccagcctgggcaacattgcaaaaccccatctctacttaaaatannnnnnnnnnnnnnnnnnnnttccagctactgcggaggctgaggcaggagaatcgcttgaacctgggaggcgggcgttgcagttagccgagatcacaccactgcactccagcctgggagacaaagcgagactctgttctcaaaaaaataaaataaaattttaaaaaatgcttttatggatttaaaattgttttttcattctccatgggagttaaaaagtagaaagtagaatcatgagtggacatgcgttttaataaattggaggtttgtgtaatttcagtaacgtaataataccagctctattaaaaatgaagaaatggaccttttgtactgggaagtagttgtaagtccacgtatttgtcttctcactggtgtatatgtgtaagcccaataattgtgttagtttatgtagtttcttgttttttttgttttttttttttagtgtctataagtcaagtctttggtgttaaagattttaactatcatttgctgtaattcttagaaagccgagggactaatcatttatgtttcgtgcataaggaaatgggcgttagcttccccaagaccccaggagccaggcattgttcttaccccaaagcctcaggtcagacttctgctgcttcacgttagaagtcatgatcttttgtattatggtaaagggagcttggaaaattaagtacttttaattccatttaatgtttctttcagtcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactggtgagtcttggggaactgtcttcaagtgtaagggagcatttcatatattccatgtggcttgaacaacgaaatgttggttgagtaagctctgataatttcagtaatccatgatgcagtctaatctgtagggaaaatatagagtactatagctggaaaggggccatagtgtaatcatctggattgactcaccattttacaagccacagaatgccacacttgataagagtttgtctgtggtgacactgttggtttgtggcagaatctcaggtcctttaacctggctactccagggcttctgtgaactcacatttaaagccaaagttctgaaatgctaaattttaatttgaaaaataacctttttcctatttaaacaacagtcaattctctgctgtgggttgggtggtagaatacaaagccacaaggacaccaccatctgcctacacagagcttgaagtccagttgtgaggcatgatgttggcatgtggtatcgtaagggttcatgagaaggtgccacaggagaccagagcaccaggtgtacctaaactaggcatggtttcttggagcaaggcaaatcagattgagacttggcagtgaggtgagaattaaggagttggtgaatatgggaaggggtgtttctgattgaagaatgtcgtatgcagaagtagaggagcagcaatgagcttgacatgcgagggagaaattacatggccttttatgtagggtgcacattgaagagtgaggagaaatgaagatagctggggctgtattcttgtatatggctgtctttgaacttgcaacttcacacagtgactccagaaatgtcagaaagtgaacaaagaaattcttaccctttgtaaaatatcctcctatgcttagcaattacattctagattatctttttcctccttgaaaggtaagatacatataactgaacttttgtactgcactagtataaatgccaagtttacttgtatatttggtgtatattagatttggacttagccttgttcagtattatattccttaactagctttatcacctaagaaggcccctgtacccattaagcggccactccctgtttcctcccccaactcccagcaaccactaacctgctttctgcctctctacatttgtccactttgtatatttcatataaaatggaatcatacagtatgtggctttctctgtccagtttctttcatttagcacagtgttttccaggtttatctgtgttgaagcatgtatcagtactgcattcctttttatgattgaataaattctactgttttgataatgccacattttatttatccatcctttggtggacatttaggttgtttgctcctttttgtctgtgattatgaataatgctgctatgaatgttcatgtactggtttttacataaatatgttttttcttttcttgcttttttttttttgagatggagtgtagctctgtcgcccaggctggagtgcagtggcgccatcacggctcactgcaacctctgtctcccgagttcaagtgattctcccgccctagcctcccaagtagctgggatcacaagcgcatgccaccacacccagctaatttttgtatttttagtagacacggggttttaccatgttggtcaggctgatctcgatctcctgacctcaggtgatctacccgcctcagcctcccaaagtgctgggattacaggcgtgagccaccacacctggcctcttttctttagacatgatctctgtgttgcccaggtgggagtacagtggtacggtcacggctcactgcagcttccactttctggggtcaagcgatcctctcccgccttagcttctcaagtagctgggactgcaggtatgcacgcctggctaatttttatgggttttttgtttgtttgttgagacagagtctcgttttgtcacccaggctggagtgcagtggcacgatctcgtctcattgcaacctctgcctcccgggttcaaacgattctcgtgcctcagcatcccaagtagctgggactacaagcgtgcaccactgcactcgtgcctcaccctccaagtagctgggactacaagcgcgcactactacaaaaaattcttgtatttttagtagagatgggatttcaccatgttggccaggatggtctcaaaattctgatgtcaagtgatctaccagcctcagcctcccaaagtgctgggattacaggcgtgtgccaccgtgcctggctgtgcatgttttttctttttttttgagacggagcttcgctcttgtcgcccaggctggagtgtagtggcgtgatcttggctcaccacaacctctgcctcccggtttcaagtgattctcctgcctcagcctacctgagtagctgggattacaggcatgtgccaccacgcccagctaattttgtatttttagtagagatggggtttctccatgttggtcaggctggtctcaaactcccgacctcaggtgatctgcccaccttggcctcccaaagtgctaggattacaggcatgagccactacacctggcttaatttttgtattttttggtagagacagggtgtcgtcatattggtcaggccggtcttgaactcctgtcctcaggtgatccacccgccttggcctcccaaagtgctgggattacaggtgtgagccaccgcacctggccttgtgtatttttttttttttactagagactgggtttcaccttgttgcccaggctggtgtggcctcaagtgatcctcctgccttggcctcccaaagtgctgagattacaggcatgagccactctgtctagctatagatatatattttcatttctcttgggtatatatacctaaaagtggaattgctgggtcatgtggtaactaactttttgagaaactgccaaactgttttccaaatgagcagtaccattttactttcccaccagcagtgtatgagggtttcagtttctctgcgttctttccagcatttgtttttatgagtcttttttattagagccaacttggtactaagtggtatcgttttgatttgccatttccctgatggctaatgatgttaagcatcttttcgtgtgcttattgtatgttcatattgtatatttttacattcgtatgtcttctttggagaaatgtctattaaaatcatttgcccatttttaaattgggttgtctttatattattgagttgtaaagagttattttactaggcccttagcagatatatgatttacaagtattttctaagaggaattattttaaattttgagattaaaaacaaatttttttagaatactctgttctgatccacaaagtggtactatactgtgaccagtgttgtcataactggctttttcttttgtatttaagggatgaagatgcccctgctaagattccagatgaagaggccacaaaacccgaaggctggttagatgatgagcctgagtacgtacctgatccagacgcagagaaacctgaggattggtaagaacttcagttaactttttttaattacctggtttttttgtttgtttttttttttgagatggagtctcactctgtctcccaggctggagttcagtggcgcagtttcggctcactgcaactttcacctcctgggttcaagtgattctcctccatcagccttgcgagtagctgggattacaggtgtgtgccaccacacccggcaaatttctgtattttttgtatttttagtagagacggactttcaccgtgttggccaggctggtctcaaagtcctgacctcaagtgatctgtctgccttggcctcccaaagtgctgggattacaggcgtgagccaccacacccagcataagttacctgtttttattgaagtcaatcttaatacttaaatatagccaagttccctaatttcagggtagaatttgacaattttaattatattttcttcttttttaaaaaataaatttttcctgaaaaactgttattactggaaatacaggagaagctggtctgggatactgtgaaaacatttcagcaggatcttggcagccctgggccagccagctgttcatagtcctgcatcacagaacctgtttataatttgttgtttgtacctccgtagggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccaggtttgtgcctcttgatggttgagttgctttcattaatctgtttgtattcagatagaagttttatctagagtaaggctgccaggttggtcattatattcaagctgttgaattaaaagcagaaagtagacttcctaagttgaaagagagcttaatgggttaggtattgcaaagataaacctagaaactggagtgaataactttctttaactttatttatttatttatttatttatttatttttgagatggagtttcgctcttctacccaggctggagggcagtggtgtgatgtcgcctcactgcaacctctgccttccggtttcaagcgattctcttgcctcagactcccgagtagctgggattacaggtgcctgccaccacgcctggctaatttttatatttttagcagagatggtgtttcaccatgttggccaggctggtctcgaactcctgacctcgcgatccgcccacctcaacctcctaaagtgctgggattacaggcgtgagccactgcatctggtcaactttctttttttgagactgagtctcactctagtggccaggctggagtgcaatggctcagtctcggcacactgccacctccacctcctgggttcaagcaattctcctgactcagcctcccgagtagctgggagcacaggtgtgctcacaggtgtgctcacctcacctggctgattttttgtatttttagtagagacggggcttcgccatgttggccaggctggtctcgaactcctgacctcaggtgatccacctgccttcgcctttcgaagtcctggggtttcaggcgggagccactgtgcccagccaagaataactttcatagttgctttgtaactatatttaaaaacaaaagagaaatggaaaactgttgatttgggtaccctgctcttgggtgccagggttgcttcagccataggatccacagctgagtctggacaatctgtgatgtggtgggtagaggactgtggtttgagtcagcatcttgactacatcaagtcagctcactgcttggcctcaatgcttgcaactataaaaagactgaggcccaaaagagatggtaaggatacaagtagtaaggttgtgaggctttaggcctcatgcaaaaatgtacaccctcagacctttgttccttttatctttctagccaagtaaaattatttataatctctacaaagagtggcaattaaaattatttataatcattaatttctactttatttatatacaaatactaatatatgtatatacatatacagaaacaggagaagctggtctgatactgtgaaaacatttcagcaggatcttggcatagtatatgtatatatacatatactaatatatgtttttctgtttgtaaattttttatttttttcctcatagtcgttaaagatgttatgtgaatgtatttttaattgtgtagtcaaacaataagataaaagttttactttaaaaaagttgccctttaggctgggcgtagtggctcacgcctataatcccagcacttgagaggctgaggtgggtggatcacctgaggtcagccattcgagaccagcctggccaacatagtgaaacaccatctctactaaaagcacaaaaattggcctggtatggtggcacacacctgtagtcccagctgcttaggcacgaggctgaggcacaaggatcacttgaacacaggaggcagaagttacagtgaaaaagaagttgccctttagttgttctcctgttggtggccatttaggtggattgtcacttttgctttcagagtcactgctgctgtaataatccttgtacatgtctgggtgtatgttgtgagtatttctctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttcactgcagcctttgcctcccagattcaagcgattctcccacctgggcctcccaaagtgttgggattacaggcgtgcagccagacccagcgagatcctgtctcttaaaaaaaaattgttggccaggtgcggtggctcacgcctgtaattccagcactttggggggccgaagcaggcagatcacgaggtcaggaggtcgagaccatcctggctaacatggtgaaacccatctctactaaaaatacaaaaattagccgggcatggtggcaggtgcctgtagtcccagctactcaggaggctgaggcaggagaatggcgtgaacctgggaaggcagagcttacagtgagccgagattgggccactgcactccagcctgggtgacagagcaagactctgtctcaaaaaaaaaaaaaaaaaaaaaattgttggccaggcatggtggctcacgcctgtaatcccagcactttgggaggccgaggtgggtggatcacgaggtcaagagatcaagaccatcctggccaacacagtgaagccccgtctctacttaaaataaaaaagttagccaggcatggtggcgggcgcctgtagtcccacctattcgggaggctgaagcaggagaatcacttgaacccggaaggcagaggttgcagtgagccgagattgcgccactgcactccagcctggcgacagagcgagactgagtctcaaaaaaaaaaaaaaattgttggccgagcaaggtggctcacgcctataatcccagcactttgggaggccaaggtgggtggatcacctgaggtcaggagttcgagatcagcctcgccaacatggtgaaaccccgtttcactaaaaatacaaaaattagccaggcgtggtggtgggcacctgtaatcccggctactccggaggctgaggtaggagatccacttgaacctggaggcagaggttgcagtgagccgagatcatgccattgcactccaacctgggtgacaagcaaagtcgatctcaaaaaaaatagtggccgggcgcgatggctcacgcctgtaatcccagcactttgggaggccaccgaggagatcatgaggtcaggagatcgagaccatcctggctaacacggtgaaaccccgtctctactaaaaataaaaaaagttagccgggcatggtggcaggcgcctgtagtcccagctattcagaacactgaggcaggagaatggcgtgaacccgggaggcggagtttgcagtgagccgagatcgcgccactgcactccagcctgggcgacagagcaagactctgtctccaaaaaaaaaaaaaaaaattgtagatctagagatgtgttctaatgctaatatataatcaccaaaaataataaggttttgctcagttgtttaacttctgtcttagaagagaaacagaaaagtgatgctgaagaagatggtggcactgtcagtcaagaggaggaagacagaaaacctaaagcagaggtaaaggaaaggggtcacacattttgttttaccaagctgaaggtacatttatgtaaagggaatattttaatagggtagtttacagtggcttatggcagtaaaaattctgttaaagccaattttgttgaagtgggattctttgtgatacaggtcagtgttttgtttgataattttaagctacatattaatctcagaagtatctttttagctgaaaatcattttctgaaataagcagaaggttatagggggaaaataaaatgcttgctaagaaggaaacttcgggtcattaacagtctatttgcctctcctcactgtgccctgaaaagtatttcttatacaaatcactgtgttctaaactttttgtccccgttgtccatagatgggttcattcattcatttaactgacatttgttgagtgcccattttgtgccaggcattgtcagtgagtaagacagacaaagatactctgcctttagggagcttaaattctacttgggggaaacaggcaatgagcagtaaacattttaaggaagtaaacaacacagcgtattaggaagtaagaaacgatgaataattaaaacaggaaaagatactaaaagtgctagaggtaggcgggtcaccatgttaaaaccttactcgaaagatgacatcgaaccaaacacttgaaagaggtagagaacttttccatggggatgtaagtgggaagagcattccaggcacagagaacagccagtattgaggcctaaagtggttgtctacaaggccagtatggtgagtggacagagagagtggagaaaagaagggtggagaaggctccaggttagacaggctgttgtgtggacttggctttccctcctagtgaagcgggcagccatcacaggctactggacacaggtgtcacaggatgatgactgtgtctgctgtgtttcctatataccagggagaatcagggcgaccagttaggaggtccctgtaatcatctaggaaagatacggtggccccacaaagggtgacaggagaggaacagagggtatgagaactagttggagatctggatcttggttttgtggtagattggatatatagagtatgagagaaagggaacagtcactgtctgtatgtaccattgcttactaaagtcctttacccagcacctctgtgtctaaatctggtctctcccggaaagctctcctcaggttttactttcagctacaactctgccttcctattaataaagatcattgctatctgtatcttttgtatattttccatggatatgttctgtcttaactagaatgcaattcttaaaagtagagaccatgtttcccccaaactccctcacacgttaaaaagttgctggtgcatttaaaaaaagggaatattttcatagggtaatttacaatcttagcaacttgtgatagagtacagagcagcagccttggagtcagtctacttggatagccttccatcttcatgaatccttggtttcttatcctcagaatggggctagtgtgccataggccagtagattgtttgggattaagcaagattaagaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctagtaaaaagctagagtaacgaatgtttgaactactgatggtgtatctcaatgtgcagcctcctgccacctcctgcttaaccttttagcaattagagtgcccatatctagagttcctgatatcctttggcatcacactatctagttttagtactaacactgtttgattgctccagtccctctactcccctttgcctattagttttaataatggggcataatttgtcttggtttggttttgttgagtaactcagttttacctaaaggactgtttttggtccggcgcggcggctcacgcctgtaatcgcggtactttggcaggccgaggtgggcggatcacctgaggtcaggagtgggagaccagcctgaccgacatggagacaccccgtctctactaaaaatacaaaattagccgcgcgtggtggcgcatgcctgtaatcccagctactggagaggctgaggcaggagaatcgcttgagcctggaaggcggtggttgtggtgaaacgtcgtcctttgcatttccagttccctctaatggagctgcactcttgcatgcttttgctcacatcttctggactttttttttaagtagtgagtaatactgcacttttgaaacttgctcgggcttttacaaataggtggaaactaccagtgattcggaatgttgcaagaggaaactaccagctcactagacgattctgaccaattatggggctggatacaaggaataaggtcaaagtaaaacggctgacattaaaatagcgtggctacttagagtttatcaaagtcgaaatttaaaaaataatttaaaaaaaaggtctctgtactgccaggcgggcgacagggactggccagctgcgccgcactcgcctgccagattccccttttctcggggtagccggaagggcctgccttcagcgggtgctgtgcaggaaaccaatagccgcctcttggacgggctcctgtcagtcacgcttagctccgcccccaggactaaggcccgcccaggggcttccctccgcccttcgcttgagaattccttttaaataccgctctggcgcccgagcgcgcctcttgcgtgctcgtccccacgccctcgggcggccggttcttccttctctgattggccagggcccctgctcatcagtcgtgatgcacaaggtctcttaccgaggccccgccttcttccgagaggcccgaaaacaattttaagatggcggccgcggcggtagcgcggaaaacaatggggccggggcggtggg

SEQ ID NO: 17091 - DNA, 41736 bp, Human
gattaatttctaacaaacgctaatgacctgtccacattcttttggaattgtcttatagcaaacataattcattgattgaactgtcattgaaccactatttattgagtcattgttctgtggtagattcattctaggtactgggcatacagcagtgaattcgccaaagtccctgcctgtgtggggctttcattctaatgagaaagccaaacattagccaagtaaataattgtgtatttttaaattatgatgctatgttttaaaaagtacatgcaaattaaccaagggacttaaaaaaatactctgagagaatgccacaagaggggctaattgagattaggaagtcaaagtggttctccttgagaaagtgatgttgaagctaagtaacagccaaaccgagagagagagagaagtgcatttaagcagagaaaatgatgtctgcaaagagtgggcaaatttgggactacaggaggccaccatggtgggagtggagaaaacaaaagtaagagcagagtcagatgaggttggagagttgtgcagggggagatcatgcaaagactttggaggcctgttttccctctgtgtaatcatcagccccacaaagaggactagtgtgaaaagatcattctgattaatgagtggtaaagagatggggagggctgcgagaggaagcaagaagtgcagcaaaggtaagagtgaagatgaagaaaagtgatggctttgggatgtattttggaggcatgctcaatagggtttaaggatggattggctgcgggtggggagaaggtctgcaagaagaagtgtcagagatggttcccaggtctctgacatgagtaaaggggaatattctttactgaaatggggaagactagagatggagcagatttgggaggaaagatcaagaggtcttaatctcgatatgtgtcgtgtttgagatgcctatgaggcatccaagcaaagatgtggaataggcagttaaatatgtggacctagagagctggggttagaaatctgaatgttgctgggagccataggactcttatttagggtaagagggtagcaagagaggagaaggaaattcagaacagaatcttaggaaatgccaaagaaagagttagaggagaaattggcaaaaaggatgaggtgaaaaacaagtgtgttaaaaatttttttttagcatttcaagaagagaagattttagcccggcatgatggctgaggcctctaatcccagctactcaggaggttaaagcaggaggatcacttcaggccaggagtttgagaccagcccgggcaacacagcaataccccatctctaaaattaactaattagttaaataatttttaaaataaaaagaggagttcatgaaagtgtagtcagcaatgccaaatgcttttaagtaagatgagagttgaaagtattcattgtgtttagcaacatagggtttattgctcttaggaagagctgtggtgggggcagaaattggaatgcagatatggcctgtggctgggagttgggtgagtgttcctaatgagggcctttatcataccaggagttaacctatacaccacacttctgcagcccatgacagattccatggagtcatccagccaaaaaacaccaccactaaactctcatctaaacaggttggtgaaatgtcaaggagataacccttgagaagattctttttttttttaagtacacgtgagcatctgctgtgcaatctctgcaaaccaatgaaattacgtacacacaagtgcattaaaccacccactggtggtttaatctcacaaggaacttgaggaagcaatcttcatcatcacttctgctgatcaaagtctcaaaggtcaagaccacattgcagtcttttcattgttgtaaaagttaatgagagttaattattaaagctgacagaaaggtaatttgtccactgtcttacatagcctatatatagacatccctatgcatatggatgcacacagagcctgtagacctgagtggatggacactgcctcttagaactagaacttagaactttatcttgaaaatgtaccactgttgcagaagctcctcacagagtatgtgtcaggtaggaaccaaatttatgattgttatattcaaactggttttctgttccttgaaaatggtattttttctgatcaaagcctatttaggagttattatgttcttgagtttattccatgtgtgtgaatattttgaatgaatccactaataagatatgcatgtatgtctggagcgctagcaatgtagaataaatatttaagtagactttaacaagtaaatggttgtaggcatcattaagtcttaaatagccttttcaaagatattagtgttcttgttttaattattcagataattcctttaattctccactcaaatctgactttatagatagattgtctgctctgagggttggcaaaaaaaaaaaaaaaaaaagcaagctttaaggaaagagtttctccaggagagagaatcacctactagaaaggattcagaaaggccatctggtcccagccaggcatagggatatgtatctatagtcctagctactcaagaggctaaagcaggaggatagcttagcccaagagtttgaggtcagcctaggcaacatggcaagaccttgtctcttaaaaaaaaagggagggggtaggggacatatggtctagaagtgagagatttatctgctagacatcctagaaagtccaagactaagggaaacacggagagaagaaaaggcaatgagagtaagaaggatagagactggaaagagaagagagatggggagaaaatggtcactggaaagtagcagaatgccctatgccacaagtagtataatataatataatacattagtaatgtatgggtacttatcccatacattactaactctatcaagataaaatctattttattctttaaaatgtcaggaaaagattatacaactttctttatatatgcaagtgaggaacaatttatcaaattattggactaaataattctcttttctgaagtaagttagtcatttggaaaaactgtgtcatgaaatttgactgcataaagatcattcctttttttttttttttttctgagacggattctcactctgtcgcccaggctggagtgcagtggcacaatctctgctcactgcaacctctgcctcccaggttcaagtgattatcctgcctcagccccccaagtagctgatactacaggcacgctccactgtgcctggcatttttttttttttttttttgtattttcagtagagacggggtttcgccatgttggccaggctggtctcgaactcctgacctcaggtgatcctcccacctcagtctcccaaagtgctaggattacaggcatgtgccaccccatccggccaaggattattcctaatgaaaatttaggaagcaactaatttgatttcagaaacaagaaaaatggggtaacacaatacatactttgccttctccctctggataagggaataagtaagtatataaagaaatgaacaaatgtttaatacctcctaaacagctcatattcgactaagaaacaaaatcgttcagaaaatgagaatgaatatttttcaattacaagaataaatatgtaataacacagtctggtgcttctctacaataaaggtctttgattctccaaagagaagagaagaggctcctctagcctctgtgtcactttgttgagaagcaaggggaagaataaagcaagtcacctcaaggagatttgtccccaggccaccaggctcatgttttgtgttgtggatattgagtgtaggagtgtgaggctttcatgctcaaaagcaaggaccctgatggtgcctcaccttgttcttttaccttgtctctcttgggggtaggggctgagacccctgacattgaatatgtagcagagaagaagacgtagtggagagagtcagttattcactagatgtggcttctcatcctggctctgggaagttgagaaagtcatttatcttctctcatctccatttcttcatctgtaaattagcgacaatacagcctatcttgtctgcctccatccacagtaatactcaaggaagaaaagtgaaagtgctcagaaaatctcaaagccttacagaaatggccagggattctcttttgcctgctgtgagcctactgggtgtgaaatcccttgctatggtgcatcccaacatttctctaatggtttagcctatgggccaacaaagccttctgtttcagtgtttggaactctcaataacctttcacatgatttgcttattgcccactgctttgtcatcacccctgccaaacctatctgttctttaaagtctaacacaagactcacagttccttcacaaaaccttcctaactccaacccacatttacatcccttcttccaatttattatctgcaccaattattttgggcacttctcctgtgtatgtaaactttggagtttaggtctacgtcatttatatatcttttgctcatagttcagtttatttcaacaaactttcttgtatacttactatgtcataggacctaacaaaagagggaaaaatggttaagatttgggccttgcccttgggaaactcagtcttaaagggaacagaaacataaacaaataatgtatgacatggaatagacatatatacaaggtacttacaagaaggaaatgatcaactctatctagggattccatgaaggctttacatcattttcttatcttctacaactgtgttaggaactgagttcctgacaaataataggctgatacatgtttgttgaaggaatgaagaaatgaatcaatggtcagctgagttgtgttttgtttgtttgtttgttttagagacagggtttctttatattggccaggctggtcttgaactcctggcctcaagcaatctccccacttcagtctcccaacgtgccaaaattacaggcatgagccactgcacccagctgtgctgagtatttttaagaatgaattggaatctaccaggtattggagaagaagaacacaaaggaaatcatgtgtacagagatacggaactgttaaatatcatagcgtgttaggaacctgctgcaattgtgaaggaggagtgaagaagcttgtgagatagaccagagccaaaacatgaaggaccttgtatgtcattctaggaagctcggatagctagattattttaaaactatgttaaaacaaactgggataaaaatggaaaactgctacttctaaagataagctcagagtaaacataaagtcatagaaaagttggcagcactaacattttccaacaggttccagctgacttttgtggaccagttgtaaattccaccaacagtcaatatttaactcacttctgagactgctacctatgaacttaaggctaagaagtctccctttgtataccctgctttcagttttaagaacagccctagaaggaaaataatggtctcctccttttgctttaaggaaattgaagccttgggccgggtgctcacgcctgtaatcccagcattttgggaggccaaggcaggcagaccacttgaggccaggagttcgagaccagcctggccaacatggcgaaactccatctctactaaaaatataaaaacttagctgggcatggtaacgggtgcctgtagtcccagctactcgggaggctgaagcaagagaatcacttgaacccagaaggtggagtttgcagtgaaatgaaatcgcgccactgcactccagcctccaccctgggcgacagagcaagactctgtctcaaaaaaagaaaagaaaagaaaagaaaattgatggcttgaatcactggcttatagcaaacatagttaagatatggcaaggcaaggatttgaaacctggtgtgcttagttgccaaagtctcactcttttctgttgtacctcccgattaatttaggtttgacttccttcttcagcatcttgggcaatgtagtaatagaattgatgaaaaatagtagtaacaattattgcccacctcagcctttgaccccttctgagctctcttaatcaacctcagtgctgagacccctcccctccattcaccactccagccctctcccattctgatgccatcatctccctgcttctatccagcctcacgctaaccagaatgtggagctttttgtgagcttgatttctgattcctctggctgccgatggagatccctctgaaggtgctcactggagcaattattctgcttgttcccccatctctcacccactcccccaagtatagttatcaggacgctgctgtatttcccattgtccaaggactaattcatgaaatagggctggcttacctctggttttgcactgactggctcagagatattttgagatccatgaggtgagttgtgttttcagcagatttcaggcacagtgtggcattttcagtgatgtctctatcgaaggccttcctcagcttgaacagctatgaaggggtgatgctgctaggagctgccttgtccaagagtggaggcatctaatgtgactgcggaggggctgggaagtgttctgcacccttgcttgtctgctggtttcaaatgaccgctaattaaagacaaatcctagcaccgctcatcagcatcttggttcaaattagttgtttcccagcaaaaagggcagacctctgaaagactaaaacacagaatagataaacactgagtggaaaggtcagggccaaaagacacttctcagcagagcggggcaggcagagtggaggttctcgtaactggaggccagtctgcaggttggaaatgggtggaacttgaagtggtggggaggtatgtacatgacaatccctagaaatatcaaaaagttattaatacatgggaatagttaaactgagaaactgaacttcagaaattaatcccaggattaaatttctgctcaaaaagaaaaaaaaaaagcagagaacaacaacgtgtatgactaagccacagcaccaagatatgtaggtatatgaatgtcttcatgtgtgtgtctatgtatgtaatatatatatcataaaggccaaaaaaataataaaaagcacgtcgtagggaagcaaataaaagtggaaatatatacaaacaaggcttgggattctataattagtaagaggaagggactctgtgaatgaatttcaatccccaaatccactgacaccctaaggaactcagagatccatgaagatagaacatgaaaaggcttttacattaatatgggcgtaatatttgaaattggaattgtgattccaggaaccagaaaaaagtgttttccaagaatttctggcaaaaatgtaacttgttcaggtgaaaaaagagtttaaacaatctctttttaattcctaattaaagatgagccgagatctcgccactacactccagcctgggcgacagagcaagactccgtctcaaaaaaaaaaggtcctgctcaagaatctcagaaatgatgacatggagaatgtcattaatttatgactatctggaacatctcttcagcagaggcaccattggggtagttgattcagaggcccacattgtatgttacacatggaggcatagcttttggaagcggggatgggtgcaaggggaaaacagaaaggctggaatgtggccctcaagatttctctctaaagtctggaaagatttcttttcttttctttattttttgagacggagtctcgctctgtcacccaggctggagtgcaggggcatgatctcagctcactgcaacctctgcctcccgggttcaagcaattctcctgtctcagcctcccgagtaactcagattacaggtgcccgccaccacgcctggctaatttttgtatttttagtagagacaagttttcactgtgttggccaggttggtcttgaacccctgacctcaagtgatcctcctgcttcagcctcccaaagtgctgggattacaggcgtaagccaccgcgcctggccggaaagatttcttaagctcccctgattcctaccctgagcagggcccttgcaggcagtgcttgggtatgaggaggaggcttttactggcaggacagccagagttcaggctcttgatccagctggaggtataagaaagcccactaaagagacagccatagccatcctcagagaaggaaactgattagaaatgaagttatatttctcccatcactgtcatcggcaaaaaaaattaaaataaaaaaaatacaacagccagaagaataaaagtaccttcaagatcttttttggggaagacaactaataaatttctgtgaactccttgaggaaagcatgagtaaagcaagcaaagagcagaatcttttttttttttcctggccatagcagcatctgacagaagtacaaatgcacagtgctgaagtcttcttcatcctaaggttggctaggttggttccttcaaaggattaaagctgttcttataagatattccagataccctttgtgagaaatccaagatgtcagaagtgattgaccatggattagatcttaattattattgccccaaccatgttgttggtaatcagccaaaaaaagacaaaaatccatgctctgcacagcaatgcacaagtcacctccactttgtgagcaagttcttctgacaatgggaagtactgtctagttagtgggatttgacccctgaagtgtgggtggagagatggaagagggaatggaaacaaaagagaaaacaagcacttgggagtggcaggggaggagaggcccagaaagaatagcaaaggaggatctaaatgtcataaccgaggccctggtggtgcacctatcagcaacttgggaggctgaggttgaaggattgcttaagcctaggagtttgaggccagcctgggcaacatatgaaagatccctgcctctactgaaatattttaaaaattagcagggcatggtgggccacacctgtagtcccagctactcaggagacaggaggaccgcttgagcctaggagttaagaggccatagtgagctatgattgcaccactgcactctaccccaagcgacagtgagatcctgtctctaataataataataataataataataataataagggagtcataactgagctcaaaggaactcaaattctggagatcaagccagagatgtggggcagaagcagtatattgtggtcaaaagtgagtacagaggactttagaggaaactagaaaatgggatgggagagaaaaatgagtgatcaaagagaggtcaagtggggccagcagtagaggccagcatctgattcctggttataacttgagctctgcaaacatgctgaaaatcccataaggtatatgagggcacggtgtaacaagatactatctagtgtgagataattcaattaatcactgtgattgaagctgaggaacaaaacttgggcattatgagtagtaatacagaacaagattagagggaaaaaatgctagcagttagttggaatgttcttcgattatgtttatattgaacaatagagaagctgcatgacatagaaaagagagcaaagaagtctgaaaatgcaggtaccatttctgccatgttaacaagctgtatgtcccaagaaaaagtatttccaatttagtgtgggtttggagtgtgtgtgattattttatcatttgtaagaataaaataataataataaaataataagggtaactgcctcaaagaattgtgaaggctaacttggtaatgtgcatttaaacattttgtcaaattgatcttttaagcataatagaaacaggattgagataagaattaaaaacttaaacattttgtgtaaaaaatgctaataatcaaaataataactaccatttagtaaatgcctatagtgtgttggatgtaaaccagatgctttggaaaccttatttaatcttcacaatcacctgaaacttgaatatctttatccccattatacaggcaaggctcagagaggttaaggaacttgcccaggatcattcctttaaaaagaccttattactcacaaatgaagtaaacaaataatatttagtttgtttcatagtttccttaactataaattgtaaaactctaactcccagaaacaataaggaaataactgaaataggcaatacctttgaatttcacaattttttaattttacaaggtaaaaaaaacaaattttaaaattctgttgggtaaattggaacagtctggactggagttggggcaataaaaaaactttaaatctaacctgtcccaacacttaaatgccttaactttggaaatatttctgggaaaaaaagttgatgagaatatcttgccttgtaagtaaaaaattgactaattgattcataaactgagtcaattttgttactttttggcaaattaaaaaataaagctcttgtttacttacctaaaagagccacgtccagctcactggaataaaacatcgctgtcgcaaaacacaatctaggtcccttaatcctgccttttttgatcttaaaaggtggtaacattcagttcggagctcactcatctgtaaattgcatcacattatctctgagttatttaagaagcaagctctgtttggtttcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtaggtaagatattttttaaggtattggcattaggaatacatttttgaagcactttcccctaaattttctaactttccaactctcctttctggctctagtccacagcctacagtcctttcctctttagtttccaaacctcctactccctgacagagttggaaaggtagtgtctaaaatgaaccccatctcggcttatcaacacggtctttccaaatcagacaactaacagatggggacagaggaaaattctcatttgaaatattgcatgatttgagctgaggatgacaaataggtctattatggttaaagaaaagcaagcattttaaaaaatcctttgttggtgaccagagggcagctgattatgggtaaagaatgttactgggagtgaaattactagtttaatctttagcatattaccatctttaccaatttcccaccgacaggtactaaacttaaaatttgatattaattgactgacctgtggctttccatgttttcagctgttccccacaaaaggccaagagaattgtcctctctttgttccccatagcatcttggttgccagcataccggcttaaagaatggttgctcagtgatattgtttctggtatcagcacagggattgtggccgtactacaaggtaaaattttttttaagtataatttatatacaataaaattcttcctctgaatgtgtacagctcagggacttttcgtatattcactaggttgtgcatctgtcaccactatctaattctggaacattttcaccaccaccaacccctaaaaatcccttacccattaacttcacatcccccctaccctttctctgtggatttgcctcttctgcatatttcatgcaaatgaaataatacaatacatggcactttgtgtctggtttctttcactcaccgtaatgttttcaaggttgatccatattgtagcatgtattggtacttcattccattttatggacaaataagtattctgttgtatggacatatcacaatttttttatctgctcatcggttgatgaacatttgagttgtttccacttgggggctattatgagttatgagtaatgctattttgaacatttgtgtacaaatatttgtgtgagcatgcttcaattttcttgggtatatcactaggattgtaattgctggatcatagggtaactctatatttaatcatttgtggaactgctaacttattttctaaagtagctacaccattttacatttccactagcagtgtatgagggttcagatttctccatatcatcaacacttgttattgtccatcttttttcttttagctatcccagtgagtgtgaagtggtatctcattgtggtttgcatttgcatttctctaatgactaacaatattgaatattttttccaggtgtttattggccatttgtatatcttttgaaacatgtctattcaaagtttttatccatttttaaattgggttatttgtctttttgttgtggagttgcaagtgttgtttctatattctggataccagacccttgtcagatatacaatttgcagataacttttttattctgtgaattattggttaactttcttgatagtatcctttgaagtacacgtttttaaattgtgattaagtccagtctatctgtatttttcattgggtgcttatgccaggggtccccagtccctgggccacagaccagtacaggtccgtggcctgttaagaactgggccacacagcaggaggtgagtggcaggtgagcaaatgaagcctcacctgtatttacagccgctccttattgctctctttacctcctgagctccacctcctgttagatcagcgacaacattatattctcataggagtgcaaaccctatcgtgaactgtgcacgcaagggatctaggttgcatgctccttatgagaatctaatgcctaatgatctgtcacggtctcccaacacccccagagggaaccatctagttgcaggaaaacaagctcagggctcccactgattctacattatggtgaattgtataattatttcattaaatattacaatgtaataataatagaaataaagtgcacaaaaaatgtaatacacttgagtcatcccaaaaccatctccccttccctagtcagtggaaaaattaccttccacaaaaccagtctctggtgccaaaaaggttggggactgctggcttatgccataggtgtcatttctaagaaaccattgacaaatccaggtcacaaagatttatacctatgctttcttctaaaagttttatagttttagttcttacatttacatctttaatacattttgaattaatgaggtaacttatttttaggatccaattctaaataccataagaaccaaatgagaatgtctttgattcctcttgcacagagtaagggctctgctgcttgtgtgtttacaggtttagcatttgctctgctggtcgacattcccccagtctatgggttgtatgcatcctttttcccagccataatctaccttttcttcggcacttccagacacatatccgtgggtaagtcagttactgagctgattaatgctcacattgttttttccttatgaattttattagccataccttctatcaattccaaatttcacataatccaggagaagagtcatggtctcctgtgagaattaggaccagggtttgagatggagggcagggtcacagatggcagccattttatttatttatttatttatttatttatttttatttattttttgagacggagttttgctcttgtggcccaggttggagtgcagtggcacgatctcagctcactgcaacctccacctcccaggttcaagcgattctcctgcctcagcctcccaagtagctgggattacaggcatgcaccatcacgcctgactaatttttgtattgttggtagagacgaggcttctccatgttggtcaggctggtctcaaactcccgacctcaggtgatccacccgcctcggcctcccaaagtgctgggattacaggcgtgagccaccacgcccagccttgccagtcattttatatggtcttattctgtggttgaaagacaatgtgctttagagaggcatatactgaccacgattcacccactgttaattaggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccaggtgagcaccttctcatgtaacttgcccacctcaatctgttcatcttgactgttacacatctctctatttttcctcccccctgccactcctccccatcttccctttggtttgtctctccctcatggcccataggaaatactgtacgaagggtcactcaccacaaccagagggagaggagtgggtcaacagtacaaaaacgaatgaatgtgggtctagacagaaggaagaaggggaatggagaggcacaaacagtgacaagcgaaatgcttcaacatatatctgggaattgatagagtcaagaaacagcatatctgggaattgatagagtcaagaaacataactgtatacaagaaatcgtcatactggtggctttggaatttttttctttaattcttcagcaactataatctagttggaagggatgggggctttgaactgttcatgtcaattttggggaaaactgacgaggattatggtggagcctaaagtctcacttccaagccgtatgctgacactcctgctgaatactgaaaatgtcatggactttttgagatgttgcctaagtttatggataatgatattattggttaagaccatttcttaaagaaaggaaaagtcagtttctacaaggacataagcatgcgtcttattgacaatttggttagttatttctaatacatttctgaacttagtatagaaatggaacccaactgggctttgggcagccacagctctggctgcgttctggagatgtgagcagaaagacaggccaagtatccaagggaaggagaatccatccgattcactcgattgcaaaacaatgatgctttaggggggaattaaccatccttttcccccagctagaaccaagcacttctgatgtccaatatgcagttatgtatttcttaagcaagttgagcaactttgaggaaataggatagacactcgctcatgcgtgctccagcagctagaaagtataacttaaaattacatcagcaaatttatgagggctgatgctaggtaagattctactagaaaaggcctatgagtcttccaaagacagcacacttaaaaataaattaagtgcaaataagcctgttacttcttgggggcaaactagacttatatcctatgtgaataccatgtgacgttccacctggatgatgcggtggaagggaaggagagagaggagccctgggtgggaggcgtcccaggaggcagggacatttgcttcttcaaggcatgtacatacaggttgagcctttacgttttgtgtaatattatttcagttgcggatccttgagtttgctgaggtatactcctaatctatgctgacaaaggcttttgttctctttccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtaagtatttctttcacctaaaaaatactgaaatacatgaaactcactactgtgtttttagagagctttcctttaatgcctttgccatggggtttacctacagtttgtaaaattttttcatattaaaaaagaaagcagcactttgggaggccgaggcgggcggatcacgagatcaggagatcgagaccatcctggctaacacagtgaaaccccgtctctactaaaaattaaaaaaaaaaaatagccgggcatggtggcaggcacctgtagtcccagctactccagaggctgaggcaggagaatggtgtgaacccaggaggcggatcttgcagtgagttgagatcacgccactgcactccagcctgggcaacacagtgagactcttgtctcaaaaaaaaaaaaaagaaaaagaaaagaaaagaaaaagaaagtaaagccaggcatgatggctcatacctgtaatcccagcactttgggagcctgaggtaggaggatcacttgacacctgaacccaggagttcaagaccagcctgggcaacaaagtgaaacctcacctttacaaaaaataaaataattagccgggcatggtggtgcatgtctgcagtcccagctttttggaaggctgaggcagaggatctcttgagccagagagttagaggcagcagtgagctatgattgcatcactgcactccagcctgggcaacagagcgagacatagtctcaaaaaaaaaaaaaaaaagaaaagaaaaaagaaaaagaaaagaaaagaaaaaaggaaacgaaagaaaagaaaaagtagcaagggaacaatactgaaaatcaaccacatctaccatacagctaatgttaacaacaaaattaagtaacacttctcttagatttgactcaagtactttccaaaaggaaaaaaaaagtctatgttttaaaagctttaccattttgtcccaagttttaaactgtttcttaaaatcttattttgaaagaaatttgctaattgagttatgatgttttcctgtttcttgaaaagcatgtctcattcttttagaattgaagttcttgggtctttttgcatcctgtttagaaaacaaaagaacatttaccactatgtagatagggcagcagttctcccctcctccagaggatgcaaagtagaacagatagtgttcttagttttaaaacttgggacaaaatggtaaagcttttaataacatagattatttttttgaaaatacttgagtcaaatataggagaagtgttacttaatttttgttgttaacattagctcgatggtagatgtgtttgatttttaacgactcccaaaagtttttgggagttgagacagaacttgctccaaattggaaccaacactctctttcatccagaggtattccaaaagtggagtgttctagaagcaatttgggatccagttttggcctgcttgagctttttggggtaagtggatatggaacccaactagcttcaagaagtatgtgcacatgcatagtgcacagttagccagaaaactattttccaaaagtgacatagagagtcagctaagaaatatgagggggtgtaaaccccccaagagggccaggaattgagcatactaagcaaaactatcaaagatcagaagttattccctggacagagtagtgatggctgtgaaataaaaaatgacgaccaaagagacctaataagggcagaagaccagtggtaaaaatgtgaaaagtatccaacaaaatttgacactagccaaagagattcccagcaaaaatgccagaagcattcttaaactagtgtgccacctacactatgctaacttactcttctcatatctccatcgctactctctacaatttcacattcacaattaaaccggggcaatacaggaaatcactatcagtctctatcagtctttttgcttccatgtttatttttatttgtttggagatgcgttgtatccaaattgtgcattaatatagggctttggtggtttttgtttttataattgtaggtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatggtaattgatcattttcagactctgtcatagctactctactgtttatatgttgtaagtccttcaccatttgtagctcaggaagttttagtggggcagaggccatctctgcagttttcgggcataatgtttagcatggttttattttcattcagaatttaataacttcctcttatgattttgagttaattttttccacgtgagacaaggatagtgcagagagcaagacccttgacaaaatgtcgtgttagagccatttgaatttagctgtggttctcaatcctggcggcatgttagaattgcctccgaatttcttaaaaagtaacaaagcctgggctggagttcttacttaacaggtacagaagtgggttttggcaatttatttttcttcaaagcaagactcttacttgcatctcacatttctaacttgggccatttgcaactttgcagaccgtgattgcagcaggtgtatcctacggctgtgactttaaaaacaggtttaaagtggctgtggttggggacatgaatcctgggtaagtgtgtcttcgatgatggcatcaccatgcactaagcagagagttagcagtagtgacaggagaggtacaatccgaactgcagttcagcctgcaggtaaccctcatcagaatcctccctgcaccctgcatccctaaggaaggctcactgctttccttctaggaaggtgctacaaagaaaggcagggtgtgcagttctttttttttttttttcgcctccccacagtgaatgcagttcttaatatcagaaggcttctccttgtggaagaactcacaaacaagacaagcagggacacagaccagtagaaactcacaggaaagtaaaagttagcaaagtagtgaaagtctaaaaataagcaaagtaaggccagacccggtggctcatgcctgaaatcccagcaatttgagaggccaaggtgagaggatcacttgagcccgggagttcaagaccagtctgggcaacacagcaagacccccatctcttgtttttttaaaaatatataaataataccataaagaaaaataggcaaagtaaactgcttctcctcttaaagaaacatcaagtgaaaccagatttccttgtccataaattactataaacaatatgtaatgctttgtttgaagttactggagccaagttctgaaagttcaaagaagacactgaaggaacacaggcactccacgtgagcagtccagataggcacactctgtcctttctcccgatcagattcaaaacaagggcagagcaacttttcccactgcaaaaggatgagaagtccagtttgtacaagaattttaaaatgtatttcattacattcagtggattgagaaggaagatcattttgtgttgtttcttctaaccacagaatcagtttcttccaacttaccaaggaaaaggtgttttcctgttttgttttgttttgttttgtttttttaaaagacttctctccctctctatgcttaagaaatatttgagaattcgagaaatcagcatttatatgtattttttttactttaaaacagccaaattcttttaaaggcaaatatatgtactttttatttttttaaagaaaaaacattttttttattaccagatcttcgtgtgttacatttcacgaatctcaagcatcacttttaatttttaaagttttaaagtggaaattaggctgaaactgaaagactgtttctagggtttccttctattctgccactttgaagtgatttcactttacttaaatgtcttgggagacataaaccaaatagaaaaaatgaatacttgcaaaaccaaacaggatcttgtcagaagggcttggaaaataaaagataaacttaagatcactgagttacaccttaaatacctcaacaacagtcttatttagtgaatgtattttcaatgtcagtgtacctctctccacagtgtgtagggtgtggcaacgggtaaccattacgttcaatagagtggcagtgtaacctagtaggtaagctccagtgttctagaggcagagtacctgagatttgattctgactcactttttgagcttgagcacattaccaaaaactctgtgcctcaatgttcttggctgtaaatatgaggctaaaaataatagctatcaagtaggattcttttaagagttgagtgagttaatacatgtaacatgcttaagtgcctgacttacaataaatgttcaaattacactactattgttaactagtttaacacctaaattaggtagcaagcacttgagctttttatgctccatttttttttctgggtgatgattgagtaggtattttaagtttttgttgattgcaaatagactataactggaaggtagtgattattaattattgctaacctactgttcatgactatgccaccttagtagttattttgcaaagtctcatacactaaatacaaataatttggctgaagaaaagtgctcattgaaacagtaaaggaaacacaaggagtatattcagattccagagggatcctataataatagctaacaggcactttgtgttttacagtgtgtaaatagtatttgcatttattatttgaccctcccactaaactgtgaagaaaagagaacaaggacgggcgccatggctcacgtctgtaatctcagcacgttgggaggtcgaggcgggtgaatcacttgtggtcaggagttcgagaccatcctggccaacatggcaaaaccctgtctctactaaaaatactaaaattagctgggcgtggtggcacacacctgtagtcccagctacttgggaggctgaggtggggagatctcttgagcctggacagtggaggttgcagtgagctgtgcactccagcctgggaaagaggagaccccatctcaaaaaaacagagaacaagttttattatcctcactctacaaatgaggaaattgtgacttgggaagggcaagtggcagagccaggaaatgaacccaagtctttagactgtaaatcttcatcacatcattctgtctatggtgttcagagaccagaacaaaagaataataagatcctggttattaaaaaacaaaaacattccaagctaacttttggatttataatggcatcagatataatagtacttcttcaaaattatggtataatagtacttcttcaaaattagagataaaaatgtattaccatagatattcacaaaatgtggaacagcaattcagaaagagttgattggacctaattaacccacttccaataagtctgatgtcagaaatatatgcttataggagtggaacattttagtaaattgatgttgagtttaagatacatgcaccttttatgatacaattagtaaatataattgaactggtctacattcatgaggcttaagcacagaagtacgccctgtgagttgaaggtttctctgacatatatcaccttaaagagaaatccactctccattagggtcatggttgtctctagcatttctgtgaagtgcagggcagagtccaaggcccatctctttgccaggagttttccatgaaaggttattattatcaatggaaagaagacttttttgctttccttgtctcacaattgtgtttgctcaaaggacttcatgtatggataactattgggagcattttgagtgatgctttgcagcccagtgtaacaatacaagtggaatagaagacattttgcaggaagcttataagaatacacacgcacattatagtgtggttttactggcaaaatcatatctgatttaccactatccttggattgaatttgcagtcttttaccaaattcaggcagtgttgcttttcagcattaagaaagcagattgcaaaattgttagtggagctaaattctcgttaatcatactccaaagtgagacacaactcagcctagattgcattcattcattgatttgcccaatggttatatcagtttataaattggttggtgacattcagacttgcttaatttcaattttagatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggtaagtaaacaaactacactgggtctcactgggcaactttaaataatattttgcacacataatatcaatggtgccacttctgaaaaaggttcattcttgtcttcctgtcaggagttaatagccttgggactgggtaacatagtctgtggagtattcagaggatttgctgggagtactgccctctccagatcagcagttcaggagagcacaggaggcaaaacacaggtatgtcaagatctttgctgcaagcactgtcctagcgttagtaactaggaaattcaagccaggggaaaagttgagttggtgatgataatttttttatcctcacagattgctgggcttattggtgccatcatcgtgctgattgtcgttctagccattggatttctcctggcgcctctacaaaaggtaacactgtctttggatagcatctctacttttagtggtaaatcaaggaccccggttcttaaattctgaaagcacaaactaaactaggggaaatgaggtaatgacaaactctcaagtactcttcttagccaatactctgtatgagccaaaaatatttctttttccctggcaacatgttctgaatgttaggaacacaggtgcccaacctgccttatctcctctacactttgcatgtgcatagccccaaatagaattaatgttgaaataggagggcaccctggcaccacactttcaacacgcatggactgagtagaggttttcttaaaggttaaggtaatcaggccctctatctaattcagagaatggccctaccagccacacaactcgttcttaggaacacaccctgaagcttctagaactttggtttaactccaagaccaacactgttggattgtgggatgggagtgaacagccagcacagacctcccagccctactctcatgctcctctgcctataagcttgagggtttagtttaatactttgtaaactgctgcagcactcagatataaaacataccatcagaccctggaaagcaaaggctctctaggaaacaagatgacagtaaatacattgttccttgtggttttaatataattttgaggtggtacatggagccctgttgacctccttctaatcctggctctgctacttattatctgtgtgattttgggcaaattacttaaccttgctgaacctcaagcgccacatttgtaaaatagaaagggaaataatacccactacacagagtgactataaaaataaataagatcatgtatgtgaactacttagctgagggtttggcatatgataaatacttgataaatgatagtcattattgttaataatattattattctacattgtattacactcctggctataaaagacatagagatatgatacagcccacaaatgtctattggctgttacctaggccttttttccttgttggttggtagccgaacggtgactgtggtcccaggttgctggactcccagtgtggtcatctcaaaaagctcaatggccaaatccatcttcaagcagggcagagaacaatttgccaaaaatatgcattctccataggctatacttctgatttcaaaataagtggcataaaaggaatgaaaaagtcaccactaaagaaatagaagaatgttatctcaataaaaataaacgcacacacactcacccctacagagagaactccaccctctcatgcttctccccgggtgtaaacttgagttctacctagcccacatcaatttggagacactaaagaaataattaccaaatcttgtccaagatttaatcaaagccccttttataaagggtcctgtgatatgttctttttaggccattgtggtcaggaatgtctttgtttcaaacacccaaataactatttgcttctttttatcatatgaaggcaaaataacccataataaaagctcataataggtatttattgagtgctcactgcatgtcagcagagctctaagcgttttctcttcatttaatcctttatatcaaatgcagtatggataccagattactgcggaaattatccccctttcctttctatgatttcttaatgctctgtaatctttactttaaaagtaatctgttgtatatgtatgtcatcgtaaattacttcaaattgtttttccgtagaatactgactaggtgggaaataatgcccaatggaaaaaaaaagtctcttcgcacaggtgtctcttgacatattttatacttagagaattaaaagtcctgcaaaatggagaggcccgttgtacagtcctctgacttctttgcctagctaccacaatggtgacatcttacacagctgtagtacaatatcagtactatacattagtatagtatgttaagtagattacagactttattcaattttcaccattttttaactggcattcacttgtgtgccaaattttttaaaagtcacttaagaccatatttcttctaaactgtgacctctattctcacagttagtaaaattaattgcttagatattatattataaggattacctgtgaaaattagaaataggcagatcagttcaactgtcctcaagatataaaaataaaaactgtatttggcttttctttgtacactgtgttttcatggtatagcagtatacaaattccatactccattcagaataaaataaattggcagggggaacaggacggtgaggggcatgttcctacaattacgataaaatccaaagaatgaagagaatatacttagctattcagcatttttcaccttaactatcacaattcctgcaagataaaagatcacattctggctgtggaagaattggaagtctgaagcttggctgtagggattagtactggcctgggaaatattcattcattggctcagccactcattcactgactaattttaaagcccctcctgtatgcatttaacatagtaggttctggggatatagcaggaactagatagatatgtttcatgctgtcccagaaagcccgcctcaagtcatctcattccaggacctcaagcttcccaagctatttttttttttaacaaagagcaacccccatctccttgactccaataaacaaacacacattagactgtctctgcttgggaggaatttattccaaatgttagtctgtcataggtctgaaggtctgcctttctctgtcccaaggtgcaggctactaaacgccatcagatcatctatctcataatcacaagagcagcctaggccttgtcactgttgtggggacaaagtcattcataggaacaggtcagagtcccagttctggtgtgtcttgcgtggcatcgcacaccggaaaagggtgtaatgctttgatttgctttgaggccctttaaagcacacacttatctatagccttcacctttgcttccctgtggtttatttcattaacttaaagtacatctgatgtttgtgtttttcacagtccgtcctggcagctttagcattgggaaacttaaagggaatgctgatgcagtttgctgaaataggcagattgtggcgaaaggacaaatatgattgtgtaagtagaggcaatagtatttgaaagagagataaatcacaatagcattttaatgctaatgtgaaatgcatgtttatattgtaaactaagtgaaattttgtttctatatatctgttcaaaaaaaccttagtttgttttatttgctatttttaaattgcatattctaatggtcattttctgggactttaatttttttaaatggctacttttaatttaaaagaatgggctccatgaaacactagtctagaacttccttaggcctattctaaaagttcttgcagtaatcccaagtaccacagaaactctctgaatttagggtacgcatggcttctgttcttcattacataatgtttttgtttccacgaatctgtgaagaacttaatttctgaacattgcttttggaaatactctcatttggaaaggctcccccttgctctcacatgctttgctattttaacagggtcaaagtctgtggtgtaaaaatgcctgttaacatacccttaggtatttaaagatcataactagtaaactacacttggtttacttttgtggggcgttttaacacccttttggcatgctaaaattcttataaagatagcaaccattaattaaatcaacagaccaagagtaaaacattagtataagctctaccagttaatttgctgatttttttttaagagataggatctccctctgtcacccaggctggagtgcaatggtgccatcctagctcactataacctcaaactcctgggctcaggcaatccctctgccccagcctcctgagtagctatgactacagctgcacaccaccatcctcagctatttttttttattttttgtagaagcagattctcactatgttgcccaggctagtcttgaactcctggcctcaagtgatcctcccacctcagcctcccaaagtgctgacattacaggtgtgagccttcacgcccagtctaatttgctgattttaatgaacagcagctggttctattaggttggtgcaaaagtaattgcagtttttgcaattataattatcactgtgacagataattccatttcctaaatgagttggagatgggattagaaataaatacactttctttgaatcctcttatatttgtgtgtgtttttgtggcccagaacctgagccagcagaaatgacctcttgggaaaagtgtcttctgtgcactttgctccctggcccaagatgacaactttcaacttccaccacgtctggcaaatttttaaattttttttatagggacaaggtctcactgtcgctacaaaaaaaaaaaaaaaaaaaaagtctttttaaaagaccccgtctcgacattgtactttaatcaaagtaaattgtagtgtatgtgttgctttcttttcacagttaatttggatcatgaccttcatcttcaccattgtcctgggactcgggttaggcctggcagctagtgtggcatttcaactgctaaccatcgtgttcaggacccaattgtgagtgctcaaagtgctctgcatcctggcaggcttggacctgcccaaatcagaagaggaaaaaaaatgtcactggctaaaagaacagtagttggttgataggtgtgcatttctatcaggatggggcagtttatcctccctccagttgctcatctcaaggcctgaagggcaatagcacggcccagctttagaacatcagcccagggaggagacttgctgttggtctgcttctggctttgactccagttcaaataaatcatataaatctctgagtctattcgcccagctataaaccagaagtaattctattccaagcaggtttaatgtctttgccttgtacttgttaaacatggaaatgtgttactgagattgtgagattgtttccatctagtggatggatttcctctttataggttgttagattgccctcgtacctttaaaatatggagctggattagagaacttctcaaaggcccctcttaccttaaaattccacaaaagccatttggaattcttgatttttaataatcattcagtccaagcatctttttaatttttatttatttatttatttattgtcttttgagacagagtttcgctcttgtcgcccaggccggagtgcaacggtgtaatctcggctcactgcaacctctgcctcctgggttcaagcaattcttctacctcagcctcccaagtagctgggactataggtgcctgccactggctaatttttgtatttttactagagacagggtttcaccgtgttggccaggctggttcgtgaattcctgactttgggtgatccgcccgacttagcctgccaaagtgctgggattacagtcatgagccatggcgaccagccttgattttttaaaatctctgccatgtaacatcactaccatgtggttgctcagcctattttgaattacatggtgtgacagaaaaagatgcttcctggggaactaaggagttctacaacagaaattgttatcacaaagtcaatccctgactgatggaatacatccatattgaaatactcccgaactctttcatttatttatatttcattccattttttactgggaacccatcaaacatagagacaaactgaatggtcataagcaagtcattttacttttccatgttctcatccatacaactgggtaatcatatccaccttacctcatggaataactgtgatattcacaatcaaaatggcaaaagcatatggagtgctttgtaaactgtaacatgacaaatgggaggcacttttcaggtgctgtgagaggacacaaagataagtaaaacaaggtgttcaccttccagagtctctgatggcatgatgattccccaaccttttacattttgaaaagtgagcctgctttggtatgctggaaaaagtcagtgttagccttataggcttaacaaacatacatgaatgatttacttggtgtttttctccctacagtccaaaatgcagcacgctggctaatattggaagaaccaacatctataagaataaaaaagattattatgatgtaagggagattcatgtttttctttgacttgctaaatgatattaactatggatctaatgggcaacacctaacaatgcttctctgccttacagatgtatgagccagaaggagtgaaaattttcagatgtccatctcctatctactttgcaaacattggtttctttaggcggaaacttatcgatgctgtaaggtttggggttatttaatttttttccttgtaatcttactgaattctgggaatgtcattgttctgtaaggtcattgttgagactgggttgtgtcacatatgttgaggtggggttgtgtcagtattttttgtcccacgtcccagaacagatgaaactaccttatggggagtttgttaataggttgggaaataagcctcttcagatgacatctaatatagaagaatccttttctcaaattctgatgtagagtaaaagaaatttaccaagttttgggctgctagcttttagtagatgtcatcctacagattttctttgggcatcaacttcagaaacaatgaaggagcatttaatatttgaccacatcctcaaagagattcagtataacagttgtaaatgaatagttaatactgaataacaatacatactgagtgtccctggcaaactggagagatgatgacaaggaagcagtcttgacagttaagaaaaaaagctcagtcctccctcttgaaacatgcctttggtctactctgtaccttgcatacagcctctgccttaaaccttaactattattattagtttgatatgcatccgacatttttctaccgagttttttgttgttgtttgcaaaatgagattatattgtatatttggttttctgtactgcccttttcgattactctagtaaacttccatctaactatattttttgtcaaggatttttttttttgagacaaggtctcgctttgtcacccaggctggcatgatcacagctcactgcaacctcaaactcctgggtttgagcaatccccctacctcagccccccaagtagatgagactccaggcatgtgccactacaccccgctaagtgctaagttttaaatcttttgtagagacgagggcttgctttgttgcccaggctggccttgaactcgtggcctcacgcaatcctcccacctcggcctcccaaagtgctaggattagaggcttcagccaccacgcctggccaaggattttttattacataatttgatcctcctctcttacttatctgtaactaaatattacagcaataagaattcattagtgttgaaaaaaacaaagattagcctcaaatataatactaaaattataaaataaaattgtacaataataaataacataccattataaattttaataagataaaaattacatacaagcagaatacttatgtaggtgcaactcgtactcaataaatagaaaataagtaaaataaaattccctaagagttgtgtaggttccaaacacaaacagattcaaatagagtttatgtccattcatggataatttatggatgaatcctggactgtgttatacaaaagcttttgactgttgataactgcatacaggtggagcagaccatgggtctgacccaatgttctggctgatattgtttaaaccacttttaaattttgtcacaaatatttttattatctgtcccaatccctcaaatcactccagttaaagttgttagaactatgctatataaataacagaatattcagtactcttgtaacacagcaatgggtttctcaggttggctttagtccacttcgaattctacgcaagcgcaacaaagctttgaggaaaatccgaaaactgcagaagcaaggcttgctacaagtgacaccagtaagttccttgaccacatttctatgcattatagctaaaagcttagtaaaggatgattcaaggtgtagttccattcctttaaatgaaatgccagataaacaagggatttcatgtgtcaatgagtgttatattttaaaatgacatccttctgagggtctccctaaaatttttattctcctgggaaaagtaccaaacacaattgtccacaatcttgttgttgtttgagacagtgtcttgctctgtggcctaggctggagcgcagtggtgcgatcacagctcattgcagccttgacctcccagactcaagcgaccctcccacctcagcctcccaagtagctgaaactacaagcacatgtgccaccatgcctggctaacttttttattttttgcagagatggagtcttaccatgttgccctggctggtctcaaactcctgggctcaagtgatcctcccacctcagtttcctaaagtgctgggatgacaggcatgagccaccacacctagtccaatcccatcgtttggctcaactcagaatcagtgcttctgaaactcactggctatctctgacatacacaatgtttttcttggtcacagttttcatacttgttatcctctcctgcagaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattcttgacttttcagcagtgtcctttcttgatgtttcttcagtgaggggccttaaatcggtaatttctttgttcttaatggaaacaaccaatcaatgactaaaggttaaaaaaaaaattgtatttgtgggctgggcacagtggctcatgcctgtaatcccagcactttgggaggccgaggtgggtggatcacctgaggtcaggacttcgagaccagcctggccaacatggcgaagccccgtctctactaaaaatacaaaaatcagctgggtgtggtggcgtgcacctgtaatcccagctactcgggaggctgaggcaggagaatagcttgaacctgggaggtggcaattgcagtgagccgaaattgcaccactgcactccagcaatacagtgagactctgtctcaaaaacagcaacaaaaaaaactgtatttgtggaaggatgctcctttaggtaacatgcatttaattagaagcaaatgataatcttagagtattccatggagggaaaggtggtgttcagtggactcttgaaagggcatttttccatgagactgggtactatattgaagggaatcaaatctacagttctaacgtatgctgaatctgctggtggacaactatgctcacattcctttcaaatttcaattctgtggtgttctcaaatctttgtgggcattgtgtctaaattattctgaaatcagagaagatctggaaaggtcctgggaaaaaatgtaagagtggatccttttgttttatcctcatccattataagctgatgaaatttcacttggctaaaacccaaatagatatatgaaagaataaatgtcacatgtgatttcaaaacacgactgaaacaatcagattgcagtgtgttttctttccacagattaatcatatttctaaaataaattagtttctaacagaaatgcagaaacatataaaaagaaaatttaagaaattctacatctttctctctttttcttgggttttcacaaaaaatctgcccaagtgagagctgacctaagataagacctattcagcatgggtgaactggatacaaaattagaaaatggaagaattttttttaaatgttaacatcatgtaactctcaagtctacttgcgttttcttttcttttttggttttggtttttgtttattttagcttttgattactttagcttttgtttctgcattttcactcacacacacacacacatttattttttggttctagcagtataacacaaaggacaggggctctaattcttagttaagtgcctagaagaggttctgaaagtgtttactgatgatggcaatgacattaatgatcatctaacctgatcaaacaatataagctacttttcttactttacatgatcttactcatatcactactggtatttgttcttagcctagagaccagaaaaatgtataaacattcattggtgctagatacatccattcattgtggacaaaaataattagcaactcatggtccataggttcttttttaaaacttttatgtagcaagaaagctctagttgagatcatcccaaagaagacactattttaaaattaaatcagagttgttcttatgagtttgagacagaacattttcccataatacttccttcaagaatgatcatttttaacttcttactgaggagaagggttcttttgtttgggtttatttctgtcacagagccttgtttttaactttagtatcttctgacactattatctcttttcaaaatgttaaagcttctaaaaggaatatatcacccgtaaggtataattctgattgttttctttatatttctgacaagtgaaactgttccctaaggaagatatacttttctttttaacagattttgcaagaatttatcaggatcaaggtagatgtgtatatcgttggaactgatggtaagtggctttatttttgttttatgttctgacaatcacttcaggctcactgccaactctcagtctagacagcctctccaaagaatgagtattttatataatcatgatgaaaatctaatatgcagccagcccaataaaaatccctatggaaacagcatctttgtattttagttatgttgatatgtaattaaatacattctacaatttgaatcctgatttcataggcaacaaaggaggaacatgttaactatttttcactctaaacttcctgaaaaggtagccttgttttctgtctctcttcctcccttcccttgcacaatccagcccataacaatttggttgagcttcacctgctgatgagaccatccttgccaaggttatcagcgatgtccagattgttaggattaacggccttcatctcaggtccttctgcagcagcttacctgagcatctggcactctctctagcatttgtctttgaaactctctccctccctgactctggcaggacagttcttattcacctcctacctctcaaacatctcctcagggtctgacattggttcttctcccactttcagtctcccccaagcttcaaccgtacactctataccatagttctaattccacagactctttctagtcaatttcctacatgtttatgatttcatgtgcatctacttgttaatgaatccccaaactatacctccagcccaggcctttcttctaagctgcagaccaatggactcgactgtggatgtccccaggcacctcagatacacgtttttagaactacgtatatgattccccctcccaaaaatacttctttcctatcacaatcactgcatcactgcttacctagttttccagatagaaaccctgaaaccatcaccaatttctgctctccttccctctagtcaatgaccaggtcctataaatatttcctcttaaatcagtctcttcctctccatttccagaactttaatctagacccttctcacttctcaactaggccttctagaaggactttctaactaatatccttgcccatccctataatgctctcccatcccattttctgaaagaagccttcttcaggaatttttccgacaataactgaaaacatccttgcttccccaggcagagcaccgggtcttcagactgtttgtatctacagagtacgcacgtatcacataattttgcagttcagtttctgtccctactagactatatctcttccagggcaggtattgttcctgcttaccttcttcctgtctcttccctagatcctaggacatgatgggcattcagtaaagacttattgaatacctactatttatcaggcacagttctgggtgctgggaatatagcagtgaatctgacaagcctctgtcctcatgaagcttatagtctcatagaaaagccacataataaacaaacaaaagcatatttcaggtagtgataagtgctaagagaaaagcagagttaagaaacagaggctgggagcggtggctcatgcctgtaatcttagcactccagaaagctgaggcaggcagatcacttaagccccagcgtttgagactagcctgggcaacatggtgaaacctcgtctctaaaaaaaaaaaaaaatgttagctgggtgtggtggcatgtgcctgtagtcccagctactcaggaggttgagatggaaggatcgcttgagcctgggaggtcaaggctgcggtaagctgtgatcgtgccactgcacactagcctgggtgacagagcaagaccctgtctcaaatcaaaaaaaaaaaaaaaaaaaaaaaaaaaaaaaaaaaaaaaaaaaaaaaaaaaaaaaaaaaaaaaaaaaaaaaaacccctttttttttttaaaaaaaaaaaaaaaaaaaaaaaaaaaagaaagaaaagaaagagagaaagaaagaaagagaaagaagaaagaagaaagacgaaataagaaagaaagaaagaaaaaagagagaaagaaaaagaaagaaaagagaaagaaagaaagaaagaaagaaagaaagaaagaaagaaagaaagaaagagaaaaaaggaaggaaggaagggagggagggaggcagaaagaaaaactggtgatcagggatgtccagcaatatgacattttgagtacagactagaacgaagtgaggcagtcaaccttgacagtacttagggggagctttttagggagaggagacaagtggtacacatatccttcgaaaagtataaaattggcatccttaatctctccctttctactggatcctgtccctaaaatatacagacatattctagtttcaagacttttaaaaaaaacttttaagttcaggggtacacatgcaggtttgttacataggtaaactcgtgtcatgggggtttattgtatagattattttgtcacccagatattaagcctagcacccattagttacttttcctgatcctttccttcctcccacccttcaccctccgataggccccagtgtgggttgttcccctccatgtgtccatacgttctcatcatttagctcccacttataagtgagaatatgcagtatttggttttctgttcctgcattactttgctaaggataatggcctccaactccatgtacctgcaaaggatattgtttttttttaatttttttatatgtttttatatagtattccacggtgtatatgtaccacattttctttatccagtctatcactgatgggcatttgagtccatgtctttgctattgtgaatagtgcagcaatcaatgtatgcatgcatgcgtctttataaaagaatgatttatattcctttgggtatatatccagtaatggaattgctgggtcaaatggtatttttgtcttcagccctgtgaggaatcgccacactgtgcttatacactgttggtgggagtgaaaattagttcaaccattgtcaaggcttccttataattaaaaacatccccttgatcccagaaacctttaatttactaacaattttaccctttcctcatcatcccagatattttggaaagtatctgttcctgctgtctctgctgcctggcattcttttcagtctttatcaaagattatcaccttccttcccattgcatgccacccactccatcccagatcctggtggccacaatgccctccacgctccctctccctctgtcactgaaagctttctgtaaacagaagaatccatcttcataactgtgtaccttctcttcctccacttttctgcaaatcctaggcacgtttagacggtatctgctcaagttttcccagatacccaccaagaggaaaatttctcagaattttcatagtacatgatctatatctctctcatatattcaacaaaaaatatgaagacatactatgtgctgggaatttttttaaaactaagaaaacaataaaggaaaaaaactagattgctcctttccctcattattataccacacgttttctgtcagtactacaggaatatataaatgttctatcttccttgagggcaagattcaggtctaatttatcttttgatctttcttattactcagccagagttttgcacatggcagacataaggtaatagttggttgagtcatctatgtaaatgaatgctgcttagtgcctacaaaaatgggatttctcaaagatgattagagaggtaagtggtaaggaagatgttttctcataaaacccagcagctttgggaaaatgggctacaataaagaaccacagcatatcactggtccataaacatatgttccattttggcagaatcccaaactttaataagaagccacacttgatactctaatcattaagcagggagatcaattcactaggctcctgcctaaatgaattttcttctaggaactactgtttttcatttgctcctttgccttcctcctttttacattagggcattaaattttttttattagaaaggtatttgttagttccaaaagacattgtactaaagatagactggtattataccactgcaacccacacacacttaaccaaatgtcaatgaaacgcacatttgcaaatggaaggtgaaattactagcctcaaggggaaaccggtagccaaacaattgtttcttcctaaaagttactgtttttttctcttcagatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggtatcagctctttggtgactttcacaattgcataagcagccatctgcactccttaaatttctctttttcaacattaaaaaaaatcagcccctaatccatatttccattctctttttctcaggaaaaagatggaaaaattgattttaccataaatacaaatggaggattacgtaatcgggtatatgaggtaagattcttcaacaggtttatcttcacctagacatcacagcaaaaaaaaaccttcaaagtagtgaggccacttcctgcatgtggcagaaagtccagcacttgcttgagcctctgtgcctcatccctagaaaactgaagcaatgctaaccaatctcacagggagttttcaggaaaagaaactcagacccgtacaaaaacaggatgaaaaaatagtgataatagatctccattaatgcaatattgagcatatcttcttttgtttttcaaaccacttacaacaatgctcttattctggccctgtaataatccacgtagcagggaaggtattgctctttccatttacaggtgaattagcaatgaaaatgataagctaatacacacctcccaatagccagatgcttgagaagtccctagcacagtgcccagtcaagcaatgaaacaagtttctatccttccttactagagtgagttgccaattcagcatttaactggagagtcccatttcattgtagatgttcatttctagaacattcagtcctttaaagcaatgtttctagtttgggaaaagtagaatcacaaattaaaatgggtttctgctgtaggccaggtagatggcaggtgtattacattcattatctcaatccttataacaatatacaaagaagatatcttcattttccaaatgaaaaaaaaaaaaggaaacaggctcagagagcttaactaatctgcttgaggtcacataccaagtgaccccaacaggactgcactaagatctttctgatgacaagacctgtcttctgttctagtacaccatctctatcctctagtgaaagacaacggattgagggaccagagaaagaatttaatgattgtcttcaagcatggcaggcagctggtggtatttctcttagttgaaaggtctcaaaaaaggaatttctagtcaaaatgaaaaagaaatgtagagcataagataaatctggaacattattaagagtggtatcaagtagcaaaggtcagatgaaaaggccattctagaaaattggatagacctgaggtaagaggcgaatgtacataagcaccatgattctgtctcccaggactagattccagagaaacccaataaaactggcaccttgcctgagtaccttataagaaaagtctcacaccagaaaccctctcctcagtaattgtattcagaattgtcaccaagtattggaggataaagggtaggaatagcatttacctcatgtctgacccaaacactagaaccaattgtctaacaaatctagctagcacagtggtggaacttggcttccccatattaaaaaaaagaaacatttaacaccagctctttggtctcaaggaaggtaaatcaccagctgtggataggccaccagtggtgactggggtaacagctgaatataccaggccaacacacatagtcctttggaataaatgtgaagaaagatattgctacaacacactgtaccattactttaagttaagttaggcctttgaattacaatgtggtatcacatagatctatgttaaacaagcagtgatggaaggtacttgatcattaaaattcaagacaaaaaaaaaacctgttaactctggtaaattctagctcctaagatgtgattattgtaacagaacttgacgagtattttaaaacaagaactttctgtcttcttccaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtacagtggatgtgtcttgttttgttaaatttgttagctttctgaaacatgcttgctgtgggtcctgttatatagtggtctggctggaaacctgctacatgagaatcttctaacagaacccctgtaatcaggcttctttgctcagattttatgattaccagttttttaaagcatccaacctcctatccagattttaaacacaatccttctaatgtaatatctgtacctatatagatttagtatgaaaactatacaagctaaaaaatgagaaagcaaggaaggtgaaaagaaaagatgggtagccaattcttccgggtctcagtgggaagaagaaaaacagatggcaggaagtagtatgactctcttcttttttcactgctggttattatttgtaactcacagggcagaataacagctctagagctcaatttatctggaggagattcagcacacctgcttctctttttccactggcatggctcttggtgcaaatttgtatttatgtaatagttagaaattaaacatcagcaccaacagaaaaatattcaacgccctttattaaacatcaaacaactttgtcaatgggaaaagctgccccaactgttttagatcttacctctcaacattgttgtcaaagtacctttccactctctggtagtgtctttgagagggtttgtctattggacttaaaactacatacacaaaggtaagataaaggttatttacacagccaatcttaaaagtagaatatcagcactctttaatcttcccatttttttgtagagacacgatctatgttgcccatgctgtctcaaactcctgacctcaagcaatcctcctgcctcggactcccaaagtgctgggattacaggtgtgagccattgtgcccggccacagcactctttatagtagtgtttaactttctgagtcatggactccttatagagtctcatacaccctatggactttgggggaaaaaatacacacacacacacacacacacacacacacacacacacacacacacacaatttacatataaaatgcctcacaaatcttgggttaagaacttctcctctaaaaagagtaggaagtcgaaattgaaaacaggagcctatttactcaatcatttggcttgaagttgaggcaaatgccttatatataggattgtcgctgaggtctccatcttcccaagcaaaggtgccctctgcactcttcttgccaaccaaaccaaaccaaaccaaacaaaaacaaaaaactcaagaaacaagcacaagcactccaattcttgtgcccacatcacagtacattcaaccttaacaccttagaggtttacttatccttatccttaaatgttttctttcttgtaggccactaaggttgggtatgcttctagtaatgggaatacatggggctgagcctctacttgcctgcctcagagcacatattggaaatttcctagtaccaaaatctgatccctaatttaggaagaagtcaagagaccatgttggaagataaaaataaacgtatataaaccagaacaagattggaggggagaggaggcaactgggagacagaacaacttgtgaagagacaaatacattacagaaattcataaagtgtgaaagtaatacatgttgagcagtgtatctttaaaattattttgtaagttatttaagcacttgatacatatttttgtctaaacacaggaacttaccacttagaaatgtaaatgaaattttttaaatggctgaccctacactgcatgaacaagaatataaaagagggatatttaattcatgtttctagcatcttcctctggatttcaacatgtcaaggctgatctgctgatcttcccctaatctgctctaccagcattttttctacctcagttaatgacaactccatttttcttaagctgatcaagccaaaaaatccaccaggaaatcctactgactctctttttaaaatatagtcatttaactgtcaaaagagtccccaataatgtcagt

SEQ ID NO: 17092 - DNA, 6355 bp, Human
gctgggcagtctggacattatctttgaagcccaccacatataagtcatagggctactggaggttttaagctaaaagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcgacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccggaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagatttaaaaacaactggctgtttttttacactgtggtgtggaagattgtgttgtgttcacaacttttcacttcttcccctgtgtgattacacacacctgcccttgtggtgtgacttgcagtgcgccctacaggccacacaaccccatgccctccaccactggctctgctgctggaatgtgagcagaagtgacatctgcctcatccaagcagagcctcttgctcagccacaggaaggcccattccagatcacacccgtcagcccgtgcgccctggtgaatgagaagacacagggagctgcagccacatataacatgagcaagaagtctgtgtttgctgtgataagccactgagttttaggggttgtttgttaagaagcacaaaaaccgattaagacatgtggtatatagtgacttcatatatagaatctggaaaactatccatttattttcaatcatggaattcaatatgacaagcatcccggagggtctacctatgccagactgggttggaaacagaaagacagatgttaatgccagtgtcctttacacctccaagtccagggccagctgtggagtgggaggggtagagaaggtcctgtgcacagtcacagtgcgctgtgcagagcaggaacagaggcatctgtgaaaagtgctgagagcctggaggacagagtgactaatgcaatgacagtcttgcatcataggaataacagccacagcaggattttattgctgccaaagaaactgccatttaaaaattgccagccatccgggaggctgaggcaggagaatggcatgaatccaggaggcggagcttgcagtgagccgagatcgggccactgcactccagcctgggcaacagagccagactccatctcaaaaaaaaaaaaaaatgccagccat

SEQ ID NO: 17093 - DNA, 7440 bp, Human
gacattatctttgaagcccaccacatataagtcatagggctactggaggttttaagctaaaagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcgacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccggaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagatttaaaaacaactggctgtttttttacactgtggtgtggaagattgtgttgtgttcacaacttttcacttcttcccctgtgtgattacacacacctgcccttgtggtgtgacttgcagtgcgccctacaggccacacaaccccatgccctccaccactggctctgctgctggaatgtgagcagaagtgacatctgcctcatccaagcagagcctcttgctcagccacaggaaggcccattccagatcacacccgtcagcccgtgcgccctggtgaatgagaagacacagggagctgcagccacatataacatgagcaagaagtctgtgtttgctgtgataagccactgagttttaggggttgtttgttaagaagcacaaaaaccgattaagacatgtggtatatagtgacttcatatatagaatctggaaaactatccatttattttcaatcatggaattcaatatgacaagcatcccggagggtctacctatgccagactgggttggaaacagaaagacagatgttaatgccagtgtcctttacacctccaagtccagggccagctgtggagtgggaggggtagagaaggtcctgtgcacagtcacagtgcgctgtgcagagcaggaacagaggcatctgtgaaaagtgctgagagcctggaggacagagtgactaatgcaatgacagtcttgcatcataggaataacagccacagcaggattttattgctgccaaagaaactgccatttaaaaattgccagccatccgggaggctgaggcaggagaatggcatgaatccaggaggcggagcttgcagtgagccgagatcgggccactgcactccagcctgggcaacagagccagactccatctcaaaaaaaaaaaaaaatgccagccatctctctttctaaagtggaatcctcaagtctcgtttattctggggacatttgagtaggctgttcgagttaagcaggtggaagatgatgatccctcatcatcattctgagggatgagtgtctgaagactttttggtaaggaagggtcttggcatagcccaccccatgccacctcccttgatctgtgatatccccagcagctggggaggttggagcattttgcaaagaggccccgaagcctccagaaagtaaaccttcaagagcccatccttccttcctcttttgtttttgctcattatgaaaacttccctgacaaattgaaaaggcttcaggtgagattagcccacaggaaaaaccaccaagggccacccagaggggccacactgtgacagaaggagtatgggctggtgagctgacctctggaagacagtgcatgaattgaggagaagagattggttccaggcatgggaggaatgaggctggaaatttcttcagacattgccacttcggcactctgtgtgtgtgtgtgtgtgtgtgtgtgtgtgtgtgtgtgtgtgtgtgtgtgtaaacagagtcctgtaatgcaaggtccggccttggcagccccagcctggagccacagtgagatgtgagccgagggttatgctgggaaaaacctctccctcccagcacctgaaaggctctgcaggcccagcagctcagcaagcaagggtaagggcatggactaacatcttatttcatactatcccttataacacatcctaatgtaatcagctcacaatatgaaattatttcatttctctccagtcattgtttcaatggggccttagggttgactggattctggaggtccctgcctagaggagggggtgcattctgtccctatgtcccctcctgctccatcctccacagcacgtgcctagtggtctaccttgtggggaattcttgtacctccctcttctaggcatggactagcattgagaagtgggagaggagtgttaggaaaaagggcaaatatagacataccttgtcttattgtgctttacagatattgtttttgttgttgttgttgttgtttacaaattgaaggtttgtggcaac

SEQ ID NO: 17094 - DNA, 19412 bp, Human
accccttctcctcttccctgacggccagcctcaccttccttcctcccccgagactcactccaacgtctaggggcaagcagtgtctaccttgtatgctcttacctgatgaggaaacagcctgagtcaagagaagggagaagcacaggcttttcctcacccatggcaattgcaatagtgcgtgtctcacctcgctgcaagctttccaaggacgcaatcaaacacgggggagaaacaaattcagccaagaaagtcaagtaagggaacatcttcttccctctagcaccagttccttttgtgtctttatttgccaagtgagagggaggagtgagatgccagagcatctggctggttctcagctatgtatagtttcagacaccatttatttgcaatgagcgcccgccgagggaagggaatttcacggctccctcgcaccgccgttccttaaggctgatgaatcagacacctctttcgttcttactgtgcatgccctctacctttcagatgacctatttgttggcctttttccatttagacaataaacccaagtgcaccttctgcatccctttgctctacgggaactgagggtgatgaaggggacatgcgcctgggagtaccacgccatgacagagcggcattgagtcctcgggacaatcaatacaccaagaggtggaaattaacatccacaagagtgtagtcatgattttcccccagaacaaatatataaaagggatctttgtcataacaatgacaggaaatcattaatcacatcaggattgaagtccccactgtagcagtggatgggaagacttcgtctgtgatcttcattaaaaatgcaatattttgtatatttagcttttttcaaagttttaccaaaacacctgtaattaatacaatttattgtattatctttgttaatgtatctgatgtgcaaaaccttactagatttgccccaatttgaaggtgtctgtggctttccagcactccatgtgttcctagctacatctcacaggcagactttctaaagcagtgcctttcaatagcactgttggcgacgatggacaggttctgtatctgcattgtccattgggatagccactagctgcatgtggctattgagcacttgaaatgtacctggcatgactgagaaactagttaacacttaaaacatttttcttttttgatacagggtctcagtctgttgcccagggtggagtgcagtggtgcaatcttggctcactacaacctctgcctcctgatccttccacctcagcttccctgagtatctgggactacaggcatgggccaccatgcctgcctaattgtttttgtgtgttttgtagagatgaggtttcaccatgttgtccaggctgttcttgaactcctaggctctgcctagtgatctgcccgcctcagtctctcagagtgctgggactacagaggtgagccactgcactggccctagttagcattttaattaatttgaatttaaataggcacatctgcctagtagctactgtgttggatagcacagccctccgggttctggtacgtctgtcaaggccagaaaaggtatgttgcgatggatagtgctacatctgccactgggtggtaatctgatacaggcctgctcaggtgacaccacctaaagaaatctcatcagtgtgcacctctggcaagcctgacaaggctgacttctctcgatgggatcctccaatttccccattccctgtaagcagctgtgctgtctaggaagagaatttgctcttagatcatcagtctgtatgtgcgtcttcagatgagacagtttccccttatcccagcagttttcagctttttgtttctggttgcaaatgattgactccgctgattgctggaagctacacaggtgactccccaccctcttgggctaccccaccagtgacaacacaggcaggggtggcctggcttcctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacagtgagtattgctcttcttcttgttgcccccaacccagtgtcatcttggccctcagttgtgtgctgctatgatggcttctaaaacctgggcttgcactcatttgttcagaggtcatgggcaccaggcacttttctagaaacttccaggaaggtaaatgggaattggtgatgcccaacccaggtttcttgtagggcgagtaataaaactccctcccccttcacatacatgaagcttaggcttaaggcagtctgtgatttataccttaaaggaaggagaagcaggtgctgggggacaagatggtggccaggggtaaaggacacacccatgaggtccttgagtctgagacactgccccatggaaaggattctttgtagcagtgaaaaactggaaacaaggaaactatgcatcaggaggcgaatggttaaatgaattgtgatgtatctagacaatggaatacacagcagccatccaattctatgatacggttctatgttgaattggcatggaaggtgatccatgaaagatgggcaattagaaagcaagatagaagattatatgtgtagtctgatttcctttctattaagtgcgtgtgtgtctgtgtgtgtgtgtgtgtgtgtgtgaggttgtgttacagagaaaaagtcagaaaggaagtatctcagaaacttaacaatggctaaactaggaaagggtgcttcaggagtttttattttctatattatgtatgttggcattttggggattttttgtgcattgtaaaaatactcctttatgatcagagtaaagcaaaaagttattttaaatgactcatcagtggatgctggtttgccttttcaaacacacctaccctctttagttctgaattagctgttactccatagacggctggcaagtccatccagagagtggtcactgtgtgctgaaccggaagggctgtgcagcagccagtctgtgggatcccatctccttactccctttcctgaacgagcaaaagctaatttactatttcagcatctggaatttcggagtccttttcttccaatatctgcttatctgttctgaagcctctttgtgtaggcctcactcacaggcttgtgttgggagcccctgggccctgtgcagcccctgctgggcggttggcaggcatctgatccaggcatggtgagtggatggatctgatagatggctcagagaccctgcctcgtgtagggaacaaaaagcagagctatgaaaaaatgtaagagatgattcaagctccgtgtagcaaattgtacaaagttcaaagtaaggacctgcattcctgactcatgttagtatctgatttgatgttagtgctgtaagcatcagaggctataagtgtggggagatgctgtgtgcacaataaccccatgctgattttcatgttggctacttaagaatgttagagaatacaaaaatagtgattggataataataggttccaagctaacttttctaataggcacttttctcttttggagaattagcagctctctcccttcctttatctcccaggtccctgcacataccccatgctttctgactttcatgccttagtgcatatgttttcccaccctggagcaatgttccctcccctcgttgcatgtctccatgctcttcggccttcaaggacccgcaaaaatgtcacctcttcaatgaagccctcctggattctccccagagctaaagacatgacctccttcttccaattcctaccacaactcatagcactttccctttgttgttatttgcagccatgacttactcagtgtatttgaatgcaagcttcttgaggacatggatcatgtcttacacattgtttaagccaaataaatgtatcaggtactcaaggcacattgaataagtgggttcgatggatggcccatggcacctgcaacaaggcctcactgagcagcaagggagagatttgccacagtgctgagtcaactgcccatccactcccgacagaccgctgagatggtcctcactctcagtatgtttggtcatatgtgggattttcccccctatatttttcccgctttctcactggcaagacaaaaatgaaagcaagcactgagacttagtagctgggagaataaaatatttgagaagtattctgacaaaaatgaaagagaaatagatggcaaggctgtctgtggaggttctagatgtgggctctagggaggggtatgtcctgtttttactctttggctctctccaaattttctatgagccagaagcagatgcatattttataaactgtaatatattacattctattatacaccataatatattacatgatatatactatttgtttatttattttagagacagggtcttgctctgtcactcaggctgcagtgcagcagtgcaatgttagctcacttcagccttgaactcctgggttcaagcgattgtcctgcgtcagccagctgagtagctgggactacagggtaggcaaccatgcctggcatatttttaaattttttgtagagatggggtcttgctctgttgcccaggctgatctcaaattcctggcctcaagtgatgctcccacctcagcctcccaaagtgttggaattacaggcatgagccatcttgcctggcttgtgtttatatattacctttaaaaaaaaaaataaagagaaacctttatagaaagctagtgtacaacttagttgcataaagtagcctcggtgaatgtaattactagacttgctctttctgcggtagctggagcaggctacaagttcctcctctagatgagttttgtaaacaggtgtgctgaacgttagagcattgggcttcttcttcttttttttttaaatctgacaagttatttttatgacagctcttaaaataaaattttacacacttggtaagatatttaaatagtttgcaaaatctaaatgaaaacatgaaagttcattttccactggtcacagtggttcagtctccttccagaaaatgtttcggtgctggtgagcagtgcagtgtatgtctttttctatttttttttttttaaagatcacacaacataagtcttcctacatgttgcattttaatcttatagtcttgaggacctcttttctatcagcatgaggaccatccttgtttattggctacacatggtttattggattgatgtgtcataatattaccaattgctgaatatttaagttgttttccaatttttgttctgctccaacatatatccctatacctggacccttgtgttcttttgtgagaataccagtagggcaaattccaagcagatgcgctgcagagtcagagatgttgtgctttgtaaattttgacagatatggcttaaccctccaaaaagatcacataaatttatactcctcacagcagtgtggaggccttttttccaaactcttaccaatgtcgttaccatctattgctatttccaatctgaaacttgctgtcactcactataacaaagccattctttcttctttttgtggtttctttctttgggaatttttctcaggtattacatgattaatattcagtcctttcatgcaagcaaaaaggaggtgacataagccctgggtattagaaatatatatatatatttatataaatatatatataacatatatatatatttatataaatatatatataacatatatatatatttatataaatatatatataacatatatatataatttatataaatatatatataacatatatatataacatatatatatatataacatatataaagtgttttctaattgatatctcaaaaatcaacctccgtattccccaagctgtaataaaataaaatttgctgagttgaggtcttccaaactcaactgggcatttttcatctggggcaaaaaaaagaagagtaatgctcagctccaaagtggctgcttttctgcttgctgggtgagtttcttatttcaaaacagaggctcactgggcttcttgatggcacctggagtcatgccaagcaggaagcaatcactccacagagctgaagatgtcagaaccgttcagaaatactgcctggggaaagttcttggttcttcggcttaggaggaaaggggcagaatacaacctttctgaagaaaatgcatctttcattcacctgagaaatatttcaaaataactataaaaagaagttagaagcaggtgaattgccccacagaggggaatgtttaaatgaattggggcacagcccctgtcggaatgccaggtagctgatgccttcacctgtctgaagaatgtttaatgatgaaagaaatgttcataatccgttaggtgggaaaaagaaaataaaagttcaaagtgtacgaatgcatagaaacacggctgggagggaaaacaacagaaagttaaaagtggttattttagggtaggaagattacgggtgattttgattttctcctctcggcttttctgtatttgtcaaatttcctgcaaacacgtgtgttacttttgtaacaaaaaaagtcatttttcagataaatgtcagtgttttcctggcccccagagggctgcagtgaaattcggtgaatgcccaggtggctgggtaaggtcacggccggaggctggggctactcatttttatttcagacacagtcctgttccaggctttcttgtgtcttagggtcaattgccaaaatatttttttctcttctaaaaatttattgtgagtcttacttgtatctaatttcaagctcactgaaaagtgaaaaattgtgtaaagaatgcttataaacccttcacccaaaccattgttttcattttgtcctactggctttattattctccttctctctatatacatatgttttcattaattttttgcattttttgcttattttttgaatcctttgagaatatgccaaagacactgttctcttttgcccctaaatacttcaggggataattcctaagaacaggggcattctcctgtaaaaccacaatgcagtcagcaaaatcaggaaatttaatccggatgcagcactatcatcgaattcacagcacctattgtaatgcccttaatttcccagtaatgtccttcacaattattttttttccccactccaggaccaaatccaggttcttgccttgcatctacttgtcctgtctctttagtctccttcaacctgagatggtttctcagtttttctttgtctcacttgaccttgatatttggccaattactttgcagaaagtccttcattttgcgtttttctgatgcttcctcattctttgatttaggttgaccttttttccaggaataaagatgatgtgtcttccctcctcaactctttaggacaaatgtgacactggtttgcttccatgttggtggtatggggtttgaagaccaacttagctggtcttcaaatccaacaccatcaacatgtagttacatgtctccaaggagccctggctgtttagtggagaaagatatttagattccaagatcagggcactaggtgctaattatgctgtgtatcattgcttttaggtcctctcagcagacagagacaggaaatatgtatgtgaaacacacatacatatacatatacaaattgtctatctatctatctaatttaatcttaaaaacatatgggtataaagacatgtgaacatgtatgttcattccaacactattcacaatagcaaaaacatggaatcaacctaaatgttcatcaacgatagactggataaggaaaatgtggtacatatacatcatggaatactacacagccataaaaaagaacaagatcctgtcctttgaagcaacatggatggaactggaggccattatcctaagtgaattaacacagaacagaaaaacaaatgtcacatgttctcatttataaatgggagctaaatgttgagtacatatggacacaaaaaagggaataacagacactgggacccccttgaggatggagggaggtaggagggtgaggataaaaaaactatctaccagtcaggtactatgcttattaacctgggtggcgaaataatctatacaccaagcccccatgacgcgcaatttacctatatgacaaacctgcacatatacccctgaagctaaaataaaaggaaaaaacccacaaaaacaaaccaaaacaaaaaaaacccacgtgggtccgtagtgatctctcaagttggctacaacagcacaaggcactccagtgcacttttgaaaagctaccagcagagaggttaccaggaggaagttctggttgctttcctcctcagggcctgctgacagccggagatgacactgagaagtgaagtgccagaaggttttcatcgtactttgctttttcctgccttacttgaacagctttattgaggtccaattataataaactgcaaatattaaaatgcagaatgtaagttctgacgtacatacacccttgcgaagctctcacacaacccagacagtgaacatatttatcccccactgaggtttcctttgtacccacctgccctcctgccctcccacactccccttccctctctctctctctctttttttttttgtttgagatggagtcttgctctgtcacccaggctggagtgcagtggtgcaatcttggctcactgcaacctctgcctcccaggttcaagtgatcctcctgcctcagcctcctgagtagctgagactacaggcgcacaccaccacacctggctaattttttgtatttttatagaaatggggtttcaccatgttggccagactggtctcgaactcccaacctcaggtgatctacccaccttggcctcccaaagtgctgggattataggcgtaagccaccatgcccagccacctccccttctctctctctctattgccaggacatcagtgattctgctttccgtcagtatagattagtttgcattatttagagttttatacaagtgaaatcatacagtatgaactccctttggtctggctacttggcataattgtttggagacttgtccatgttgctgtgtgaatcggtcattcattccctattccattggacggatatttcacagttaacttatccatttactacttgatggacatttaggctgttagcagtttttgcctaccacagagtaaagctgtaataaacactcacatactagtctttatggggacatatacttacaattttcttgggtgaatacttaggagtgggatgactggatcacatggtgagtgcatgtataacgtcttaagaaactgccagttttccaaagtggttttaccacacattatgcattggaaaccactgtactttcagaaaagcagggtggggtcatgatgttgttatggaaaggaagccaacaggttggctttataggatttatgaaagaggctatttttttcgagaaccttggggtgtgatgctggacaggtttccttgaaatgtactcgctaagggtataaaaggaaatgccccagctcaggcacagacttcgtcctcgaaggcagtcaagctgttgtttctttggttatgtaggggtgggctttaaagaaattcaaaacacatgaaaatgacaactcgagatttatttcagtcagttccgaggccctgtgcattagggaactagaactcattttcttcagtacacaaacctaggacttccttttcctgctgaagtcagggtaaagaggagaaaggtgggttctgggggcaccgggtcttttagggaggggccccaaccccagtgggcaccacccagccctcatgttcttcttgccacctggttactcaaaggcccttttcctggggagtccagagcccagggcattctcaaagcgaccactgtcctgttagcttcggtgagtcccttagctgatagagcagggggaaggggaaccagtcagcaaaacaggacttgacagacaagctgaatcaagggaaagggagctaatgtagaaaggatgagctgggaaaaatgtaacagcccacctgccattcctcatttgtggatgggagatgtactaattattgtctaagtagaaagaaaacaaatgctagaatcaggtgaccctcagagtcaaagaagtgaatgataacttcaaaggagaggttcattcatttctgtgtggactactcagatgattctgaaatctagaatactatatagactctaactcctgcttggaatatttttttcagaagaataagcagatttaaaatttaatctccatctttttggcatttggttgttactattcgtttacaagccagtccactttttgatttttgtcccttttccaggagcaggcttgcatctgactgacccaccatgacacccacagacttcacagtgagtacagccgtgctcctctggctcctcaaaacacacactcatcttccctttttagggggtgtgggaaggatccactgtgggggaaggatttatctgtgtggtttcccagggtaagatctctgcctggcaatgcgcattgctgggtaggttgttgtccagcacagagggttttgcaaatgcaaagaggcagctatgctttggggtatgttgtggagacagaggaaaatgtggtgttataaacagctaaggatttttaaccatctttaactagggtgtgcttagttccatatgcctgttctaaaactcagacaaatgaggcaaagggagaattcatgtaatttgcttttaaaaaacccatggtgggcacattagttgtatttcttgcataacattatgtagaccttatgaaaacacgtaacagtatacattcccctgaaagagaccaagagctgagcaaaaattagtgagtcagtctgggcgtggtagctcacgcctctaatcccagcactttgggaggcagaggcgggcggatcacctggccaaggccaggatttcaagaccagcctgcccaacatggcaaaaccccatctctactaaaaatacaaaaatagctaggtgtggtggcatgcgcatgtaatcccagctacgtgggaggctgaggcacgagagtcgcttgagcctgggaggtggaggttgcagtgagccaagatcacgccattgcactccagcctgggcaacagagcgagactctgtcttaaaaaaaaaaaaaaaaatcagtgagtcaaatcataatccagagaatctttttttcttttacagccgaatgtaattaagtgtagaatcaaattaatttcccatgcttttgtaacattcataaatgccttataaaattacctaagggctttgattttgctcttctccaagggaaagcctgggttttacatgtagataattgaaatccagacttcctagcaggcgggctaacaaactgcctcacagtacattgtgggtttccatgatctatggagagtggtggttgaaacagtttatcaactaaattatttatgatatgctaatgattcattagtattacatatgtatagttacctaattgcacctatatccataacaacaaaaaagtaattaatttggtcctggtgaagtaactattattctgacaaaaagtagactcttcagtttctcctgcattaaattcacctttcaatccctgaggctgtggaaacagaagtagatgaaggcagcagagccagggctgcttctgagcttgccagtcatttgcttttatcatttgggatcttggataatagccaactctgcaaagcagccccagataagaaggaaactgcacctcagtaatgacctgctcttgtcagaggagtctggcgccatctaaatgggaagaagatgggacccctgtggccctgactcccatattccatggaaagtagccgtggcaccctgtggccacctttctgaggatgtgctgggccagtcacccatgcaggtgccccacattccctcagcgtcacagtaaaggcagagtcctttttacagatgaggagaccgagactggggaaggtggtttgagggttcaaggtctcatagaaatttggaggaatagcccttgaggggtgctgttggcaatcatagctttgctgggttcctccctcagggtgaatgtcaaagcactgaaatccaggtctcaatgttgggatttaatactttctcaagtgtggggccaaggtgtctgccagagtccctgctgataacaaattcattttttccccacctccctccttcttgtgccctctcttattccatctcccccattgccttgtgcccattcttggtgctaaggcacaatggaagccttggcaagcacagtccctgccctttctctgtccattccccagagaggggcatcttgagcctgggtttggctgaggatttccagagaacacatgagccagagaaggaggccctggaaagctctgggaccttcttcctgctctgggtgttcacaactgggacgcctgggctgctgcttctgagcccaggactcctgagggaagaggacgtgcctgtgtgggagcaacagcctgtgggctcagaggcttgccaggacacagacaggcaggatgggccccttgccctggctgtgcactgaggtttgtttacatttactgagggatttccagaggatttgatgtctaagatccatcaggcatgtgcaaaactatgagtgtgagtcatgacacagggggtgttgttccaggattcctctcgtggtcctgacaaattttatataaatctagatttggggtgtaaaattcaatcacttaaaaaatatgcctggggagtccctaacctaactaactaagtaacttcatgcaaaagcacgaggtccttaattctcacccagcagaaaaactatgccccctgggcttccagcaggacacaatgtccttgtctgggattcagtcttgggagtgttagctgtgcctgctcaccgggcagtggagaaagctgggtcacccaggtcctgggatttctgcacaatttctcccattctgctcctgcagtctcctccaggccccgctccagatcaccttccctcgctggcccaggaatccatctccttccaggaccttagcccaggactaacacagctaagtgatgctggccttcccacctgccccctctcatttgttccccaggaaccaaagtcgtcccttgtgcttgtccttctgccaagcatgccctctttcctcccttgccttcttctttcttccttgtctgtcttcctcttaacatgtctttaaaatccatgctgctcctcgctacctggagctgcagcaggaggagagcaggcttgctggaccggagaagcaactccaggcagcaagacccctgggccctcatctgtgaggctgcttgcgatttgcttcacagccgtgggctcaggctcatgtgagagtctattaaagctatttgaccaaaaaaaaaaaaaaaaaaacacacaaaacacaaaacaccaacccacaaataacaaaaaaaaaacttcaaaagcaagtttagcacttattcattgtgtggattcacagtcggtacttgctcatctgcattgttttactgagattcctccaaaaggtcatcctcccaacctcttaaacctgctgtgatgtccactgtggggtctccatgctcttcacagtcttccttctattctcaagttcttctttcactcaaagtccactcaaacctcacctcctacaggacgactgtcttagtggggccatgattgcagctggttcccgtgtccagcgttgggaggattctcctggcatgtttctaaaatgtgtgtcacctaggaggtctgtcctctcgagagactgggtttccagacaagggccaatgctagaagaaacatctctaagtgtaaactgaaatggattaatcaagccaagggactaatcacatataaaatagggagacgagttttctttagttctttgcgtttgtgggccatttccagctgccctggcctgaagagccgcctccaggatcctgctcctgggtccctctctttgcaataggattttctcttgctcacatattggagatggagtcaggactagatgtcagattttcccagttgtcatccaagttaccttgggtcctcctgctacttcctgccagccagggcccaaataggactaacatctactgtcctttatcaatcaattcagtgagccctgatatctaagaagccctccacaaacacacacacaacaggttctatgttccaataaatttagaaaacattgttaaacaaaattcaacagattctgaaggatttctcagagtctttactgtgctaatgtgcaattaaaataaaacaagttctgggccgggcatggtggctcacgcctgtaatgccagcactttcggaggccaaagtgggtggattacgaggtcagaagttcgagaccagcctgaccaacatggtgaaatcccgtctctactaaaaatacaaaaattagccaggcatggtggcacacgcctgtaatcccagctactcaggaggctgaggcaggagaatcgcttgaacctgggaggcggaggttgcagtgagccgagatggcgccattgcactccagcctgggaagcaagagcaaaactccgtctcaaaacaaacaaacaaataaataaaacaagttttgtaggacttttcagatccttcaatgtgctcaggagtattgtgaatttcaaagaaggaatatgcaaagattctcaactattttaaccattagtgttccacctaaaacatggtttgggaaatgctagacagatctactagaaatagatggatattacaatgtatacagatagggagagcccagctaacaggaggtagagaatattttgctatttaaatataaacattcaagtacacaaaatcatctttgtacttatatatttgttaatattaactgttcaaaacaaaataaaaacttattgtggatttggggtgacttctagtccaaatgtatccagatgaattgaactattgcatttgcctcaggataaataaaagtagagatgagatttggcaaggaatgtccctcaaggaaagggagtgagagctggtagtccctggtggaatttgggagtcctaatgggagccctcagaaggaaactggtgggaagtgagagcgcttgaagatctgtgggcagaggttttggaaggaatgtagcaggcatggcacggactctcccctcctcctccatcagcagtccacatccttcattacctcccaccccaggtttgactcaagggcttacatctcagggtctcatttccagacctcatttcctgtttccgtagcaggggttttaggatggcttctgcttcaggaacccagaaaaagtgtaagaagtgtgtgtgtgtatgcgcatatatgtgtgtatatatgtgtgcatgcatgagtgtgtacctatgtgtatgtgagcatgagtgttggcatgtttgtgtacgagagcatgtgcaagtgcatgtattatgtgtatgcatgtacatatgagtgtgtgtgcttgttggggccagcttcatggctgtgcaacccacacagtcacataggggccctgtgcttagaagtgctgcttgtttgattgaatgctggatgtgttgaaattcctaataatttttggaccacgggtcctgctaactatagagcaggtcatggtgcttgtgtgtgtatgtagggttgagagtgtctgtgtgtgtatgtgtatgtgcatgtgtatgtgggtgtatgctggtgctcccggagctttcaggaaactcaggggactgggatccagatgagtttaagagcccttgctaacctttttagggtcagtgaaaaactgaatagataggagaagtacgatcacagtcatatcacagtttgataaaactgcccatcagtagtgtggaggcactcttaccccatcagagcacttggcatgcacactataaatgttcatttgcgtgtctggttgctctatgggtaggtaagtttcctgagagtgaagccacacatctgacttatttattatggtttctttggcacatagcacagtagccaacatacagtatgtgcttaataaacatctgttgaataaataaatatgtcacaacccaagcagatgtcctcagaatgcctatgtgtctttggccttatcataggtgtttggggttggaagggtcaagaggtccatgcctctgccatcagacaggaccttcaaaatattttccttgacctaatgccatcttgtgtccccttgcagagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacattaagagtgtgaaggctggtctgaaggtagtgagctatctcaatcggattgttcacactcagttacagattgaactccttgttctactttccctgcttctctctactgcaattgactagtctttaaaaaaaagtgtgaagagtaagcaatagggataaggaaataagatctccaaataccttaaaaccatcatggctgacaactttttatttctcctctgtccaaacttactcctcaggcttttccgtgttagtcaaatggaatttccaaggaggactattggaacagcacagtaaaccacccctggctttgccacttgctttagaggaagcatctaatttccccagtgccttgtggatcgctgtggtttccattccaacgccatccctttccaaaggggagacaaaagcactggaccctgccatttcaccctttttctccctgcccacttctaaagcacatgagaatgaggaataaagtgagcagacatgggcagcagccagggagggcgaaggggtgaagcgcaggccttgctaccccatcaacatgctgcccgtgagggggcagtgggtgggaagaaaacatcggcctgggaccagcagatcaacgtgggcccagcactggcactgcatccgtagttaaagggaggataacttctccaaggtcacttatgaacacagccatccattgaccatttccaagaggagacccagatatttacccttataggaacttgagagaa

SEQ ID NO: 17095 - DNA, 36855 bp, Human
cctcaggagtttgagatcagcctgggcaacatggcgaaaccccgcctctacaaaaaaatacaaaaattagccaggagtggtgacttgcacctgtagtcccagctaattggggggcttgagggtagaggatcacttgagtccaggaggcggagtttgcagtgagctaagatcgtgccaatgcattccagcactccagcctcggtggcagagtgagaccctgtctcaaaaaaaaaaaaaaaaaaagactaattttgaaagccataaaaaatgacttacaaagtttaagaccaaattaagactgtgcacatttttttcctcttaagtaacagtaaagacatgttttaatccaagcaaatgcagagaagcaaattatctttactctcacaattactacatttctaagtctcctccacaagtactatctttttctttatattccctgccaagcctgaccctgaaaggtcagtttactagaggtgccagataaaccaaataggtaattcgccaaagcctcacttccttcttagtttataaagcaggggttgcaagggaaggtttattagaatcacctgggaagctttttcaacctacatgtgtgccacagcctcctctccctcttaggaagcactgttctagtttggggcttcaatctgtcccacattaaaggtcttcatctttctaaatcctacccaactgaaggttaatggagtagaaacaattgaacgcagaagtcactgactttgtcacaaactggctggacaagtcccttaacctttctggtctcaagtttttcctccgattttgggggttccctttaaactttgacattcttctatgtgaccgcatgtcatgtctaagaagccttctgaactactcctagcatgggatgacttgccctttcttgcttttccaacagcctgtgcaatacaacatatcacctattttatactgtcctatattgccctctagttgttttttaatgaagctttttttcttctcaacgatatgtagtttaaaatactagtttaaaagtttattttcaggggtagacagtgtgcctgctacttaaatctcctaggacaattcaggctgcgtcctaaggtaatcagtatgtatttatattgctttgttcaaaacaatgacgtcccttctttgaagtcctgaaattatgttttccatcagttctgtccagtagaaatataatgggagctacaaatatagttttaaattatctggcaggcacatttacaaagtgaaaagaaagaagtacaattaattctaataatatatttaatccaacatatccaaaagactatcatttcaacatgtagtccatgtaaaaagtatttacatttttcattcttttttttttaaatgtctttgaaatctggggtgttttttacacttgcagcacatctcgattcaaaatagccactttcaagtgcttagtaaccacatgtagctagtaactacctactgaacaatgctgttctgcataagttggctgctttccaaactgatcactttttttttttattcagataatgactgatactgagtactcaggctagccagagtggtgcaaagatgagtcaaattcattctgataagagagatttgtaagtcactagcaattatacagcgtggtaggtgccatgatagagatgcataggagaaacccagacttggcggctgaagggcacagggtggaaggcggtagagagacaaggaaggttgcacagaaataacatttgatgtaggaactaagtgcacgaagggaagccggctgtgcggtgaccggagttgcaggttgccaatcttgctgaggggggctccaccggacgccggcctacgggtcgtaggcgtgtgtggggtgaagggggaagaggacgggagaggattggctgggaggaacccggagctccatctggtgggtggacggaaaccgcaggggggcgctacttgcacttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagatagtaataatggctgagaacgaaggtaataatggttaccaagggtggagccattgcgcctgagtggaggggacctttagtggtgagaacgtttcgttcctacttaccactgcgatcttgtgtacattgtttacattccccacctctcttcccagatggttgatatcttacgactctgcttcctagcgtctgctgattgcataggcattgggtgtgagccctcagccactttcattgagtgaaactggccgctgttccccgtgcctcctccctctggtccactcccagcccagcctcccactccgtcccccagaaagcaagggccacaatttgaatgcctagtcaggcttcactgcctcctttttgctcttccagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaagagggtggtggtaagggggaaggaatgatactgaagaatgttgtagggtccacatcaaggagagcctgggatgtgaggaacgtgaagagaaacttgttgctgagaacttggtaaggtgtttgaatcccagctcgacgactgtgattaatcactgtgatttgtggtaagttatttaatctttcagtaccttaatttccccagctgcaaaattcagataataataggttcttcctcataaagtagtttatgaggattaaaagagaaatatatataaagcagttagcccaatgtttgacacagtaaacactcaaagtcaactattattatttgtggctaagagtatgggtcatagagtcagagacctgggtttgagatccagctttacttataatctgttggactttggggaagttatttaacctaactgagcctcagctttcctcatatgtgaaatctaagtaataatggtacagatggtccccgatttgcgatggcttgtcttagaattttttaactttatattggtgcagaagcaatacacagtcaggggaacatcaataaattacatgagttattcaacactttattataaaataggccttgtgttagatgattttgcccaactgtaggctaatataagtgttctgagcatgttgaaggtaaactaggctaagctatgatgttcaataaggtgtattaaatgcgttttcaacttaccatattttccatttatgatggatttattgagatgcagccctattgtaagttgagatgcatgtgtacctatctcagggttaataagcacaaatgggaaaaatcacataaaacagcacaatatctggcatgtggtgagtattctgtaaatgtcagctgctattaggtaggacacgccaaagagcttactctggttggtgactgagatccactgaagagttctgtttcttttttctttattattattattattattattattattattattattatacagagtttcacccttgtcacccaggctggagtgcaatggtgtgatcttggctcactgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtgccctggctgtttcttttcaaatagtagcatgatcacatttgcattttagctagtacactgtaccagcagttaggaaacagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgaggaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaaaaaaaaaaaaaaaaactgcaagagaaagatgagggagtggtcacatctggttggagggatgaagaaaaggtttcagaacataatggcatttgacaccaggcgcggtggcttatgcctgtaatcccaacacttcgggaggctgaggcaggtggatcccttgaggtcaggagttcaagaccagcctggtcaacatggcaaaacgccatctctgcaaaaaaaaaaaaaaaaattatccgggggtggtgatgcactcctgtaatcccaggtactcgggaggctgaggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaaaaaaaaaaaaaaaaaagatttttctgaatgtaaaagtcatagtgctcattgtagaaagtttgcaaaacagaagaatattttttaaataaaaaataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccactgcatttgtcttgggtgttaatacttagaaaatccaattgggtggccgggtgcggtggctcactttgggagcctgaggcaggtggatcacctgaggtcaggagttcgagaccagcctggccaacatggcgaaaccccatctctactaaaaatacaaaaattagccaggcatggtggcgggtgcctgtaatctcaggtacttgggaggctgaggcaggagaattgctggaacccaggaggtggaggttgcagtgagccgagatcgcaccattgcactccagcctgggctggcaacagcgagactccgtctcaaaaaaaaaaaaaaaaagaaaagaaaagaaaaaagaaaatccaattgggcaaacagaaagtatctattgttttgatttgcatttctttggcctgccgctttgaacgtttttcttaaatgcctgacagatatcaacacttaactttatactaatgtctcccacattcgtattactagcccagacccctcctgaccttcagacccatacttgcaacacccttccttcatgggtgtttcacagacatgtcataccttgaacccttggctttttaacccccaaatgtgcctcctcacccatctcagtaagtgtaccaccattgacttaggtttttaaaccagaaacctaggatttagcttcaattcctcactttttctgaattttcacatccagtccatcagcaaaggcctttccattccagctacaaaaggtatcttctatccttctatttctctccatctccactatcatacctcagtctaggctaccagcatttctcagctgagatagacaaatcagctccaaggccttgtgtgatctgctgcctgcctcttttcagtctcaccatgtatcattctcccctcgttcactagacttcagccacaatgaccgtctttcagttctttgaatagacccagctctgtccctctatagaatgtctgtgtgtgcagttctctttgcatggaatgctcgtcatatggctaattcttcatcctctaggtctcagcttaaatgtcactcctcaggcctttccagatcagtctctttaagtagttaacaactattattctctctttgcttcatgtttgtttccttcttggcacttgtgtgcagtcatttcatgtgtctttctgagttttgtctctctcccctactacagtatatactctatgagggcacaagccatttcttgttcactatgttatgcctgccatagagcttggcatatagaagttcctcaagcaatgcttattattgacaagcaggagaaacaagatgaacaaaagcccaaagccagggtatatttaggtatgttcaaagactacataatagtctggtttggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttcttcatgtatgtcctctatttcccatatttgaggagtatgagtctgcttgagtaacagcacctccatccttttgagagaaatagagaagtggacgctgggtaagtaatgagtctagttttggatttactgaatttaggtcctaaagtgacaactggatagtcatttccatagacacatttacttgaaatgtgcaagtaaaatttatgagactgttttgtgactgatgtgaaaaatttaggaggcctgtgctttcgttggtgtagatgagtttgccaaggaaaaacatgtagacagaaaaaaagtcaaggataaaactttggggcaagttaagggagaaggaagaggaaggaaagagcaatcagaaactcagtaaggtggctgggtgcggtctctcacacctgtaatcccagcactttgggagactgaggtgggtagatcacaaggtcaggagttcaagaccagcctggccaaggtggcgaaaccccgtctgtactaaaaatacaaaaaaatttagctgggcctggtggtaggcacctgtaatcccagctactcgggaggctgtggcaggagaatcgcttgaacccgggaggtggaggttgccatgagccaagattgcgccactgcactctagcctgggcgacagagcaagaccctgttgcaaaaaaaaaaaagaaactcagtaaggtacaggtacttaaaggagcctggaaaagagaaaacaaatgttatgtcctccttgaagcctttccctaattatcttccctcccagataccatggcatttagttcatgttacttatcacagtataactatctgtcagtctctagacttgaaactcctcaaggtcagagaccttgactgattgtatctcagtatactaattatgtcgttgtatataattgcatccccttggtgcttaacccagtaattggatcatagtgggtacttggaggtgtctttgggagagacagagtggtcataaaaaagatggaagcaaaatgctgtagcggaaaaagcctagacttaggattcagacctggggtaactaatccaatttctaccacttaatagatgtggcatcatttagcaaccccccaccagcctcaatttctttatcagctaacagtgtattgctgctcacaaagcactctgatgtgtgtttttccatttgatccttttaacaaccccatgaaatagacattcttatccccattttagagattaaaaaaaagggggggggctctgagaattgaattgcccaaagttacatagctagtaagtggctaggttaggatttaaacccaggtcttcaaattcccagttctagtatcattcccactgtagcacagaaaagagaagagtaggccaggtgtggtggctcattcctgcaatcccagcactttgggaggacaaggcgggcagattgtttgagtctagaagttcgagaccagcctgggcaatatggtgaaaccctgtctctacaagaaatacaaaaattagctgggtggtggtgcacacctgtagtcccagccactcaggaggctgaggttggaggatggcttgagtctgagaggttgaggctgcagtgagctgtgatcacaccactgtactcaagcctgggtgacagagtagagaccctgtctcaaaaataaagagaagagtgatcatttgaaagggtagaaaaatgagttgagggaaagtgtttctaagacaggggaaaggcaccagtagagtgaaaaactagctgctaatgaccaggaggatgatcaataaatagagtgaggcccggaagaatgtgtggggggtactagattgataacaaaagtggagtggtaaagacattacctttggttgggcacagtggcttgtgcctttaatcgcagcactttgggaggctgaggcaggagggtcatttgaggcaggagttcaagatcagcctgggcaacgtagtgagacccccgtctctacaaaaaaattaaaaattagctgggcatggtgatgtgtgcctgtagtcttagctactcgggaggctgaggtgagaggatcacttgagcccaggagctagaggccaaagtgagctgtcatcacaccactgcactccagcctgcgcaacgaagtgagaccaaaacaaaaaaaacacaaagatattaccttggaaatggcttggtagagacagaatcagctccttaaagacaacagtaaaagaggaagagtgaagttatcgagttgttttttttttttttttttttttgtgagacagagtttcactcttgttgcccaggctggagtgccgtggcgcgacctcggctcactgcaagctccgcctcccgggttcaagccattctcctgcctcagcctccgagtagctgggactacaggcgcccaccaccaaacccggctaattttttgtactttcagtagaggtggggtttcaccgtgttagccaggatggtctcgatctcctgaccttgtgatccacccacctcagcctcccaaagtgctgggattacaggcgtgagccactgcgcccggccgagatggagtttttccttgttaggccggtctcgaactcccgacctcaggcaatccgcctgcctcggcctcccaaagtgctgggattacaggcgtgagccaccattcccggccagttacagagattttatggtgaagagggaaattgaattctacattggctggccatctggtgagtgtgatggtgataatagtcttcacaaaagatgaacgaaaggatggctgagcaagggtgaccactcagccaaagtttgacaatagtgatttgtagttgacccatttgatacaagtttctaattccttaactctcttcaacagcttgggaacagagaaaggaaatggaagttgcccagggtcagaagggttacaaggataggggattctagggtaacagggagtatttccatgtaatggcccaccatggagaatccataacagtgatgaaggtctaagacagtagttttccatatgttccttggagccctaaaatttcactgcaatgcctgggggttgggggggcgggtgttgacagccctcctgatttaaccaaggtaaattttacttgtttattaattatgggagttccgtggcatctctcattagaagaaaaggttcttttactaaaacagttttaaaaacactggcccaaatgaacaagtgttgagttagaagtttaaaagatgatgagcaggctgggcgcggtggctcacgcctggaacgcactttgagaggctaaggcaggcagatcatctgacgtcaggagttcaagaccagcctggccaacatggcaaaaccccatctctactaaaaatacaaaaattagctgggtgtggtggtgcacacctataatcccagctacttgggaggctgaggcaggagaatcacttgaacccaggaggtggaggttgcagtgagctgaaattgtgcggctgcactccagcctgggtgacagaacaagactctatctcaaaaacaaacaaacaaacaaagatgatgagcaaagtcatagaagctaggaagtagaagaaaaggaaggagcagagtgcagtagttaggccttaagcatgcagagaatgggaaaagaaacaaaagaaccttattcagaggactactagactaaccctgaatttaccctgaattatatcaccctaaggtcctcgtatgttatttttttcccgtgacttaggtacatccaggaaagagggttggggataggagtgagattggagttaaacattctcaagtaatatctctgatagcattcatgaactaggaattgtagttctttgtagtgttttactcaaaaagcttcttaggatgatgatgtgtcagttattcgtaacattatagtaaatgtccacttgttaggtaaaaggaacagaagagcctaaacatttttataatagccttttcagaacagtggttcttgacttttttttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgatctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggtggtgcgcgtctgtgatcccagctactcgggaggctgaggcaggagaattgcttgaacctgggaggcagaggttgcagtgagctgagatcatgccactgcactccagcctgggtgacagaatgagactccatctcaaaaaaaaaaattgtgctgactataatgaaggggaagagaggaagaggatgggaatggagaagaaaggtagaactggaggagagggagaaaagagtaggaagagtgaaataaaagaccagggggatatgcttaggttggaggaggaattagaatttaaccttgccacaatgatgcactgtcacacctttagattacccacgtaggagacacagcaagggcatttccatgcacagaatgtccagtaaactggtaaagaaacctggtgtaacagctttggctatctttgaacatcataaccctgttttggagctgctgcttcaaaagaataggctctgctgccacttgttctttggttcaggacacaacatgaattgggttgaatttatcagcaagtcacaggcatttatttaagtcctcagagaaacctcttcctaatttgatttgtactaattagcccaggagctcttgcctcaggataacatcaacctagttcttcatgttaagagatcaaagaatgaacaattaatattctaaggttataaggccccttgagcatgtctagatgagtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcctttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggagagctaaggaatctctaccgttagtgttctgctgctatatcttagagactgataaatagaaagtgagtgaattttgaatccagagcttttcaagcacctgaagacttaagagcccgtatggtatgttgggtaaaatggcaaattcacctctcataattaatttccttcttaggcatcaacttctaactcatctcgccaggagaggcctccagtgaaacccttcattctcactcggaacatggctcaagccaagtaggtagtactagaaagtttgctttgcagccctctgcttttatggttcaatgtggcaattcattagtgacccacagactgagtggtgttgaaaagtcatgatcttgggtgggcgaggtggctcgtgcctgtaatcccagcactttgggaggctgaggtgggtggatcacctgaggtcgggagttcgagaccagcctgaccaacatggagaaaccctgtctctactaaaaatacaaaattagccggacatgatggcacatgcctgtaatcccggctactggggaggctgaggcaggagaatcacttgaacctgggagggggaggttgtggtgagccgagatcgcgccattgcactccagcctgggcaacaagagcgagactccgtctcaaaaaaaaaaaaaaaaagtcatgatctcacttacggaagttgttcttttatctaagggatattatctttcctgaaactttctccatgtctgtgttcctcagacacttccttcacaaactcaagcttaaaaataggcacacatgggccaggcgtggtggctcacgcctgtaatcccagccctttgggaggtcgaggcaggtggatcacctgaggtcaggagttcgagaccagcctgaccaacatggcaaaaccccgtctctactaaaagtaggaaaataagccaggcgtattggcaggcacctgtaatcccagctactcgggaggctgaggcaggagaattgcatgaacccaggaggtggaggttacaatgagctgagatcaccccactaccctccagcctggtcgacagagcaagactccatctcaaaaaaaaaaaaaaaaagcacacatgtaaacaagcaaataaaacaaaaaaggaaaataattgaatggagaattgtatactttaaagtttttttttattattacattattggcactcttcctgccttcagctacgattctcaaaaggacatatttgcctccctatgatttaattctgagttcttgagatatgtttccctagggtggcgggagtctccttgttttctgtacctttcagagtcaccaactataaatacccattccacggtgtcttcactgctttgtggagcattgccctctgggattgcttaatgggagatgatcctgggctatttatcttctcatgaaagctcttgactttaatgcccctttctggatgcccctttttacatatcctcccatgagtttgtacaactcctcagaagttgactgggtagggaacaaggctgaaacggacacagactttgttgttagagagactttttgtagtactgggttttttttgttatttttgtttttttgtttttttgttttctaaatgcagcgtaatttttgcagagtatttggagctggttatccaagtctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctctccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttggtaattggatcatagtgggtacttggaattgtctttggaaggggaagatgaagagggtggccaccaaaaaggtggaagcaatagggtataaccgaaaaagtatggacagacctgggtgaacagtccaactcctgtcactttttttttttttttttgagacgaagtctcgctcttgctccagggctgggagtgcaatggcgcgatcttggctcactgcaacctatgcctcccgggttcaagcagttctcctgcctcagcctcccgagtagctgggaatacaggcgcctgccaccacgcctggctaatttttgtatttttagtagagatggggtttcaccatgttggccaggctggtctcgaactcctgacctcaggtgatcggcccacctcggcctcccaaagtgctgggattacaggcgtgaaccaccgcgcctggccctcctatcacttaatagatggaatatcttagtccctctgagcttcagtttccttatctcatatattatcccatttgatccttttcaaaaaggaaaaatagagacagggtctcactgtgttttccaagctgggtctcaaactgcctggggctcaagcaatccttctgcctcagcctcccaaagcattgggattacaggcatcagccaccgcgctcagcttcatttgatcctcttaacaacttcatgaagcagacattcttattctcatttcaagatgagaaagtgctctgggacaaataggtgaaaacaaaaagaaaaaaaataaaaataaataagatgcgctaggcacagtggctcacacctgtagtcccagcactttgggaggccgaggcaggcggattgcttgagctcaggaattcgagaccagcctgagcaatatggcgaaaccccgtcgctaccaaaaatacaaaaaccagccgagcgtagtggtatgcacctgtagtcccatcttctcgggaggctgaggtggtaggatcatgtgagcctgggaggcagaagttgtagtgagccaagatcacgccactgcactccagcctgggtgacagagtgagaccctgtctcaaataaataaataaaatgaggaagtagtcactgggagctgacttaaagtggcctggctaggatttaaaatcagaccttcaaattcccaggttcagttctgtttctactatagcaccaaaaagagaagagtggtaatttgaaaggattagcttttcacctgtgggcagactgcagttactatgatgtaactgcatgtaacttggataggaacttgcagtcttactgtttgaggaatgagagaactgagatcagggtgaatagcaactgaaaaatgaaggaggttatcccagaaaagagagaaccacagagaagatgccctgattctgtatataaaccctactgaaatctctggctgactatgcatgcacagaatggactcttaagcacctcaactaaggctaaaataactgaatggagaattcagctgttgcccaatgcaagggagatagaatttggtattttggttttagacgagttaattgcctgctaaaatgaaaaatcagtactctttagaggaatgaaacagaattcggaatctctacaatatatcatttgtcacgtttagaattcaatcctaagctattagacatgaaaaaaaacaaacaggaaaatgtgactcataactcaaaagaaaaggcaatcaatggataccaaccccaagataactcagatgttggaattagcagacagggactttaaagcagctattatttttatcctcaagggcagagagcaaaatatgtttgtaattaatgaaaagataagaaatctcagcagagaaatagaaactatacacacaaattctggaatggaaaaatacaatatctgaaaatgtaaagtcactggatgagcttaataccagattgttgctgacagaagagcctgtcggttaacttgaagatcaatagaaattatccaatttgaaaaaaaagattggataaaagtaagcagtatctcagtggcctgcggaattatgtacaaaggtctcatgtatgcgcaattggaatgccagtaccagaggagaaagaagggaacagaaaaacttgaagaaatgatgactaaagatttcccaagattcagaaatgtcagcaaaccccaacagtttaaatacaaacaaaatcacacataggcacattatagtcaaactgcagaacaccagagagaaagaggaaattttgaaatcatccaaagataaagtacacattacacataggagaacaaggatatacattattgctgaatttccattaaaaactgtgggcgccagagatggtggaacagcttcaaagtggtggggggaggaacctgtcaacgtataattttatacccagtgaaaaatatccataaaatgaagatgaaattaagacattttcagataaatgagagctaaaagaattcttcaccagaaaattggcattagagaaatgctgaaggaaattcctcaggctgaggggaatggtatcagatagaaatgtaaatactcaagtagtgaagagcagcagaaatggtaattatgtgggtaaatacaaaggactgtcttcctcaacccagtttttaaaaactatacgtagcttctcaaagcaaaaattacaatattgacttgtgaggtttataatgtattaggtgtaatatatgtgacagccatcgcaaaaaggacagggtaaatggaactattttgtttgtgagattctcctgttttatgtgaaccgatacatgtctattgctgtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctgggactacaggcgcccgccatcacacccggctaattttttttttttgtatttttagtagagatgaggtttcattgtgttagccaggatagtctcgatctcctgaccttgtgatccgcccgcctcggcctcccaaagtgctgggattacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcccttgagccgaggagttcaagatcagcttgagcaacatggtaagacccctctccacaaaaaaaaaaaaaaaaaaaaaagttttaaaaaactagccaagtgtgatggttcgtgcctgtagtcccagatactcaggaggctgaggtgggaggattgcttgagcctgtgaggtcgaggctgcagtgagctattatcgtgcccctgcactccagcctgcgtgatagagcaagaccgtgtctcaaaaaaaaaagggagcagcctgattaagaagtgggccaaaaaccttaacagataacctcaccaaagaaagtatacagatgacagataagcatgtgacaagatactctacatcatgtcattagggcaatgcaaattaaacaacactgagataccactatacacctgatagaatggccaaatccagagcacctcaaatgtaaatagaataaaccttcgaattagaagtcagggatcgattatcaggtctagctgcatgctgtctataaaagatacattttaaatacaaagacacagattggttacaaataaaaagaagaaaagatatataggtggctcacgcctgtaatcccaacactttgggaggccaaggcaggcggatcatgaggtcaggagttcaagaccagcatgaccaacatggtgaaaccccatctatactaaaaatagaaaaattagccgggtgtggtggcacacgcctgtaatcccagctactcaggaggctgaggcaggagaatcgcttgaacccaggaggctgaggttgcagtgagccgagaccacaccactgcactccagcctgggtgacagagtgagactctgtctcaaaaaaaaaaaaaaaaaaaaagatatataggttgagcatcctaaatctgaaaatgaaaaacctgaaatgctccaaaatccgaaacttcttaaggctaatgtgatgcttaaaggaaatgctcactgaagcattttggattttcagatttgggatgctcaaccagatatgatgcagatattccaaaataaaaaacaaatctgaaatacttctggtcccatgcatttcagataagggatactcaacctctaccatgctaacagtaagcataagaaagctgcagtagctatagtaatatcagataaagtagatttcaagacaaaaaggtattatcagagattttaaaagggcatttcctactgataaagtggcaatttatcagggagacatagcagtcataaatgcatttgtgcctaataattttcaaattatttacttgaatacttacaggctactgtagggttattcattggcccaatttcaatattgttgtgtctcaaggaacagagaggcctggagcagggttgggacagccagtcagtggagcagtcagaacataacacatttacccattaagttctctgtcttctgtgggcatggtttgtggtgccccagaacaattacactggtaataccaaagaccacagatcaccataacaaatgaaataatgaaaaagtttgagaaactgagaattaccaaaatgtggcacagtgacacaaagtgagcaaatgctcttagaaaaagggcaccaatagacttgctcgctgcagggttgccacaaaccttcaatttgttaaaaaaaaaaaaaaaaaaaaaagtctctgcaaagcacaatagagtgaagcacaataaaacgaggtatgccttcaccttcttttcagatacccatggaacattcaccaaggtagatcatatactggtccatgaaataagtctcaataaattttcaaaaattgaaatcacactgaatatgtcctcagaccacaatggaattaaattagaaatcaataatgtacctagaaaattctcaaatatttgaaaattaaacagtacacttctaaataacctataggtctaagaagaaattagaaagaaaattagaaaatacttctaactgggaataagttcaagagatctgttatacagcatggtgactatcgttaatggctgggtgcggtggctcacgcctgtaatcctagcactttgggaggccgaggcgggtggatcacctgaggttgggagttcaagactaacctggccaacatggtgaaacctcgtctctaataaaaatagaaaaattagccgggcgtggtggcgggtgcctgtaatcccagctattcgggaggccgaggcaggagaatcggttgagtctgggaggcagaggttgcagtgagtcaagatcacaccattgcactccagcctgggcaacagagcaaaactccatctcaaaaaaaatgaaaataaaatacagagtagatgttaagtgttcttactgcaaaaataacaatgtgtaaggtactgcatcttttaattagctagatttagctatcccataatatatacttcaaaacatactgtacacaataaatatgtttgcccatttaaaaataaataaaagagaatactttgaacagaattacagtgaaagtacagcatcagaatttatgggatacaactcgagcaatgctgagatggaaatgtgtgtaactttcaacacttatgttagaaaaaaggaagataaaatcaattacctaaggttttaccttaacaagggtgggggtgggggcatagggaacaaagaaagcccaaagtaaatagatgaaaggaaataaaggcagggaaactaggggtggtcatggttctggtagtaatgcacaaaaattggacacgtgtatactcccatgacctggcagtttcactactcggtatatacctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtgctggttgaaagctagtaagtgttcacccttagttggggatcatgaatggaactggacctacagggtcttctgaggagttagaaatattttgtatcttcatctgggtactgattacatggatgtgttcaatatgtgagagttcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaattgaaattaagcaggacaggaatagaaaaagaaagaaaaggtccagatgaaattaggagagaggaccagaaccaggaactccaatcaagcaagtaatcatatttctttaattcacatgaaaacagcagaaagggagcccttatgaagttagaaaagctactctgaaccatgcttctttctacaagtttaggaaaacatttcacgtaaaaatgaacaacagattgtggtgatggttgcacaactctgaatataaaacactgaactgttggctcacacctgtaatcccagcactttgggaggcggatcacaaggtcaggagtttgagaccagcctggccaagatggtgaaaccccgtctctactaaaaatacaaaaaaaaaagaaaaattagccgggcatggtggtacgtgcctgtagtcccagctacttgggaggctgaggcaggagaattggcttgaacctgggaggcagaggttgcagtgagtcgagatcgtgccactgcactccagcctggcaacagagtgagactttgtctcaaaaaataaaaaaacaaaaagaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtatccaaaaaagagttggaagatattcagaaaataacataggacatggaaggacaatataaagcaggattagaaaaactcagaaatatgacagcttggggaacatgaatcatttcagaaatataggctaaagtagaaggaaacaagaatgagtgaacacaacagaaaatgccttactatggtaaaaggaaggaaaattttaaaacgaaaaaagataaacagggtttgaggaaaagtgacatatactaaagatagtaaagaagacctggcatatagataataggattatctgaagaagaaagccaaagcaaggaaaaagaataaatgctaaaagttaatattaaggaaagtttcttgggattaaaaaagttgcgcggggggaatctcttggtgttgggtgtgacgcgacccacaggcagccacagcagtgctgtgttccaaggcacgggtgctcagggtggctgtggagcttggtcctgggtccagtgtcttcttgaactgctgcgggacctgtgacatgggtgcaggttcagtctcaggcacaggtggatgctgctctcccaccaaggcaaggactatgactctgaggcacttctcagtagctcgggcccaggggcagggacgtagctgtgattcctaacctgggggtcagggcatagtactggcatggctctggggagggaggggtgttccagacgctcagaccccagggagcagggcacagtggcaattcaggcaccaggaaagaagatgctgtatagtggtgactctggaccctggaagctctatgaggccgggtgcagtggcaacacagccccaggaatggtagggcatagctgtggcttgggctccagggggtgggatgcagtgcaatgttggctttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaaagaatacagatgtaattccaaagaatttagattttttttaaaccctgtagtactccatatgaactcatgagaaattttatttaaaactaaacacacacacacacccacccctgcttttgctctattcactgaaaaggcttagaaacaaggaccagcccagtagcaatgagtatacctagtaactccaattgtgatacagaaatattcttcccaatattctttcttttaagaaatcagggtgtcttagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaatacacacaagtccattgtgatagaaataagtggttgaataagtaaataaatgagggagaagagataaatctcccctacagaaaaatttcaattaattttatgtagatactcctgcttcaaggaggtgtagcatgactgtgtaccccgaaagtgtgggctgtgcttagtgacttgcttccagagactgcaatgtggaaggagacaggagaagtaactttagttggaaacctacaaataccactttggtcaggtcatcgaggttattatcagtgtgaagtcaggttgatagcatatatagtattgtcctccaaaacccataaccctagtctaattctgtaaaaaataggcaacccaaactgagggacattctacaaaatacctgacaagtactcttcaaaactgtccaggtcatcagaatgaaggaaagtctgagaaagagttacatcctagaggagactaaagaaacagacaacaaaatgtactgtggtgacctggataggatcctggaacggaaaagggacattaggtaaaacctaaggacatttgagtaatgtatgcactttagttgttaataatatattagtattggttcattagttgtatcacagaaactgtattaatgtaagaggttgatgataagaaactgggtgtggttatgtaggaactcagtactattttctcaatttttctgtaaattgaaaacttctaaaattaagaagttgatttaaatagttttttaaaacaataattgtgggccgggcgcggtggctcacgcctgtaattccagcactttgggaggcttaggtgggtggatcacttgaggtcagaagttcaagaccagcctggccaatgtgataaaaccccatctctactaaaaatgcaaaaagtagccaggcgtggtggcacatgcctgtaatgccagccactcgggaggatgagacaggagaatcgcttgagcccaggaggcggaggttgcagtgagccaagatcacaccactgcactccagcctgggtgacagagcaagactcctttgtctcaaaaataataataatagttgcaactggctgaaactcaccagatatgtttaaatctctaagttcataattatatatatatatttttatttttttagaggtgggtctcacactctgagcccaggccaggctcaagcaatcctcctgcctcagcctctcgagtgagtaggactacagccatgcactaccatgcctggcagattttaaaagtttttttcttttttataattttttgagccaatataagtgtcataaatattttttttgtagacacagggtctcgccatcttgcccaggatgatctcgaactcctgggttcaagcagtcctcccacctcagcctctcaaagtgctgtgattacaggtgtgagccatcgtgcccagccccataattatattataaaacaagaccaaattattcaacctcagaggctaataagggaacccaatatcttgagaaatggtaaataaagggaaagagtcaagtattttatcttttctactaggtaaccaaatagtagttgatgaggggaaggctctctttgtaaaagtattccagttaattttaaaaagttaaaattaagggtatcacctttttgaaaccccccaataaatgaatgggtctcggcattgagcatcaacagctcctaacattacaacgagacagagatatttacatgcctcctgatgaaggaatgcagcaccacctataattataattcatgctgaagggatcaaacttgagtcaaatcaagcctctgtattcagctgccaatctgcagaaaataaaggaggacatgttagactgcatcatgagtatgcaatcagcaaaatccagtctttgggaaacaaactctacaggtcatatgccccaacttcttcaacagataacttgaaagaaaggggtggagggggaacccatagatttaaaaagatatcaaaacatttttaaataggcaaggctaacctcaaaaatacgatgctaggccaggcgcagtggctcacacctgtaatcccagcactttgggaggccgaggcaggcagatcacttgaggtcaggagttcgagaccagcgtggccaatgtggtgaaaccccatgtctactaaaaatacaaaaattagctgagtgtggtggcaggcacctttaatcccagctactcgggagactgaggcaggagaattacttgaacccgggaggtggaggttgcagtgagccaagatcgcaccactgctctccagcctgggagacagagcaagactgtctcaacaacaacaacaaaaaaaggtgatgatgctaagtgaaagaagtcagccgcaaaagatcacagattacatgattttgatttcatgtgtatgaaatgtccagaataggcacatctatggagacagaaagttgattcatggttctaggagctgggggcagggagggaaggaatgggaattaactgtaaatgggcacaagggatcttttggggttatagaattttttaaattggattgtggtgatagttgcacaactctgtactaaaaaatacattgagtaaaaaaatgaatgtacaaatggacaattacagtgtctagtggtatgcacttgggtgataaagctgtgatgaactctaggaagttattactataaaaagcagtatagaggttacttttgcaggggaggagagttgatttgtataatgtacacagagaggcttttagggtggatacaggagatctgtttcttgacctgagtggaggctataaggcctccttacaaaaatttgttttatatgtacttgtgtggtttccaccatgttttattttatagtaaagggtttaaaagaaaagaacgaggcaaggtggctcacgcctgtaaccccagcactttgggagggccgagaccagcctgggcaacataggggaagaccttgtctccacaaaaaatgtaaaaattagccaagtgtggtggttcatgcctgtggttccagctactcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcacaaaggaaaaaaaatgcaaaagagatgcagcagttggtttaatttcttttgggtgtacactgcatgataaatgccatttggacctcagagcctatttcaagcactgcaaaataatacgtaggcattcttttctggtaggtccaactgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccacttagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaatatggctatcagctgctttttttttgccgggggagtggggacatttagctgtgggtctctgggcttatggggagatgccctttgatgtgggcagtgaattggtccagcatcagatctgcccaggcattctccttcctactgggcatatgatatgaagccatataagtagcaccctgcaccatgaagcaatccagcactctacaaggggagatcataaaaaccagagctttccctggtacacagcactattctcagaaactatagctgtaaggtgaatggaccgcaaagggatgtagtctacttcccagtcctatctacctcgtcctagcttggccagaagaaatgagagatagaggaggcactcttaaaagtcatccttgtgtatgtatctgaggccagagcctttactctcatgcgtttaccatatatcccttagggtgaagagtagcctcaggccatagccttttttttttttttttttttttttttgagacgagtgtcattctgttgctggaatgcaatggcgtgatctcagcttactacaacttccacctccctggttcaagcaattatcctgcctcagcctcacaagtagctgggattacaggcgcccgtcaccacacccagctaatttttgtatttttagtagagacggggttttaccatgttggtcaggctggtctcgaactcctgacctcgtgagccacccacctcggcctcgaaagtgctgggattacaggcgtgagtcaccgcacccagccatcctaactcttcaattggcccttcttgcctatgctgtgagatacttggcacaatccaaactaatggcctgggtaaatgtgctgtggtggtcgtttggctgcttagtgaggtgcctgcagtcacgcagataatgggtgtggaggagggggacagtacagatgacactgcagggtacctactttctggggaacagagaagacagtgtcctcagctcttgcgttggcatcctataaaagcagccatgtgttgaaacaaatgatatgcacagaaagcatacttctatggctttgttacacgggttttctttcaagaggaagatgactcagccctcccagcttctgcagtctagcttaggagaggtgtttgaaaaggagactcagttccctcttgtttatagggtggttagtggagggctgtcaggtgatgagggggaggttgtgtttcgtgggagatgacagaagactaccaataatctatttgtatactgcttaatgaggagtcatctcaccctcacaacataagctcctgaaactgggagagcacagattaaatcccccaaggatttggaaagcaacattttccgctctcttccagtggctgccagcctgcctctagcaatggcctatttcctgtttttgaaactccaccctgagtttattcccaaatgggccaggttggagttacctcttggtccaagtccgttgaagattgggccttccaggaggcccagctcagttaaacagcttcacacatcctgatatctaacaggcaaaccagacaaggtgggtttgaattctggctttaaaaattgcaggctgacagaaagacaaacttcgcatgttctcgcttatttgtgggaactaacaaaacaattgaactcatggagatagatagagtagaagatttaccagagactgggaagggtactggggtggggatggggatggttaatggatacaaaaaaatataatgaataagacccactatttgacagcacaacagggcgactatagtcaataataatttaatcgtacatttaaaaataaaagtgtataatttgtaacaaaggagaaatgtttaaggggatagataccccatttttcatgatgtgattgttatgcattgcatgcctatatcaaaacatctcaggtaccccataaatatatacacctatgcacccccaaaactaaaaaataagaaaatcaaaaattgcaggctgtgtgacgtgaccttgggca

SEQ ID NO: 17096 - DNA, 12603 bp, Human
cagaagtcctcccttagagtgtgtctgggtacacattcaagtgcatggttgcaaacttttttttttaaagcactgaatagtactagacacttagtaggtacttaagaaatattgaatgtcgtggtggtggtgagctagaagttataaaaaaaattctttcccaaaaacaacaacaaaaagaattatttcattgtgaagctcagtaccacaaaaatttaaataattcattacaagcctttattaaaaaaaattttctccccaaagtaaacagacagacaatgtctagtctatttgaaatgcctgaaagcagaggggcttcaaggcagtgggagaaggtgcctgtcctctgctggacatttgacaaccagccctttggatggtttggatgtataggagcgaaggtgcagacagcagtggggcttagagtggggtcctgaggctgtgccgtggcctttctggggtttagccacaatcctggcctgactccagggcgaggcaggccaagggggtctgctactgtgtcctcccacccctacctgggctcccatccccacagcagaggagaaagaagcctgtcctccccgaggtcagctgcgttagaggaagaagactgggcatgtctgggcagagatttccagactctgagcagcctgagatgtcagtaattgtagctgctccaagcctgggttctgttttttagtgggatttctgttcagatgaacaatccatcctctgcaattttttaaaagcaaaactgcaaatgtttcaggcacagaaaggaggcaaaggtgaagtccaggggaggtcaggggtgtgaggtagatgggagcggatagacacatcactcatttctgtgtctgtcagaagaaccagtagacacttccagaattgtcctttatttatgtcatctccataaaccatctgcaaatgagggttatttggcatttttgtcattttggagccacagaaataaaggatgacaagcagagagccccgggcaggaggcaaaagtcctgtgttccaactatagtcatttctttgctgcatgatctgagttaggtcaccagacttctctgagccccagtttccccagcagtgtatacgggctatgtggggagtattcaggagacagacaactcactcgtcaaatcctccccttcctggccaacaaagctgctgcaaccacagggatttcttctgttcaggtgagtgtagggtgtagggagattggttcaatgtccaattcttctgtttccctggagatcaggttgcccttttttggtagtctctccaattccctccttcccggaagcatgtgacaatcaacaactttgtatacttaagttcagtggacctcaatttcctcatctgtgaaataaacgggactgaaaaatcattctggcctcaagatgctttgttggggtgtctaggtgctccaggtgcttctgggagaggtgacctagtgagggatcagtgggaatagaggtgatattgtggggcttttctggaaattgcagagaggtgcatcgtttttataatttatgaatttttatgtattaatgtcatcctcctgatcttttcagctgcattgggtaaatccttgcctgccagagtgggtcagcggtgagccagaaagggggctcattctaacagtgctgtgtcctcctggagagtgccaactcattctccaagtaaaaaaagccagatttgtggctcacttcgtggggaaatgtgtccagcgcaccaacgcaggcgagggactgggggaggagggaagtgccctcctgcagcacgcgaggttccgggaccggctggcctgctggaactcggccaggctcagctggctcggcgctgggcagccaggagcctgggccccggggagggcggtcccgggcggcgcggtgggccgagcgcgggtcccgcctccttgaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggtgaatgacgggcgtgggtcggtgcgcgctcggcttgcgcacacggtgtctctaagtgcgcgggtgacgagagtcgggatgtgccggagaccccggggcggagagcgggattacaagtacaggaatccctggtcacgctccccgcccctggaaacccagctggggcgagggagggcgtggacgggaccgttctgggagctcgcctttggctgcggttggctccaggccccaggcgcagtttgctcgcggcgtggggatgaagtccgtgtccctggaggggcccaggaagggcgaggaaagcggagtggagtaagttcgtctaggatcggtcccgggtggctctgggatccaatctgcgccgccctggcccaggtcccaggttcaggtcctttacgccactgtgtccaccacctggctgagcgctgaggtcagcgcgggctgtttcctggcccttgggaatgtgccaggacccgtcccctaaggactagcgaggaggtgactcactgtgacaaggagaccccagggaacggactgtatgaggtcagaaccccgcccgggatggggtacagcgggactccagaagccctctcccctgccccttcgcggtctccgtcctcccatcggcacagtgacctatttggctggaacagtttgttcccaaggaagccgggcactggaggtccgggacaccgcgtcgggtccccgctccgcggcgcgctgtaggggtcggggagtcacggccctgcgctgggcgggctctaaccagcctgtcagtcggggaagggcaagggtctcctctacctctttcccaccgcggccgggagaatcgcggcccagcctgtcctcgggtcggggcgctggactccggggcgggagcggagcccacgcctggatgggaggcggggagggttcatgtctttgaggggtggggggtctggggggcacgacgctgctcagggcctctatcagctgcctcgggggctcagggcttcccgacctagcccagattccctctccgaaagctacagggctgagcggagcaggggggcgagtcgccccctggggcgccgccgcctggcgcggaccacagcgcgtcctctccgtcccaaacccctgggggacacttgcgccctcttcgtgaggaaaagcatcttggagctgggttaggaacttggggcgcccaggcagcttcccctctccttgcctccctccacgtcgcgtttctgggaggacttgcgagcggttttgttttcgttgctcccgtctatttttattttccagggatctgactcatcccgtgctttgggcgtggagataaggtggaggggccggctcccggcgcgcgcgcgcgtgcgtgtctgcgcgggcgtgtgtgtgtgtgtgtgtgtgtgtgtgtgtgtgtgtgtctgtgtcagagacggcacaagagcgcgcggtttcccaacagcggcgggagtttcggaagcctggccggctcagcgtgacgtgttcgcggccccccggtcccctcccattctccccctccccaccccagggtgacgcgcagccggagtggaagcagttttggcgggcgagcagcgccttgcaggaaactgactcatcactactccctccagcggtccgaggctctgcccacgcacctcccactccgcgcgtgatttcctggaggccggcgccccctcccggccctggcgggaatagcacacaggctttcccgcggagtggggctggccggcgcgaaccgccgcggctactcctgggctcatccgagatcaacccctatgccattaccaccccttcaaaggagcactccttaggttcaacagtattcactgagctcttactggaaattaaaatatggctgaagtctaaggcaggaaggccaataaaggaggctatttttaattgtttctaaaacaagggtttgcgtttctgagttttctttgggctgaaagttattatgagcatgagagcagattttgatgggggaggagaggcctatgagagccataagagaaggaggggtggtagaagaggagagggtgcctgcctagatcctagtcctgtcttgaactcccgagagccagggaatatccagcaccttgatgaagccctaggcgggcgcctcctccttgtgcctatgatgtattgagacccagaatgtccatttcaaacataccagtgtgtctccgcttggctggcaacccaagagtgcccatctgaggaattgtgccaaacacttgcttgaatcttcaatttggattaagttggtctcgggaggcagggcctcagcaatctatattttgaaaaaactccctaggtgcttttctttctttctttctttctttctttctttctttctttctttctttctttctttctttctttctttttctttctttctttctttttctttcttttctttctttctttctttctttctttctttctttctttctttcttcctttctctttctctctttctttctctttctctctttctttcttttctttcgacagagttgcactctgtcacccaggctggagtgcaatggcaccatcctggactcaagtagtcctcctgtttcagcctcccaagtaaccgggaccacaggcgtgatccccccgcccccatgcccagatttttttttttttttttttttttttgagatgcggtctcgctctgtcacccaggctggagtgcagtggcgtgatctcggctcactgcaagctccgcctcccgggttcacgccattctcctgcctcagcctcccgagtagctgggactacaggtgctgccatcatgcccggctaatttttttttgtatttttagtagagacggggtttcaccgtgttagccaggatggtctcaatctcctgacctcgtgctccgccctcctcggcctcccaaagtgctgggattacaggtgtgagacactgcacccaaccacccagctaatttttatttatttttatttttagtagagacagggtctcagctagttgcccaggctagtcttggacccttgggctcaaatgattctcccacctctgcctcccagagtattaggattacaggcataagccactgcccctggcctccccaagtgattgtgatgggcctctctggttaagaaacctcaaaattagagagggagtggggttcaatactacagcacaggactcagggcaaacaggcctgggttcagatcctggctgtgccacttatgaactgtgtgatgttaggcaagttacttaacttatctgagccttggttgcctcttctgtaaaaagggagctaatagatatccactttttaggaggattgatatttttaaactgcttagaacagcccccaaacataaaaatatataaataaatcccaactcatgcctagcagagggtggatagaggttatttgagggctctgtccactgtactgggtgacccctttatggggcagtggcctttggcctttttagctgtatgactcaggggcaagtctcatatctcttccatctcctgccctttaaacttggtgtgaagttaccaagagcctcctctcccaaccagctgggacgtgaaactgtgggctccactgatcacaagcagtggggtgaggtggggtggagcagatgtggcatgtgtcccgggcttcctgcctcatgaggactcagcagagctttcacccccagaaactgcaagttgggacttgtccctaggaaaatccagttgctgccaaggtcgtgcagtcactcagccctggagtcaagccagagcaggcaggtaggtgccagggctccctcatgggcaaactcactctccgttttccctctcctgaagggggaggagaggagccaggtagaccagccacctttaattttctttttgcctgcaaaacggtttccttggacacaggcaacacgaggcaggggctgccaggtgtctagacttcagatcacctgatgtgcctggcaggatgtggctcagcctgggagaaatcatcccttgcgctgccccgcccggcccctccttacccctaggccacccgcctgacgacatccttgggaaaggccctcagcctacagcacctgtcagctgctgtctgaaggaggtagttggcagggggaagtgataggggggaggctcagtaaaactgaaggcagagaggaataatcatacttctgttttcaatgcacttctctatacgaagtgctgctggcacgttacctacattaactcagttaattctcatgtctatcctctgagacagtcactattactatccccattttatagatgaggaaactagagctcagacaagttaagttgcttgcccagggtcacctagtaaaacctggactccagcccaggtgatctggctccagagccctcctgcttaaccaccaggatacagcctttcattcagctctgttctgtctgccttgctgcatggactctgtgatcaatttcttgagtatgtgtctgtagccatgctctttaaacttgtacatggccccatttatggatgaggaaactgagacctagagacattaagtggctttttaaagcttacgtagtaactggcagagctaggaccacaacccgggtgctttttgccccaaagtcccgggtacttttacttggcagagcagggttaccctacttggggatctgggtcgggggacttaggaggctggaggaactgtcagactgtttcttcttttgggaattgaccttctggccagggctgcgattaggaaactgctggactctggcaattcacacatatttggggggcattcacacccatgagggacacctctggggggaaaacaaattgattttagctgataatacctggtggcaaacaggaccctggtccttgctcttgcaatagacttgcctttgttgacattagcttgcccttcagttgcctgctctcccagtgaccttggtgtgccaggctggctgagctctgctggtgggggtcaggcctcctgtgggaaggaagcaggaagaccagctggaaggagtgagagagaccctctggtaggaagacgtcacctgaggtgacacagcaaagcccggccaggtaacatagtgtctaatctccgccgtgaccagggccttccttgtatctctgctgcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacaggtgcggacatgtgcacggaaggactttgtaagggaccaggattctcagaatccatggtccaagggctgacctgtctggtcctggtccagcatgctccaggtagaaggaaacaggcccagagaggggaagcaacctccctgaggtcacacagcaagtaggcagcaaagaccaactagctaacatttattgggaatgttcattatgccaggccctttgccaagcttctaaggtagatttatttagtccttatagcaatgttataacataagacattcttgtcaccctgcccgcctttctttttgagacaggtgtcttaactctgttggccagactggagtgcagtgatacgatcatggctcactgcagcttcaaactcctgggctcaagcgatcttcctacctcagcctcctgggtagctgggaagctgggactatagttgtacaccactacgcccggttaattttttgagtttttgtagagacaaggtctcaccatgttgcccgggctggtcttgaactcctgagctcaagcagtcctcctgcctcagcctcccaaagtgttgtgattacaggcgtgagccaccatgcccagccccttgccatccttttagggcaaggaaaccaggctcagagaggtagagtgatttatctaaggtctcaaagtgaatttgccgttgggtcaagactaattataataacaacaactactgacgtttatatgggcccggcattgtgctgaacactttcatggattttgtaacagaatccctagatcagcactgtccagtaactctgcagggatgggagtgtccggtacaggggccacgagccacatacggctgttgtgcatttgacacacagctcatgtgactgaggaactgaattgttcattttatttgattgtagtctgtttaaacaagcacacagagctagtagtggttcctctgctgggcagcttgacttagagcagacccatgggtgcgggtgcggtgatggataaaatcacatctgtgaagcatggtgggacactccataatacccctcaagagacagagtggacgttccccgagttcttcctgttctcagcagtcggccccattggccccagggaagggtgtcctggccccccactgtcttcctcagttgggcagctccgccgcgtcctcttcttcttggcctggctgacttctgctgtctctcctcagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaatattactattgtggttattataccttataagaacaaataaatgggcttttgggaaggatttcataattaaataattttaaaaattaagcatttaaatttagagaatgcagaaaacttagcaaacagaaagactgctgcaaaaaacaacagcaaaacaaaaactactgtcacacctctgcaaagatcaccaatgtcaatattttggtttgttgtgtaatctttttgtaaagaatatattatagcttaacatcattattcatcagataaatgcaaattaagataccacaataagataccaccatacacttaccagaatgattaaaaaagactgacagtgccaagcattggcaaggttatggagcaactggatctcttatttaaaaaaactgtttgggccgggcgcagtggctcacacctagaatcccagtgcttcgggaggctgaggcaggagatcacttgaggccaagggttcaagaccagcctggccaacatggtgaaatctctactaaaaatacaaaaattagctgggcatggtggtgcacgcttgtaatcccagctacttggaaggctgaggtgggaggatcacttgaacccaggaggcagaggttgcagtcagctgagatcataccactgtactccagcctcttccagggtgacagtgagattcatctcaaataaatacataaataaaaaactgtttggtaatatcttctaaagatgcctaccttcatggctacctcatgacccagtaattctattcctggacatgttctcgagagaaatgagttcatatttccactgaaaaaggcataagaatgttctacacagtggctcacacctataatcccagcactttgggaggctaaggcaggaggacggcttgagcccaagagtgtgagaccagtttgggcaacatagcgagactcttatctctacaaaaaaaaaaaaaaaaaaaatagccaggcgtggtggagcgtgcctgtagtcccagctacctgggaggctgaggtgggaggatcacttgaggagcttgggaagtcgaggctgcagtgagccctgactgcaccactgcactccagcctgggcaacagagtgagaccttgtctgtctccctcaaaaagaaaaaaaccaaaagaatgcttccagcagcattattattaacagacccaagctagaaataactgaaatgtccataacagaatagatatgcaaattgtggtatatttatatagtggaaagttatccaacattacaaaaaacaaggtgctgttgcatgcatcttctggttgtctattcataattaaccaccccaagactgagtggcttaaaacaataatcatttatttgctcccaacactgcaatttggcccagaactacttttcaaatgtggaataattctctactgcacagggcagagctttctactagaatcatagagttctgaaacgagactctccccgccagaggggacttccagggacttcacaactgtctacttatccacagataaaagtccaggaccagggaatacactggggcgtgtgacccaagtgcttgtcccatagcctgcacctgtttcagagccctctcttgctccggccgctgcttaaacatggcagcttactaaatcatccaataaatgggctggagtgatctttagtacactgcctctgaaacccaaattaaaaagtggtaagaggggggtgggggcctgggggagggatagcattaggagaaatacctaatgtaaatgatgagttgatgggtgcagcaaaccaacatggcacatgtatacctatgtatcaaacctgcacattgtgctcatgtaccctagaacttaaagtataatttaaaaaaaagaaaaaaaaatggtaagaggtgcaagatatactaagttgtcctttaccacagagggaatgacccagcatgccccagtttatttgaccacttaaaactttaatgatttgatagatctctaaattgttgtagggaaag

SEQ ID NO: 17097 - DNA, 31214 bp, Human
acgtttcttgtatggtgtcccttgagctttcgggttagacactgtagacctttgtggttttcgtttgcttttctttatggttaaagcttggacatttgaagacagcagtaaaacactctggggtgtgtgttcctgtacggttcatactggagcactaggattacattctggcatagcatcaaaggaacggtccccgaagtggacagcagaaaaatgaaaatatgccgcgagaaaggagcaaagggcctaggctggcggttggattagggactgggaggtctgttcttacggcgaggccaggggcttggtcctggcgggtgtcggagttttgcttcggtgttttgagcgtgaagggaactgaagagctgcttctggcttaggggatgtgacattatcatgtaagaacatgcaggttccgaaacagtttctggtacacagtgactgcccagtaaatactcagcagagacataagcttcttctgtgaaagccgtgccggagcacgagcacgcgcaacctccacatcctggtggtcgtttctgtgctgcgatggagaccacggaccgccccagccaccggctgctcctcccggcattgccagagtcactgtggtggggcctgcatccccacccactctcccaaaagtcatcccaggaaattggatacaaatcacggtagcaagtgacctcccagtctaccaaatccaataaagagttttaaacaaggacccaagcgacctctccccaacaggtggcattctgcgtcacccactccctccctcttaactttctttctttggcttcggtgacttcatctgctttcttcttttctaatttgcatttgagaaagatttctacagcaacaacataaaggacaggtgggaggggtgctggactggaggcagaggccagttaggggatagccagggcgctgtttcattacactggacaatagcagtgggcatggggcagggagcaacccaaggctgcctacgaggcacagccgaggctctgtccccaggcagcgcggggctgaggctggcgttccgtcattgcttcctgagctgccccactgagagacacgccggggattcccgcggcctctcacctctggcaagacaggacaggttcactatttgattatctcagcatttcacatcggagacctcacagaatccagaggcagcaatagtccggcagctgcccatgactgcccgtccagcagtaagcgagtaacaaacagcaacaacaaccacaaacagctgttgaatctcacagcttttgtctttataaaataggccacttctttgacatgttattgcagacacacacacacagacacacacactactaagaagaaggtgtggaggtatcatcctagcatccgctaaacactgttatggaaaaaatccagtgcctctgggttattcgccactgcagttgtggttttcattctccctatcacccctgctatttcatgaatacacattttgttttagaactggaaccaatccaggttcatcttttctttgcttaagtgaaactaaactaatttcagatttcttgctgaaaaatgcctttgcttcccttacacaggatataatttaagaatacagtccagcaagatcgaaatttgtttttgaaacagacatgttagttccactggttacgatggaatataatgatgtctgagatgtgatttttttgccatttgaaaacctctcctgcgaactgtcaagggcccttagagtcagtaatttgggtgttgaaccctcagcctgtggcagattgaggagctctgttgtgtgttccccagtagatgcgactttcttcttctctttatgggggtcggcaaacctttttgggaaagggccagggagttaatattttcgtcgttgaaggccacgtggtctccaactcaatcatccagctttgcccttgaggaagaagcagccatacacagtctgtaaacaaaggacggggctgtgttccaggcaaactttgttgtttacaaaaacaggcggcaggctggggttggtggggcttgtgtttaattaacgcagcacacaaagtcttatgacgtcgttttactcttttctctcaggaaacaattctggtgaaatgtgatcgtcctggccaccctctgattgataagacatatcattttgaaaggtaagtgcttttcaagatgtcctataaagcaaacttccatattaaaaatacaaattttgcattggggtttgagtaatgaaatatgtaatttatcctatcatttgactaattgtgattataaatacagacggtccctgaggtagatttttcaactttaggaaggtgtgaaagagatacacattcagtagacactatgtctcgagtgcccattacaacccttctggtttttgctttcagtacagtactcagtaaactacgtgaaacagtcaacactttagtgtacaagctttccatttggtgattttgcccacctgtaggctaatgtgtgtgttctgggcacacttaaggcaagctaggctgagctacaatgcttggtaaattaggtgtatcaaatgcattttcaacttgcaatattttcaacctacaatgggtttctcaggtcacaaccccatcataagacgagggacatctgtaatccatatgttcattgttttaagtaaatagacattttttatatatccagtttgttgatagtaatttcgttgtgatgatagcaactaacaatagggctttctgtcagatgccttcctcggcactgggtcgtggtgtattcccagggtggtaggagagccccggaaggctcagaatcaatgcgcgtggcctttggaaagccctgctcatcctccttcagctaccaagggctggctgagtggtcctgctcccaggctctgtcctcctgctcctcggaaggacgtcagtgcctgaggcctcttcctctccccggcagcagcctgtgtcgctcgatagggtcacatctggagaagggcagagggttcccctcaagcctccgctgagcactgaccagcacaggagcggtaagaaggaggaggccaggaaagaaccaccggggaggagcccgggagaaagtctgcagagctcacacaggcctgggaattgtgagtgctcccgccggggcagaaatacctcgtgatacacaaggccttgggtagagtgagaagttagccctggagtaaaggctgctggtgccatgcggcagaacttaaatgcaagcctcgaggggtcaagttgtttccaagtaactgctggcatcccataataaagccgaagaaaaattactgggattggagggtcaaaacatggcgcacccagttaggagtaattagcaaagtctgacatcaaaaattaccagacatgattcaaggaagtaggaaaatatgacctctgatgagaaaactcaggcaacggaaatagagcgagaaataacacaaatgatagaattagtaaagaaggtgaaaacagttgttataaatctgtgtgttcaaggaagtagaggaaaatgtaaacacgttgagtggagatatgaaaaattataaaaagacccaaataaaacatctggagatgaaaaaaatgccatagaggagacgcgaacgtactggttgggatgcaggagaaagacgggtgagcttgaggccgcagcaacagaaatgaccaacgtgaaaccagggagactccatagcgagtggacagagtgggctccggggacggctgggctgacgcaagccccacagtgcgaatgagcttgaggcccctggacggcacacttgaaatggtgaaaatgtcaattttgttatatgtatttttttaccacaattaaaaaggaagtgaacagagcatcatggcgccatgggaccatgatgtattggcttccaagaagccaaatacagcgggagttgcagtcccaaaaggtgacgggagtgggcgctcagagaacatttgaagaagtcggccggaggtggggcgcggtggctcacgcctgtaatcccagcactttgggaggccaaggcgggtggctcacgaggtcaagagatcgagaccatcctggccaaatggtgaaaccctgtctctaccaaaaatacaaaaattagctgggtatggtggtgcacacctgtaatcccgctgcttgggaggctgaggcaggagaatcgcttgaactcaagatgtggaggttgcagtgagctgagattgtgccactgcactccagcctggtgacagagtgagactccatctcaaacaaacaaacaaacaaacaaacaaacagagaaacaccagagataaaatgaccagagtgaaaagacacgttgaagactcagggtcagacatgaaaatgaccttaggcttctccacagagcaatgcaaatcaaaagatacaggaccagcacctcctaaagtacggaaagagaaacagtccatccagagttctgtgccagtgaaaatgtctttcaaatacaaagacatttccagacatgggaaagctgagagaattaatcgccagagacacaccacaaggagtgtacaacggattctgtcctgaaggacatgtgggcatatgcaaaagacgctttttcttattaaaaaaaaaaaactcttccaaatctagttaactgattaaagaaaaataacaatggattgtggagctcatgacacatgcagacataaaatgcacgtgagcaacagtgtgaaggctgggagtgggcgtgcaagtgtactttcgtatggtccttatttggtatgttaggcgatagaatccgattgcaggcagcctctaagttacatatggtaaaccctaaaacaaccaccaaagacaataacaagctagagatatatacaataagctaacaaaaaaagatacatggaattataaaaaatcctcaatcaaaaataaatgtcaggaaaaagggaaagaggatttaaaagatggaaaaaggaaagggatggaaaagatatatttacctgaatgctaacattaatcagaggaaagctgttctatatctcaataaagctattttaaaaacaaataaaggcggtcaatacaatggcaacccaaatcatagcaggatgttttgtagaaacgaaaaagctgatgataaaatttatatggaaaggtgaaggaactataatagccgaaacaacttgggaaaaggacagagttggaggactcacactacccgatttaaagacttaaaatcattaagacagcgtgatagaggcaaaccaacagacacatcatcaatggaacggagaagagttcagaaataaacccacacagatgcaggcagctgactttaatagttttactcttttaatggtgggggctgtcctcttaatttatagtattctgagatatctaccttccatgttgttaagagaatttttctggaagagcaggagaaacccattttctataaaatatctgtcccaacatcaaagtcatcaaaagaagcagcaagaaccgaccctgcctccccagcttccgctgcttcagaggagaagctccctcgaagacagatcatggtgaagttttcccctttctctctgcttcaaatgacgcacgagtttacatactgtgctaacctatttctgtttatacaattcatgtgcttttatatataaaatttataattgtagaaaaatatacctgacataaaagtttaccattttagccatttttaagtatacagttcaatgggacaaagtatgatctggtgcaaccatcaccactatccatcttcacagtgttttttgtcatccaatcctgaaactccaaacccattaaacactgaattgcctgtctcccctccctcagctgctggtagccactgttccattttctgtctgagaagtcttatctaaggcatctgtgcattttatcgaagtctggtagggaagggatgttctttgcaataagccattctggaaattacagatagtgctgggatttcttagcctttgcggtcgttcaggatctcagagcatgggtaaagttcaacgttatcaattttttctctagatgcttttaagagttttctctctgacttcagtgttccaaatcaaagtgaagctgcactgtttcactcggcagttgctgagttttttgtttgttttattttattttataatactgcttgggacttttaatctttgaattaatgtcattctttaagttgaacaattatcaggcaaaatctttttaaaagtactttctctccttctatctatatccttttaatgaaattcctattagatatagattagaccttttcattctaccatctgtgtctctaccattacccgcttttgagatgatcgccttccttgtatctctctgctgcattctgggtaattttcctgtgacaatcttttaattaattcacttattctctcttcatccatgggtaaacttccatttaacccatctgtttttcgtgcttgtaaattatttggctcatttttaaatcttcttacccttttaaaaatagtcttccattttccttatgttttgtgttccttattttgtatctttactgatttattttttattttttagtgacagactctcactctatcacccaggctggagtgcagtgctgcaatcatagctctctgcagccttgaactcttggcctcaagtgattgtcccacctcagcctcccgagtagctaggattacaggcatgactttattcatgtttaacattgttttcttaagtctctttcagaatgttctattgtgtctggttcttgtggcggctgctgtattacttgtatctttgttgccactgactgtagtgatttatttattttgtgttttataagtttttactgcgaacttatctttggtgaggagtttttttgattgtttgttgttgttgtttttttttttttttttggtaggagacttgtgtactcttggctgtgggtttgcaactatgatttttcctgcaagggcctggggtttcacaaaagttctgaatcagttttcaggtaacgtttgtggtttgtgatttctctgccctgtgggctccttgcatttggattctgtgctcacttgcggtgcaggtgtgaggctttgattgctcacaggagacctgactcctcatctagactctcaggcacgtggaatactttcttaccacttatctggacccccttttcagggactaggcctatctttgagtgccctggacttgcacagccatggcacctccatgtcctgcctcctgtctccagagggcagaaaaccctgccttgtaagccctgttgcttctgtctggattggttcctcagcctgggtgcttgcagtaccaactcaagccttctacccagcctttttccactcttcatttcttgcacctaggaagtttccttcttcctttttttttttttttttgaggagtcttgttctgttgccgaggctggagtacagtggcacaatctcagctcactgcaagctccaccttctgggttcgagcgattctcctgcctcagcctcccaagtagctgagacttcaggcatgcaccatcacatccggctaatttttgtatttttagtagagacagggtttcaccatgttggcccagcaggtcttgaactcctgacctcaagtgatcggcccaccttggtctcccaaagtgctgagattacaggcgtgagccaccatgctggctaatatttgtatttctaatagagaccgggtttcaccatgttggccaggctggtcttgaactcctgaactcaagtaatccatccgcctcagcctcccaagggctaggattaaaggcgtgagccaccgtgcccagccagtttcctttctttcttcccttcaacgtcagcagcatattttaaaacatattttgtttctattttatctgcattacttacatgttggttaggggagagaaagggagttgtatcttagccaccatgtgtcgcgatctggtgcttcagagacagtgcactttgcagaatgtgttttactactcaaggattgcaataatattagaatctgtatagtctcatgcatttttattatttactgaaaaacattttatttgtatatctaaaaccaaataacttgatttttttcccctaaaataatcatatttaaaaatctcactatgaatactcaagaaaattttcatcagtttcacatgtaataaagtagcttcctgaagaaacttccatacacggtgctggtggttcaatggatttaatttgtaagagcaaagccagtcttcacgtgcaaaagctttttctcatgtctgtgcactaaaaacagtatagagaaaaatgatactttttatcagtgtagaaaagaagcaaatttatgagcactttggagtaatagccccatggcttagcttcatcatgtttgtttatgcaaacacttgtggaactttgcttcctcgtgacacacagttttttttacaatccttcactgggctgacctttcttccactattgattttgtcctcttttgatgactcaattatgcaggggaataatcttagtaaaaacctctctcttttttttttttttttttttttttttttactgtgcttcagagtaatctggtgttgggctaggtaaggagggaaatggggttggcctgactccttccaggagtttataccctagttgagaactaggcttgggatgggaggcttgggagatctttacaatgataagtaatatcaacgttggcagaataaggtgaagcaatcaaaataggtgacataattggccaaggatggagaagaaaggaatgttcggggccgggcacggtggctcacacctgtaatctcagcaccttgggaggccaaggcgggtggatcatctgaggtcaggagttcaagaccagcctggctggctgggcacggtggctcacgcctgtaatcccagcactttgggaggtctaggtgggtggatcacctgaggtcaggagttcgagaccagcctggtcaacatggtgaaacctcatctctactaaaaatacaaaaattagctgggcgtggtggcacacgcctatagtcccagctactcgggaggctgaggcaggagaatcgcatgaacccgggaggcagaggttgcagtgagccgagaatgtgccactgcactccagtctggacgacagagtgagattctgtcttcaaaaaaacgaaaaagaaagaaaggaatgtttggaatggaacagggttaatgagggaagcacctctggggaagaggccttgagcctggactcagctctggaggtttaggtgggacaggcatcccaacaaaggacagagactcatcagagacgcggggacgctcactgatgaaggacctgggggtgtggctggggaatgtctccttcgtgatgaattcttctcagtttccctgtgtccctcggttggaggccgctgctccaacttctcatttcccgctcctgcttcatctcttggaatagtgtttggcacattatagtatctgcttctactatcgtcttcccaactggaacacgagccccgcggggctggggacaaggtcttaccttgcatcccaataaatgagcatttcatttaaattgtgtttaaaatcgtggcttgctggatgatggctgaaccgtgtcagctggtgtcggtggtagatacattgtggtaaaagctttttccttcctcccgaccccacctccaatccttgcagtttactgttacacaccctagacttgacttgggaagtaaacagcgccagcttaaggaagcacgtggcctattgataaaggattgggctgaatgtttagagccaaatgcacccttcggttaaagtgctgaaggattcaatgcgcaccttcgggtgcttagcacagagctgctgagaaggaataaagtagggtcggattaggaataaaaagtttaaagtatgatcctttccccacgcggcttacacacaggctgtgggtatcggtcatcaccgcaaagcagccagagtcccacagagtgtgcggccgagtactgagtgacagagaaattcctgtgggcaagagagtcacagagtggctagagcttgagctgggtggagtttagttacatacgtcacctacacgtagcccttggcagtctccaagtactttcaggccgttggtcgtcccaggaggacctgaagaggaagctgcggggggcaccaccgcccagtctagttaaacgatggcttttagtaagcgttggatttgggcagaaggtctcagtctttgggttacaccaggctgctgctcaggtcagtggagaagcacaggcaagggcactgtggtggggaaaccaccctcggggatcgtgtgaccttgttttggggaagaaggaagtggagcagcacagttcatgccgacacgtgtcttctcagagggccctgtctcaatatgaatacgctgagggtcgaagggaaacatcaaaattgtgctgttagaagtgaacagaaaaatggaagaatttgtgcaacttgctgtctatctatagagttaggggagactttaaatataaatctctgcaagaattcattctggggtaatattgtttagcattcaggatcaccgtgtttttataaacagtggagcatatggttcttatgaaatcagaacattgttggtttttataacagctttttatggaactaacgaatgtcaaaatattttatttccattctaaaaaaaattccaacactttcagcccttaacttattttaaaaataaatttgtatgagggggaaagttcaattttactattcagaaaaaatattaataggtccagggtaagaagaaggttattttctaagtgaaataaaaatattatttaaaaaaggcaaaccaaaagtaatgccactgatccaaaatgcaaggagaaaaagaataagtcatgttcattgttttgagaagaattcatttatcaggaagctgaaggactgctggctgtattcttgtagaacaggaatttacaatgtgatattcctaactgacacatttgtgtgaaatttctatagtcgttcaagttcaagcatttttctgagcacctattatgtgccaggcaccctgttagacacaagggatgtaggtgagaggaaggcagcatttttgccaccaagacctagagctgtagggaccgttcccaggaggctgcgctgagctcagaagccaccaacacagcagtggggcaggaggcagagatgggggaggccctcgacctggggcttgacagctcagctaaccaggagttaaccaggcatagaaaaagggaaaggtggccgggggtggtggctcacgcctgtaatcctagcactttgggaggcagaggcgggcagattgcctgaactcaggagttcgagaccaccctgggcaacatggtgaaatcccgtctccactaaaatacaaaaaattagctggacgtggtggcacacacctgtagtcccagctacttgagaggctgaggcagggagaatcgattgaaccaaggagacagaggttgcagtgagctgagattgggccattgcactccagcctgggcgacagagcaagactctgtctccaaaaaaaaaaaaaaaaaaaaagagagagagagaaagaaaaagggaaaggagattccaggttggggggaaaatggtcaaagttatgaagaaaaagaatgagaatgacagggtccaagcacaggagccttgggtgtggctggacatgactgtgggaggtgggtgctgggggtgccaggtcccagggccagcttcccactggcaccgggaccgcccctcctccccggacagccgcgtgggcaaggccggcttccctccacatccccacggagcacgaggtcagatgcatgggttgttccggtccgtgggtgagaaacgggttctctgtgtcgcgtctcttcagagcgaagttgagtcttttcgtgtgcttctgacattcgcatctttttttctgtgcattcttcacttctctacaaggactgacctttcccttctctatctctaggagcacttgatagaacagaaatatttaagccgccgctactttctcagtctgtcgtttgcttctggtgtctttgagccacacgaacatgtttacatgatcgtaggtaaaaaggctgccaggttccagaagaacccccctgtggactctgctgggacacgcatggccgggtggttttcattaaactcgtggtctgttgggaatgtgtcctagtccattttataaagaattgaccccattttatctttttatatctattcatttactgcaacgccacttattttttaaaatattaattaaaaataatattttaaaatttatttatttaaaaaaaggatatagagatggagttttgcccgttgcccaggctggtctcaaactcttgggctcaaatgatctgtccaccttggcctcccaaagtgctaggattacaggcgtgagccatcgtgcccggcctgtaacaccacttattaaaacacctctctccccactgacctgagatgcccctttatctgacagcccgttgccacatggagttgtatctgtcttccttcggcctacttactaattcacgcagcaagaccaagctgtcatagatagagtctcagagaaggttccagtgtctgagcccgtcccatcccagttcctctattttccagggcttctttctattctcgttcttttattttgccaaaaaaaattgtaacaaaactttggagctccaggaaaaacctgacagcatatatagtattttgggggggattgaggtaagtttataaaccaactttggaaaaactggcatcttcatgagttgactcttctattcaggaacatgccgtgacttttcacttgtttgagtttaatcatgtattttcaggagcctttttatcattttcttcatgaaggattagaacatttcttattaagtttatttccaggcatatttttgttgctatcactgatagagtctcatctcccagcatgtcttctaactctgtttgtatatatagaggctatggatgtttttacattaattttatgacctgctgttttgttaaattattttactgatttagtaattttctttgtcttttcattttggatttctcagatgtatggccatattagctccaagtagagattgttttgccttttctgattcttatgtcactaattgatttcttttgttcaactgcataagccaatcatagctcgttgcaatattaaatagtattgcaggtaaagagtattgcaggtagttggcatcttggacttttccctcctattatgggaaaaactccagtattctttaaaggtaagatgtacacaaaacctaaaatatttacgatctagttttttcagaaatagtttgccaacccttgccatagattaggaaacttagaaggcagcaaccctgtgcaatgtagatgccatgatgaattattatttctaaaacaccagctggaaaaagtaacttaactagacaattaaggaaatgcgaacactgacttttggatggtgttaaagaataactaacattcatgttaaggcatggtcgtggtaatactgttacgttttcaagtcatgatcctttacagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcaggtcagcttcagcgtgagaagcaggccaggcctgggtctggagccgggtgatgtgcacatggggctcacttttctattctttctacttttgtatcttggtgtattttctgagtgaaaagttaaaaaagatctcagccctgagcatcttcccacacagtgctcaccacaccctctacatcatgcatgtggaacacctcataagggtcccctcccccatgtcaaattaatgccgctgctggaggcgaagtggatcaactgagcgtcaggacacacttgaaaatgaaggaaggaaaaaacttggttccagctaagtcaaaacctgtcgttcaggaaactgaggttcacattaaagcatacctgaccaagtgcaaccaaccaccagtgctgggcagctgccagggagcctgttctctcaccgtgctccaggcttctttcaaattgtgcaggaaacggcattttttggacgttgcttcctattttatttgtacctgtttatagacccagaaccacatgaggtttccttttcagagtggacatccagtcccatgatatcaattcaagttctgctgaactgacctggggcctaggaaaacaagatttttaagagcttgaacataaaaatcaaatgttatatatcaaatattgctcagagtgggatttttacattgtgattattgggccctctaaagtagagctaatttagttatgggataattatatcctccctctgtccctctctctctccctccctccccctcctcctccctcccctcccctctcatcttccctcccctctcctttcccctcccgctcttccctcccttccccttcccttccttccttccttcctttcttgcaagcatctgtcacttcatttatgcttattacattttcatagcagaaagtactatctttactctttattaacctctgttatcttgaaaaataacacagattaatcttttgttgaagaatcctgatggcgttggggggatgggaagtacacggggcgttgtgttcccaggtttctgagtctgcatgctagagccgctttctgctgcttctattaatacagcattttcactttgtctctcagggtttatggtccagcagagtctcagagcgcggtctttggagatgtgtgccccctactcacttctctcttggatgggtgagttaaaatatttttaaggccagtcatcatagttacatttgaatataaagaagcttcactgtgctgtggagtgagaatgtagcattagagtctgagcattctacagcactgcagagcatgcccatgggtcacccagcatggactccacttgcatccgtggagactatttccgcaccctgggaaaaggagtgagaatgatttggagaatgcttgttaaatgagcatatccacctgggattccaaactccactttagttacagtgcatgtgggcttaagcctgtgagtgcagctgccattctctctgggattctaacatttcagaatttaaaaaaaatctgtaaggaatgttaatgtcagatttagggacttttccctttgggaatcagccttctattcttgcagtatacaactactgatgtcaaaggcagtgggctgtaatttaggaatgaagaatttttttttacttaatggagacaccttaagccaatactttccactctggggcattttgaagaatctcagttttgtggcagaagtccacataaagttcctgacgaagacttacttgcattgtccagcaaaggcttctgcacagccaacctcaaggaacctcaaggacctagaaactgtaattacacagtgtgctgcgcgtcccaaaggcacatgatccaacgagtagggtcaagtcaggaagctcctgcatctgaccacgcacgcacgcggggccgctccgccaatcatgatgcagttgctgcttcaactcttcctccagagggctgggatttttatacccatctgaagaaatggttttgaaaatgataggggagtctctttttaagtaggcatcttttaagtaagcagattccagaaataaaaaagacatcgtggtcacagtgatcactgccagaactgcctttccaggataatgcgaaacagatggagttagtttgagttctgagtcttgtcagcaaaaagagtcaaaccctgtaaaatattgggagagatttatcctgagccaaatatgagtgaccgtggcccatgacacagcccaggaggtcctgagagcacatgcccagggtggtcgggcgcagcttggttttgtacatttcagggagacatgagacttcaatccaattcattttaaaaatacattggctctggaatgtctgggttaaggtaaaggattatggagactaaagttctcatttgcagaggaagcctttaggtagcagcttcagagagaacagagtgtagatgtttcttatcagatgtaagatctgtgtcgatattaaggctgcagggtatcgtgaggcctgtccggcccccacttcccgtcatggcctgaaccagactctgaggttaaattttagagtgccctggccaaggaggaagtccattcagatggctggggggccttagaattgtgtttttggtttacagcttccttctccgggaagtttccttttaatgttcattcttaaatggttgaaagactcctgtaagaacccgtttatctgttgtagtcaaagatattctccacacaaagaaatgcatgtaaatgaattcagggaagctggaagagacatagcctatagtggggttttgttatgaatgccttgagactttttaatcctggaaggaaaactcacaggatggtaacgcagaggcctgatcagcttggcgggagcttgtggtttccaggctcttgtggctggaatgtaacagtcaaccctagtgactcaaaccgtcagccccaggactgggctctgctgcttttcctgtccttttctaggggagacttagatgtcaatcagaacactgtcttgcaatcattttgtcaaaacaacaagctttatttgttggacttgtggtgggtacaccacgttaaaccggtattgatacaccggagtcacagttgaccagttaagtcagaatttctgagtgcaggacttgctgaatctccccagatgactcggacggggggtcagggccggagatcctgctctgaggcatgaacccacttagcatcaggtcaggtggacccatacctttacaaccatgaacatcttaaacatcatgactaagaggatgattttctatcatacttattttaaatattcttccaaatatttctgatcctcccattaatattttgggctaaatagcacaattggaaggaaatgtagggatgttggtagttaacttctctgaaataagctgcagttagctaattgagagtcttggggccgagaggcagcaggtgctacgtcacagagaggacctcagcacatgtggattgactgtggacatgaacacctcaaagtcgcttccaattacaaaatacaaaatttttcttttgtatgaaacatacgcaaaaatggctcatgcttgtaatcccagcactttaggaggttaaagcaggaggatcccttgagtccaggagtttgagaccagcctggccaatatggcgaaactccatctctactaaaaatacaaaaattagctgggcgtgctgatgcatgcctgtgatcctagctacttgggaggcttaggcaggagaattgcttgaacccaggaggcagaggttgcaatgagccaaaattgtgccattgcactccagcctatgtgacagagcaagaatccgtctcaaaaaaaaaaaaaaaaatagatagttacagtgaaggtgtggggatttaggaaggccttgctaaggtcagaatccctatgtgaatgctgagctggtggatggggagatgaaaacacccaggagaaaccgggatggatgaacccacgctgtgtgtgtgtcagtgcaaataccgtttaatccaatgtcgtacaacaagatagcaacaaggatagattatgcaaaaaatagttgtagttaaatgaaaacctaatttataagaaatggagtaacaggagaataggaaatgaaatgtattgaagtttctcatacaagtgaaaatttttcctggaatcttcttggcacccacgtgtgttttgctggactgaatctgctctgaattttaggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggtactgccgatggtgatgagtggggcagagaaatatggcagggaagccaggcggtcagcaccttggttatcacgtgggaaaaattattaccatttgaagaaggtgatcaaaccccataatctcatcagatacattcaacactatgaagtgctttcatacttctgggcattattgctaccaatcctgtgatgaaattatgttgcaattccatcattaagactaaactttatttttaaatttttttagagacaaggtcttgctttgtcgcccaggctggagtgcaatagtgtgatctcagctcactacaacctccacctcctgggttcaagcgattctccctcctcagcctcccgagtatctggtatcacaggagtgtgccaccacacccagctaatttttgtatttttagtagagacggagtttcgctgtgttggccaggctggtctcaaactcctgaccttaggtgatccactcgcctcggcctcccaaagtgctgggattataggcatgagtctccctgcctggctaagacaaaacttcttgaaagagatcccgagttacagggttccttaggcaggggtggaggtgggggatggtgagggatggaggttttctgtcctggaatgggaagcacagagggaaaactcccgtccttccgtcgcccttcctcctgccgccatcaggagtgtatgcattcgcttctcttcaggggtccagccaacatggcctgcgaagatgctcccgacccgttagcacattctcgaaagagacccactgcccgtgtcatgatttcaccaacatagttagttctagggaaaaataaaatagtaaaaagtcgtctcagtggccgggcgcggtggttcaaacacctgtaatcctagcactttgggaggtcgaggcgggcggatcacaaggtcaggagttcgagcttgcatggatggtgcatgtcattaaatattcaaccagtcatttttccttctgctaagcaaactctttaagttccagaaacaaaggctcaggcaagagccctggggaactgaggtagaaaaaacaaaggctcaggcaagagccctggggaactgaggtagaaagcgggagagaatggtgggagtttcaagaccccccgccgcgtctcttctcgtctgtgagagcggggacaccacggtggaagggggcgatgtggtgtggcagcacgtcccggacgtcggcttcgcagtgttcccagtgtgagctgcgtgcgtgcttccgaggccgtttccccctcagctgggcttagagatgcacgatgcacagccagtgagagcaggcgtcgtacattccacggctgcgtttccgtttggctctggaatttgccgacggaagcatatccagggcggcaaagggatgccggggctggaacggcgcggcggaggaggcgggaacggcgctgcggggggggcgggaacggtgctgaggtggtggcgggaactgccctgcggaggaggcgggaactgagctgaggcagcactgggaagagctgttagctgcctaaaagtgttagggaagatccatcaggaagatggccaggcggctgcgcctctccagaaaccggataatcagcgttaccaatgggcccatcgcattactggcaagcgtttcagtcgcctcgtttctaaaatggtttttccgttttgctgttctgagtctcgggtgctgtgcgtctccctccagggcacagtgatttgcggcactggaatccctcagtcagagtctcagaatctctgctcttccaagtgagtggccccgggcaaggccgtactctccctacacctcaccttcgtcgtttgcagaaacgagaatcggagcagacacggaccgtgtcctccctcatcacatccacacacgacctggagaggggtgcactgggccagggctgggggtgagcttgggtgttcgtgactcaagttgcaaatggccctctgcccaaaatgatacaaaaccacaatgacatcagtgctgatatcagagatagtttacaggaaccctttaccctgaaaaggactactcttagattgctgaagtcaccagataagccatttcctgtcgttttaaagtaaataaaatgctactgcctggattccttggctctgcacgcctctctcctttcttctaaacctggttgttgacaccgcctccttcccgactgctctccgctgtcatccttatcaacaggagtgtgtgatgtttctccacctgctacacactgtcagaggcacaagggatccaaaagtgcatgtgatcagttttctgcttttaaaaagtctagagtggaaacgggtaattatgacccagtagaaaatgggcaggaacagatggcagagacaaagcctggccccgcccctccccgccccagagagtcaggggagctgcgtgcattggaatcacactgttcattgcaggacctggagtcctttgcgtgtgtgcctcgccttctcaacactttgcttcttaaaggctaagactgcagcctgtggttttcaccattgtccctagaatctagtcaacagcccaatgattacttgtgggaaatctctcaaattaactcctcggtattatgtaattgagaaatctctaacttaggttttgtgacactcaaagagacaaactgacacataaatgatgggcccaagtgtggaggttaagtttctggatatgtggtgcattttgcctaaggtgtggagaggaggagaatgtaaaaactctagtttaggctgggcatggtggctcacacctataatcccataactttgggaggcttaggcgggtggatcacctgaggccaggagtttgagaccagcctggccaacatggcaaaaccccatctctactaaaaatacaaaaattagcctggtgtggtggtgcatgcctgtaatgtcagctactcaggaggctgaggcaggagaatcacttgaacctgggtggcagaggttgcagtgagccgagaatgtgccactgcacttcagcctgggtgacagagcgagactttgtctcagataaataaataaataaatataaagtaaaataaaatctgtagcttagctaacttcatgtttcactgttgcacacactcagagtgttctcagcaaaccccagtgctgaacctgtcgaatccaaatcttgatgctttgccaataatgatttttacctgagagttttacttactttctctttcattttagtcttcatcattttcttgactgtttgtcattagaagacaaaactcctctagatctggatgaaaaactcagcctggcagcgcctgggtgggaaacattcctgctggattttcccttgagtacagatagcatcctgtcactgaggacttcccgcccggttctcagaatagccttaggaacaagaaaagcacaatgctcaccatcggattgacatcaccatgcaggtggtagagaggcggtcacctccagcagaaagaaagaggcctttgttatttggtgacgaggttggaaggggagttttgtcagagacaaaccagaaagccagagggaggagagagaaagggagggaatccagggttagcactcacccatttcttgttgtgggattaaggttttatttctctctctctctctctctctctctgtagtatctttatttaaaaacattcctacaagccagtgcatagttctttaaaacatggagcaaaataagatgtgcagctgctttttgttttgagatggagtcttgctctgtctcagctcactgaaacctgcacctcccaggttcaagcgattctcctgcctcagcctcccgagtagttgggactacaggcatgcaccaccacgcccagctaagttttgtatttttggtagagatggggtttcaccaggttggccatgatggtcttcatctcttgacctcatgatccacccacttcagcctcctgaagtgctggaattacaggtgtgagccaccgtgcctggctgtgcagctgctttttaatgagcccgagctggttttacgggtcttgcaggaaagttgcagttggaaggcgtaagtggaattggaataaactctggactgaagcttccctgaagtggaaaagttttaaaataaacaaaccccatcactggagaagtgctagagtcctgaacatccttgcagcttgccttgggtgtctgcagtgattggtcaatggggcatggtaatttctagaccacagccatgggatagtcaggcttcttcgccctgtgtgtttagaatcctcagtgtactggttgcaaaagtgttggtttaaatataactctgataaaataactgctcccaagacacgtattcaccctacaacctaaatggcacaccctatttccctgagtgatcttcgggtatgtaacatgcagccctctgctcggaccccagcagtcttactgagcatcctgtagggcgtctggggctatgattggcttacactgaaaatcactctgtgagactttctgtaagtttctcttgtgtgttttcccgcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgagtgagtactgcacctgccccgtgctgctggcctctgagtgagaatggcacctgcccctcccacctggtcaggaggctgcacgtctctaaacgagctccccacgcccaaggatcccaaggagaatcggccgtggtggcccgatcagtgctccttgtcactgagtggttccttgtgtgttttcatgcttcgtatgtgttgcacaactctcaatttgctgtaagaatgatctttctttaaaggtggctatgtcaggatgatatatttgttaattagctggaatgggtgatcatttcacaatgtattcgcatatcaaaatatcaaggtgtataccttaaacatacacaattttcatgtcattaatatcttaaagctgttagagataaaagtaaaaaaaaccacaaaaaatattttttacaatcaaaattaaaataaataaatgtatctttaaaaaaaccttcataagagcccctcagatgggcgtcatcccatctgacagatgaggaagcagacttgtggaggtgaaagaacttgcccaccccactcaggctaggagagatgaactcatccacatttgtaaatatcagtatttcacagaatatgataatgaatcctcttgtaaaagtgaggatcccccatattaagtattttcctcaaagttccctattgtcaaatccacatggatgtgctgggtttgccccagtgggggtgcagctgggaggtgacagaaggaaccctccccatgagtgagggcccagtcaggctgcccatcctgggccccggaggcagcaagggaagggcccaccagccatgctgaatgtttcacagagctgaaggaaatcatccatgcaaccctgatacggtcacacaaagtcgcccaaaatttgagcctttgactgacagactgtgatggaaatgttatctcctgctgattaagagctctgattagcagtcatatctcatccactaacacggagaaatgggttaaacctttattttacaaatcagatttgatacacaaaatatttttaaaacatggttcctggaggctctaataaataaaggaataggtgatgttgaaaaggttagcaacctctgattttgttctgaaacagtccattatttcagggtcagcaattagagatgctataggttggttaggtctcaaaaggaaaaagtttgctttaccatgatttattgtgcctgagactggcttcagtaccccactggcacgcgtggctcatgtgagaggcttccctgagccgaggagtcttggaagtcgccttaggtaaggggggccgccctcactgtgttccccactgcttgccttgtctgtagggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactggtaagtcaccatttgtgcttggtcagtggcaagtaatagaaaaacccacttaagaagaaaaaaatcaggccaggcacagtggctcacgcctgtaatcccagcactttgggagactgaggcgggtggatcacctgaggtcaagagtttgagaccagcctggccaacatggtgaaaccctgtctctactaaaaatacaaaaattagctgagtatggtggtgcaagcctgtaatcccagctactcgggaggctgaggcaggagaattgcttgaacccaggaggcagaggttgcgatgagccgagattgtgccattgcattccaacctgtgcgacagagcaaaaactctgttaaaaaaaaaaagaagaagaagaagaagaaaaatcagcatgcctgcagcatccaaggcctctcatgggacccagcatgggaacagcagccacaccttttcagtatctgcatcccaaacccaaaagtccactgggatcccaggctgagaagaaaaagtgagagtgggagggaggaaaacactctgctaaataaaatataatgcagaaagaaaagcagggcataatacaccttggagtacatgcatttgtcatggaagaaacaatgagtgtaatttcagtttaaaaccaaaatttcaaactatgtagtatataaaatgattccagttatgtaacagaaagaacacaggcctgtgaagcctgggctgcaactctcaaacttgagctgcgtccaattccctgcagcaggtggtgggaactaatagcagacaccacccatgctcaggttcagcagggctgggactggacccagagtgtgcgtttctgcaaggatgcggctccggggaccacacctggagagccacgggtctggggccggaacatgagactgtagtcccatcaaaacctggtctcagtgggttgacactggaaaggccatttctcactcatattgaaggccagtgtggctgaacattccccatccttcttgccaccgtggcacttgaaacatttggcctccaaggttgctcaggcaagggaaggagaggtgacggggaggtgctgacaatagcccctggccagcccagagtgggccacagctgggcacacggccttgtaccgcaggggctggaaaggcacaggcgtgtgatgtttagggaacaccaacaatctctaccaaaaacgctcccgatacaggggcggtgtggctgccagtggtggtgggaataagaccggatttcatgtcctttaaaaaaaattgtgtatactttctatgttttgcacagtgaataaatgttattttgcttttttaaaaaacctaagaagtttgtttaggaataacacactacaaagacatttgcattaaaattaagagcccttttgttaggatttgtgtggaagattatcgaacagattgtagaatttatttctaaaagggctcatagattttctgagtgggattttaattaacatgattaccaagtcttcctaagaagcattatttgatttcctctgggccaattaggcattagttcaaccttccacagtgaagaaagctgctttctaacttgtgttttcccccagagaagccactatcccctggacctctgcggaaatcccacttcttactgggtgggaggtgtgggcaggagggtgcagttcagaagcttctcggctctgactgaggcaaagcacagcctcatggcttcatgcaactgttttcctcctcgtcgctccttggtcccttgcagcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgagcaggggcaggcatttccctggggggtgggtgctgcagaagcctatgatctgatggagctggatgtgcaaccaggcagcccgggaagctctgggcgagccaggcatttccccctccacaggtgagttccaaatcccgttacattctcagggattggttctcttaccccggcaacccgagagtcgtgttcctcacacgggccctctgggaacagaaaacctgagttcccagcaggagctcgctttgagctgtgagcagagccatgaaagacactcactctcatgcctgtcccgtccatggcctcccctctacctgcctgagagccgctcctcccaaggagccggttttgcttttcctgcctcctttcttggtgcaaacggtgatggtgcgtggcggtcctgtccaggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggtaaccgttttccccaaaatgccccaggatgggggaccacgtaccccaggacatgtgcacacacttctggcctgcacgtcctcgagggccacccatgcaccccctgcacctcctgtgtcctcgctgtggctagctggcactcccacggcacggtggtcattctcctgcgccgtctcaccttggcctgattgtgtgcttgttcggtctgtgtgtgacttgcctcctggttggggctcagtttctcaagggtggcagccctggcctttctcttcaccaggggtccgccagagcagctgagggctctctaggctgctgctgcatgtgtggcctgggtccctccggctgtgtagacctgcttaggccccaagttccttgggtcttttgggggcaggtgccagaagcctggacgcaacagattaagcaccagtgccaggtggggcacaggcggcccctgtgtggagtcatccagctgtggctggatctgggctttgcggtttttggggagctcagttagtgccccctcccccgactcagactccagactggttgaaagggaggacccgaggaagcattgcggctcttcctgactcagggtgcaggcagagtcccccagaggtggccctgggccctgtaggccgtgtcctgagaaacggccactgcaggacggcaggggcacatggccaccacagtcggggggctcctccttcctgggagggccaccctgggaggtggtggaggggccgctggtgctcgggactcggggaggctggaatgttccagacactctccctgtctctcattgtggggtatttccccctctcatggcaaattggcttcctccacacggtgaataacagggctgttcacaggagcatatttttggattctgcctttaagagagagaccacctggtactcttggattccaaagttcgcagccccaacagagagacagggcgacctgggtcaggggcacagcccacccgtgatctcaggggcggcaccgtggggcacacagtacctgagagccagcaggtccctcatggagccctggccttggcctctggggtctgcacttttcctcccccttagctctcccttccttctccactgtttttggttttcatctgtaattcttaaccctcgttacgggtcctgaaaaacaggaagagacagcattcctcaggaggagaagtcctgggcacacggcccctgccccaggggggcctgagggagccacagggccatgggccgtgagcagcaggtgtgggcatgagggagatctagaaagaacagccccagggggctgagcgtccctcagggtcatgtgcagactcaacctagggctgacttcatacctcccaattcccgggacacaggagtgtgagtagaaggcctgcagcttccccaggtgaggggcgctagtgaccggctgctgaccctcccggacccaggtgaggggtgctagtgaccggctgctgacccttccagagggtgaggggtgctagtgaccggctgctgaccctcccggagggtgaggggtgctagtgaccggctgctgaccctcccggacccaggtgagggatgctagtgaccggctgctgaccctcccggagggtgaggggtgctagtgaccggctgctgaccctcccggacccaggtgagggacgctagtgaccggctgctgaccctcccggacccgggtgaggggtgctagtgaccggctgctgaccctccgggacctgggtgaggggtgctagtgaccggctgctgaccctcccggacccaggtgagggacgctagtgactggctgctgaccctccctgaccggggtgaggggtgctagtgaccggctgctgaccctcccggagggtgaggggtgctagtgaccggctgctgaccctcccggacccgggtgaggggcgctagtgaccggctgctgaccctcctggacccccgtcccaggaacctgccagacgtggccactttcccgctggggcgccgggcggccctctctgcagccgcccatctcgggccctggttgctggcatgttggcactttcagatgctgctcttctttccagcttgcatgttgtttttctattttaaaggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactcaataaacctggctttattccaaagcaccctcatgaatgtggatgggacctccaactcctgccagaccatcaggcagggcaggcttcacagaggagctccttgcagtgcggcggccaccaggtgtcacagcaggcactcgctgtcctcatcagactctccccagaggccaccctgggccctgaaggccctgccccgggaaactcgggagccggcagaagtagctgtgggcaggagggcagggggcgtgagtgccccacagtgggagctggtcagcctgggcccagtgcagatcccacccgtgagctggggaggtgctgctgggcacgtacggccccagagccaccaggcctcacacagagctgccacctccgcctcctcgagttcgtgcttttcctttccccccaggctccctctttcttcaccactgtttttggttgtccaccacactccgcatgaggagctgtgccaggcagggagggggcgtctggggccagcctcacgaacctgtcgtctcatttgacacaaacgcggcccccaggattcctcaccacaggctccaggaccagatggactctggtttccatggtggctctgccacctcccagctctgcatccctggacggtttgcttggcctctaaagcctggcttcctcctcggcaaagccaggtgaaaccagagggttgggagccttaaaggagacaaggagcagctctggagactggcctgtgacttcccctgccgtggggctgaactggcacgtttaagccccaccccaccacagggctcctctccgcctcacaaggggatgcatggtgacagctgcccaccgcgtcctctgctggaagggtgccccctggggctgcccccatttccaccgggcccgcagtgacagatgtaccctctcggacccagcagatccaagagcagggtcccaggaggaacgcatgtgcggaggaatggggggtcacaagcacagaccaagaataccccatttcttaccagcaaccattttggctctgagaattggctgggaagcaggttttggagaggagtcacagctggtagctttcagatgatttcaatgccaggaaaatgtttttttttttttactctatcctgtttatgcaagagggaggtaaaatgtcttttctagtagttagcacaaaccaagtaaacctgtgcccacatgcggctcaggtgaggagcgtgagctgtggtggtcctgactcatggcgggcagaagggtaggaaccccctcccttcctgggagcccagagcaaggggtggagacaggcagggggtgttcagagcccagtgtgctaacggccttttcctgtactccttttcccagggcggagcattctgcctcactgcgagtggggacctggcccaggctgctggggtccagcttttagtcagggtggccaggagggcaggtgcacggggcatcatgcgctgaagacagagatgctgggcttctccctgccaggaaaggactcagccagtggggctgaaagcagagacatctgcttcaactcatggtttttaatataattgggtagagatgatagacagtagataggtgagatgatggtgagatggtagatgatcagtcagtgaacagatggcagatctgtagatccatggatgataaactcatcagcagatagatcagatttaatctcatatataaaaaatatgatcgtttcaatgtgtaatcaatatgaaatcaatatagagatattaatgagatattcaagattctttgtccacactaagtcttcagaattggtgtgtttcccactgactgacagcgcccctcagcacaggctggctgcgagcttagggggccacaggtgggcagcccacctagccctgtgctgaaccccacagacaaatgcctccattttgtaacaccacctatttttaaggatcccttgattatcctaaagtgaaattatacatagattatataatcctaacagagcatgcctttttt

SEQ ID NO: 17098 - DNA, 31214 bp, Human; identical to SEQ ID NO: 17097

SEQ ID NO: 17099 - DNA, 76563 bp, Human
ttgttccatctttggcaagtgggaactccttgaatttggctcctatgaagtgaactttttaaaaccaaaacaaacaaagggactatttgtttttgtttatgttttccttaaagtgagaaaaaaatattgagcctcctaagtttgcatttaaaagttggcaaagatgagtctcagttagtgggtttgatggctctatgagaaagagaataaaattacttacgatgacactccatgtagactgagcaaacgaaagactcctaagtattgcaacagctactgatgatattttgttttcccggatgagaacactttgtgaagtctataactcttttcatctgaaccaagcaggtgtaaaatgtactttcctcagaggagtttgtagtctagtttgagaagatagcactgtattatctaggtttgctggtagtgacagaaacctcaaaataactgagacttagaaaatagatattaaaaaatgtaatccagggctggcatggaagatccatggtcaccagggtcccaggctctttctatcttatactccattgtcctcaacattcaatttccacctcatgatactagatagctgcttcagctccaactgttacctcaatattctagtcacaaggcaggaggaaaagggaaagaaaaggggatgacagatcccactaaggaaatttcctagaagttgtgcacacgacttctgctacattcagttgaccagaagacagtcatacaactacacctagctacaagggaggctaaaatttgtagtctttattcttgctggccagatgcccagataactgtcagggattctgttactctagtaagaaggagagagtagctatttgggaatagtagcaatccctacctcaagcccatactcagaaaaaaaaaatactatcttgtttgggcagtgtatttccacacatatgtcttaagaatctcagaatgggggaggtaatttaaaatataccagtaccgtaccctcctgggtgtcttgattatgctggggcatccagtatatgaaataaaattaggctgttgtctggtaatttacatttaaaaataaacattggagaatttcactcctatacagcaataattattatttcatttattatttatccctacccactacatgcaatatctgcttacactaaaatctcttgattattaacatagtagaggtaactgtcacacattatacttcaactatgtactaactctaaggtgacatgtatgactagcacctaccattcataagatgtatgggattcagtcctccaaaggaccctcacaaggaagctaaggatcagagaagtcatggcttgctcaaagagaaacagcatagtaagtgacagagctgggaatccaacacaagtttgtctgttttcaaagcccacatatactttgtttattatgccattctgaaggattcacttatttttcactcttccacaaaacgtcaggacagaaaggcagtcatctatatgtagcattgagaaatttctatgggctttaatttaaatcttaaaaactaataaacttcagcaacatatttcttcactttaatgtgtgagggttttgtgctcattacctcttttaattgtccaacccaatttggtgatgatccattcaacaaatttttcttgaacatctgttttatgtgtcaggtactgtgatggttgctgagtatatcatggtaagcaaaaccacacattgtccttactccttgtgctacatgatttaactgctggatggattaaaccaggaactataaagattaaactgtaatccttaccacaattttgagtttacagtttttcaaatatcatttcaagccattagcaaaggctgtatgtattttttacatatgcctcctcgttttgtgaattttgaaaggatgtggtttcggcctttgacatcagaggagaagctcagctatgttggctgaacgttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctatttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacactgtcggcaagcctaagtacaaatgatccttggagaggtagccaccaactaaacagcatacttagttgcacgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgattcctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcaggctgggcacagtggcttatgcctgtaatcctcgcactttgggaggccaaggcgggcggattacctgaactcaggagtttgagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctggggtgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaacattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggtttcaagggcgtgcatcatttcgcacacccagcatttgatgcataccccttattcctctcccataatcatctaagttgacactgtgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaaggcaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctcctgagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtctgggaacaagacataaatttccacttttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaaggtaccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtatgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcatccctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgccctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcaggggcccgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaatgatattaaaaattcagcttcttagtcacattgggcacatttcacatgttcaatagcaggacatggctggcagctactgtactgaaacagcactggttatagaatgttcctatcactgcagaaatttttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaccactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacacggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggtttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttccgtatggctgggaggcctcaggaaacttacaatcatggtggaaggtgaaggggaggcaatcaccttattcacaaggtggcaggagagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgcgggaggactggtcatgccgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataataggtagctatgtgtaaggctgggagattcagtggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaactcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggccaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggctccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccgagcatgagattcacactgccttttaaggttttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaagggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacgtcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcatgagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgacagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgcagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatctagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattcctttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacatgaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttatatatatatatatattttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggatgggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccatccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgctgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccatatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaactaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcacaagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcggttccatatttatttaaatcgcaaactctcagaacttttccttaagtaaaaatggttacattgtttcattttccacagacaattaaagattacatatcattgaacaacattcattcaacaagtaaatatcaaacgttcctatggttcatgcacacagttcagtgtatgcatcctcatgaaaacaaagatggaaaagtcatagtctttacttctaaaaaattcct

SEQ ID NO: 17100 - DNA, 102884 bp, Human
  misc_feature (1)...(102884): n = A,T,C or G
attgcttcttctgccctattgtttatgtaaaaatgtagattcactgagctagactaaattgtgtattcagtggaaggttgatcaaggactcaaaagaatgtaacctcttctgtttcttatctacttataacctggaagcaccaccctttctgcagcttggagttgtcttgccttaccggaccggaagcaatgtacatcctacacatattgattgatgtctcatgtctccccaaaatatataaaaggaggctacacccccaccaccctgggcacatgttgggacctcctgaggctgtgtcatgagcacgttcttaagcttggcaaaattaaccttctaaattgactgagacctatctcagatatttcgggttcacagaaagatacgaattttacagcagctggagactaacggagtcccaaacgacattaatggccagaaccacttatttgatttccctcatgggtgcccatgagtagggtttgatagacctacctacccatcatcttcaggagtgcctcgccctctccaacacttagcacttctctagtcaacctgggtttgactaaagaggctcagaaaaaggaacagatggacgaggtttgaggctgggattctacaacgaggctttgctaaaacttgctgagggatcttaggcaagtcatttctctctcattatcagtttctccacctggaaaataaggtgtgttgcatcaggctctggagttatacggatgtgggtttgaatctaggcactgacattagctgtgtaatcttgggcaagtggtttagcctctcaggtttgatttcctcatttctaaaacagggatagtactagtacctaccccatgggattactgggctaatgaaaagagataatgtatgcagagtccctggctcataaaagttattttctccgattaattaaataagtgaatatgtgtaaagtgctgaagacagcgtttgacacttagcgttttatcagtcttagctatcatgattttcttattctagtacatagaaagtcctcaataagtaacagtagttattattatttttggtcacatgtccctgtgtttccctccaaaaccctaaccatccccaattctggttttctccccgcatgcagcccaagggttttcacgtcccagtgcgattgtctgggctgtttcctccgcctgatgttccatttctcctcctcccgatctcagatggcttctcctctgggattcctctggtcttcatcactccctcctcccaggcagaaggaatggctcctggatttgtgtcctgcttaaaaaaaaaaaaaaaaaaaaaaaaaaaaaaaaagaagtccatatagcacttagttctttgtgcctggcggttgggttaactctttctgagcctgtctccgagagtggcggcccccgggggacggcgctgggtgaatcacctctgagtgtcacccaaggcgtctggcacagtgcgggacagtaaacgggccgctgtgcggagaggggtccagtttaactcctagaagcccgagtccccgaccctctacaggccgcgttccaccacaaatccctcctcctggggggctcggattctcccttccccgcggtctccctcacctgagccagcccgctcccccgagtctcgccagctcctccccggcccctccctccagccccctccgggctggagcctcccctcctccatcccctgcggaggcccgggggctggaggcggacgtctcgggagggctgacnnnnnnnnnnnnnnnnnnnncacccgtccgttctccatctttcccgccttcctcaaccctcgggtgaccttccttcttcatcctgcggagccccggggctgagcggagcgtctcgacagaggctggagcgggtggggaggcgcggggcgagccggggggttccagacgcgcctccaccgccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagtaagtggccaggcgcggggggatggaggctgggtggcccggagacctgggagtagccttgcgggtccggagcgctgggaccagcagacccctgcgcctcccgcaactccgcggggcctgcagcaccccgccgtccccagcctgggagcccgggctttgttcccacgttctgcgccctgggaggtggcagaggtcggggaaacccggcgcagccagaaaacagccggtccgctcactggctagccttcccttctcgccttctccttcctctgtttttctgcttttggcttctctttccgccgttctcggggcttatcctcctccgttttctcacggtccctcgtgtccgctccgcctctctctctgtctttctctctaccgcccgctgcactcgccaacgccgagcatcccgagcgccctgcccgtgtggcctgggagcggcttcctgggaccaggctcggtgcctgccacactggtggggtaggacataaaatgcccgcggcagactgtggtagccttggctaggggatggctcgctgggtatctgcagccacacacttcggatccccgagctggcaggagccctactgaaggccaagtcaaacgcacccatttcacagatggggaaaccgaggcccacaaaagggaaaggacttgcccaaggccacgccacgggttgaggtccgcggtggcactggaaaccagggctctctttccacgccaacccgacggccgccttctttggtcctcagtttccccttctgtgaagcgaaggggtctgactcgatgtttccagctaagatgccgggtgatgtccgtgtttctcaggactagtttcccagacaccaatcccctccccggctccatccctcgggggctataagcagatttcgcggaaggcttggtcccggggggcggtgcccgggttctctcattatgaccggagaaggcttagccctggctccaccgctgcagacgggctgggctgactccagactgctgcttgggggaccaacagtcagcgttttcaaatagagcgagcaccggcggagcgagggtgggctggctggacccccgggccgcctcaaacccagaggctgagagctcttccgacagttcggaacttccaggggccgaggtcgggcggtcctcccaaagggctcaaaggaaccgccctttgagctgttgttccgaaggggaaactgaggcacagaggaggttctagggtagcaccaggcctgtgtcagtgcttagtgcaggagaaaagcatgaagaaagacaaggaaagctagttactgctcctagcacaggcgccttctctgagttttgagtccttggagaacacttgctgtagaatatctgggaaataacgaaaagtgtaaaagaaaatgatctgcaacccccaaatccacagttgctgttgatattttgttttttttcccctccacattctttgtgtgttcctatggatatatattgataaaattggaaccatacccataagtacagtttcgtgtcttgcgtttttcacttcacaccatgagcgttttccacatcatcaaattctctgtaaaacatgattttaatgactctatacaaagttttcaaaagttaaaaacacgactcatacaaatgtggccaagatttattcaactcattaatgaggtagcaaacaggagagtaaagctgattcagggagcattagaaaggggtgatacaagcattggagaaagaatgttgaaatcatgtggcccagggcagatgcagaaatggtggatgccccatgaagcaaaccataattcttggttatctttcttttttaatttccttccttcattccttcttttctttctttttttttttttcagagtctctatctgttgcccaggctggcatgcagtggcacgatctgggctcactgcagtctctgcttcctgggttcaagctattctcctgcctcagcctcctgagtagctgggcttattggcatgtgccaccacacccggctagtttttgtatttttagtagagacggggtttcaccatgttggccaggctagtctcaaattcctgacctcaggtgatccgcccgcctcggcctcctaaagtgctaggattacaggcgtgagccattgtgcctggccaggttatctttttactatgctgaaatcacttacatctctgtcagacagaattctatagatatatatagattatataacttcacagagtgtagcttttaatcaatggtaaataaaaagtcaatggtacattcccctagataatgcagtaatccatgggtgagtctgttaaacaatgctctgatacaacattgagaagacatcttgcttgctcttgccttatttccaagttttggagaccttttcttaacatgtactatgttcctcttttggtgagattttagattgctttcactatttttttacaatcgtagatatcatttaattccattaaatgctccattaaatattatagaattcctttttgtttaaaataatatagacttatcagagccaccagggcaagagcgatgcttgtcttttttttatttctgagatggagtcttgctctgtcactcaggctggagtgcactggcgcaatcttggcctcccagattcaagggattctcgtgcctcagcctcctgagtagctgggattacaggcatgcgccaccacacccagctaattttcatatttttagtagagacagggtttcaccttgttggccaggctagtctcaaactcctgacttcaggtgatccgcccacctcggacctccaaagtgctgagattacaggttgtgagccaccgttcctgtcctgcagtatgcttgtcttgttcctccatgaatattaagcacctattcatagcatagtacttggcacatagttaagtactcagaaaatatttgataaatatatgaatgcattgtttctaatatttgcctgtctgatgaattggtgttggtccaataagattatttttaaaatctatgttgactgcaagtgcattatatcggtattctgaagagaatgttaataattactcataatcaccactctaacagaacaactatggccatctttttatcattcatattctgtatgattgatgtagttagtttagacagaatagattttggagtcctcagccccattcccaggaacactacggagaccagtctgtttaggtgtcgggaaattaccattttgttaagatagtctgccgccagtatttgagttctgcagcgccctgaacaaatctctcctatagtttaaattctctttcttgcaaaacaggactcctcccagtctctagtaaaaatacaaaaaaattagccgggtgtggtggcgggtgcctgtagtcccagctactcgggaggctgaggcaggagaatggcatgaacccggaaggcggagcttgcagtgagccgagatcacaccactgcactccagcctgggcgacaaagcgagactccgtctcaaaagaaaaaaaaaacaggactcctacttcctacttcccagggttgccttgagcatgaaggagaactggtttgggagagtgatttgggaagtagaaagtggaatacaaatgtaaacttgccattaggaagctccaattaatgtaacttgatgcagtgatgctctgcggagtaggaggcaatttcatattgactcttcacaataaagctgtgagatgggcaggtagcatctttgtcttcattttacaggcaagaaaactaaagctccatgggagcagtattcatgggcttgacctccagaatatgcccagaatcccaccgcttcattcctctccactgatgtcattctaatctgagccaccatcatctctcaccagggctccagcatatctctagcctggccttcctgcttctgctctcactctcgccgctctgcctcaccccacccccattctccaccacgcaggcagagtgatcttttttaaacttaacacagatcatattgctctgtatttaaaacacccagtgccttccaagtctatttataagaaaatccagacactctccgtggtctctgcattatcagacccatggctgtcttgctgaccacatctcataccaacttcctctttcatttactagctacccctaccttatgcttgttccttcaacaggccaagttcacttctgctcaggcagggccattgcacttgctgtttcctctacctggggcactcttcccccacgtttttgcatggctgccttctggctcctcaggactcaaatgccatctatgctgatcatcctgtttcaaataggcacctcctgatagatgtctctttactccatgaccccaacttattttattcagggtacttagcaccatgtgagaacatttgttcattgtctgtctcccacctttacaagtacagagaccttatatgtcctatttaccacaatatcaccgacacctagagtgcctagttcctaggaagtgccaagagcctgaaatccagcaagtcttctaatgacccagtgcaggggcagctcacagaaagtgcatgtgtggcttagctggggtatagaggtctgggattccaatggttttgcatcttgtattggcaggaggaagtgaggaaggcagccccaagctgcagcatgaacttatcatacctcagtggaagacttcagaaagccccgtgagagaaaaggtaagactcaaaagacctcatttacactggcaggagttgacaactgaggtttgggctacctactcaactttcttagaatcccagtcatcaccattagttctgtttctggcccactctgtcctctgggtgcccattttggagatcacagatgggactttccttccttgtatgacaaacttctagaacacttcccaatgctattagttgaggaaatgaaaattcacattaatgctgacacaagctaagtgcagatgtgttggtgtcacagaaatcacttagtcttgattggaattcattaaatattgtcattgttatttttgctctgcataatacatacttcattttcttgaaggaataatgtacttggagagaaaaaagataataatataaactataaactattttaataagacgcagcgtagagacctagtactggggaatgtatcttaaaatccagtaggctcccctggccagaacaccaggaaaacacataggctttatcaaagagattgggaagaaaacaaaaaacactgtcctgttcttgcagagaggacctgagcatttaggatattctttgtggttctggtttttttttttgtttttttgtttttgtttttttgtttgtttgtttgttttgacagagtctcactctgtcgcacaggctggagtgcagtgacatgatctcggctcactgtgagctccgcctggcaggttcaagcgattctcatgccttagcttccggagtagctgagattacatgtgtgtgctgcgaagccaggctaatttttgtatttttagtagagatgggttttcaccatgttgtccagggtggtctcgaactcctgacctcaagtgatccgcccacgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatataggagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaaaaaaaaaaaaaaagaaaattagctagacctaggggtgtgtgtctgtagtcccagctactctgaaggctgaggtgggacgatcgcctgagcccaggagtttgaggttatagtaagatatagtcgcatcagcatcactgtcctccagtctgagtgacaatgcaagaccttgtctcaaaaaaaaaaaaaaaaaaaaatcaggacaaataaaagcaagtaacattttgtcctaaaggcagtaaacgcatggaattcatttcatcaaaaagtaggagaggctgaaaatagcttcaggaaaagtctcgacaaattaatggatggtcatcctagagcagattacttttaacaattaagatcttgggtattgcaacctattcataccccctgaggaatggacctgctactttttatagaggcttctttgttctctccagatgtggatgccgggcatcctcaggaagggcctgagaacaaagcagaggaccagatcctgtctttgttcccaaccattgtctgcccagcatatgggtcattgtattctgtaggaatagtcagcatagtgcctggcaccgtaactatttgttcaatgaacaaatgaatgaatgttgaagagagagagactagaggctggatttcacttgggcctctcattctcatttatataattaattcactcattaaacatttttttcttctctttttctcatcactgacttaaagctcacattcattaaacattaactgaatacttatactgtatactaaatattatactagatcttagggggaatgcaaatataggacagatttccaataccctatggagctaaagatctatttaatctagactgaaggggaaagaatttttaacccatccctaggagaggtataaatagtgggtcagcttactgtacttcataggagaggagagctgatggtgcctcttcttaatacagagtggagtttcatcagaaaagctcatcagtagagccggacagaaaagcttcatagatccttaaaatgcagtttcattgttttgcttgaaatgccccatagaaaatccttttttaaatatcagtgcctgagcaccttccagaatagagagaattatttttggatcacccacataaaaataaagattactactcctggcggggcatggtggctcacgccctgtaatcccagcaccttgagaggccgagatgggtggatcacctgaggtcaggagttcaagaccagcctggccaacatggagaaaccctgtctactaaaattacaaagattagccaggcgcagtggtgcacacctgtaatcccagctacttgggaggctgagcatgagaatggcttgaaccctggagatggagtttgcagtgagccaagattgggtcactgcactgcagcctgggtgacagagcgagactctgtttaaaaaaaaaaaaaagattactattcctgctgcagcttgtgtctctttgggggaggggaagatagtgctttgatttggggcagtattcattttctgtgggggcagtcacatggttacctacctcttggatgagggaattgctgtagctctgttgctgtgtcgtctttctttctttcttttttattttttttttttgtttagacggagtttcgctcttgttgcctaggctggagtgcaatggcgtgatctcagcttaccgcaacctctgcctcctgggttcaagcgattcttctgcctcagcctcccaagtagctgggattacaggcatgcgccaccatgcctggctaattttgtatttttagtagagatggggtttctccatgttggtcaggctggtctggaactcctgatctccagggatccgcccaccttggcctcccaaagtgttgggattacaggcgtgagccaccgtgcccggtctgtgtggtctttcttaaatgcccacttggagctggggtccctgatgctcagtgtgattgggcagggcactgcctcaaaaactccataaagtggcaaaggatctgcaaccagaataggtgttggcagagctgaatcagggcatgacaaacagagaagtgaatctcttagtgaaagttattggtcaaacatctccccagcttcctacttcggtgggtttgaaatgttccttcttgagatgaagtaatacgattaattaggcaatggccagcgttgcccaagagcctttgatcggaatgttgagatctcatcagagcccttggtgacctcaaagtctcagaaatgcccaaatcctaatgcagagtggggtttgcagcgaggaaggggaatgtgcttagacgaggtaggcttctaaccagaggtggcagaacaggtgacctactttctcagacatgcaagaagtaagctttgaggtcaaccttagaagggctagaagctctactctagcaatgattttgtggattgaaagggacttcaagaatttatctgctggatgaggtggctcacatttgtaataccaacactttgggaggctgagttgggaggatcacatgagcccaggagttcaagatcagctttggaaacatggtaataccccagtatctacaaaaaatttaaaaatactagcccagtgtggtggcatgcacctgtggtcccagctactcagtatgcttgagcctgggaggttgaggctgcagtgagccgtgattgtgccactgcactccagcctgcacaacaaagcaagaccccgtctcaaaaaaagttgtcagttccttagtcccaaaatagagagcttatgtttaaaacactccaaagaatctgttctgttttaaatatgtaaatatccttttttaaaaaaataatttatttcttcgaaaaaagttcagtagccttaagttgaattgttgaagcgtggagatttattatgacttggtttttaaatttctttgaaattctccacaataataaagtaaaaagagattaataaaaagttcttttcttaaactgtgaaagcaattgtaaacatgtggaaagatgtgcaaaagaaaacaaaattaactcatgatcccattaactatggtaatggttaggcttatttctctctacatttttccctttgcgaagtgtatttaaataaaatattcagtattgtattttgagctttatgactaatgattattgtgtacattttgtcagtaatttaacaactacttaaagttgctgcttttaatgatcattcagtgttctgtcatatgaatggatcatcatttatttaaccattctctaacaggttatatttaggacagttaggttacatttcattattcattactttttttttttttttttgagacagagtctcgctctgtcgctcaggctggagtgcagtggcatgctctcggctcactgcaacctccgcctcccaggttcaagcgattctcctgcctcagcctcctgaatagctagaactataggtgtgcaccaccacgcccagctaatttttatatttttagtagagacggggtttcaccatgttggtcaggctggttttgaactcctgacctcaagtggtccacccgtctcggcctcccaaagtgctgggattacaggcatgagccactgcgcctggcccattattcattattataagtaataaatgtccttatgtgcaaacctttgcctgtgcctccatttattcctttcaaacagcctcacattcctgagtctaaacatttttttttttttttgagagagagtgtctcgctctgtcacccaggctggagtgcagtggcgcaatctcagctcactgcaaccttcgcctcccaggttcaagcaattctcctgcctcagcctcccgagtagctaggatcacaggtgcccaccaccatgcctggctaatttttgtatttttggtagagacggggtttcaccgtgttggccaggctggtctcaaactcctgatctgcctgcctcggcctcccaaagtgctgggattacaggcgtgagccactgtgcccggccgagtctaaacatttttaaactctcagtgcatactgtcatgttatctttcagagagttgccgtcagtttaaattctcagtggtagggattgcgagtgcccagtttacagtgggcattgtgcattgtgatttagagttttagataacctctggcactttgatttttttcaaggtatcttattatttttaatttgtttttctggacgtggggaggtggtttattagcgatgtcgaacatagtttttgtgcttatcaaccactggtatatgttaagtgatccgttctggatatgtagcacctgtggccactaccaaactgcttatgtgtaaaatgtatctactttttggcctataaaaccttaatttgaggatctcttagttgcttcctctgagatgattggggttttccaaacggagagccaaaatgaaataagaacccactacgaagaggatcccctagtattttacaagataataggcaatatgtatcatggcttgccgtgtgccaggcactgtgatacattatttatgctcattatctcactcaatccttacaagatccccatcaaattgactattactatctctgtatcatacatgaagaaactgagatgtggggaggctcagcaacatgtccgacttcacacagctgcaggtgtcagagccggtgcttgaatccagatctgactctgcaggacatttactgctggagattgtgttttccagtgtttcccttcaccgcaccacatacatacacttacaccacattgcagcctggagtttcttctctatgcctttcaggagaaagcagatgggggaaggatttgggtcattctgggattgaggtcattttacatgtgggctggaaatgcaattgacctttgctcattcacttcctgtggatcaatgttggagcgctgtgctagatcctgtgcccgacccagggagcctggtgccggcttttaggaactgacattgttttgttgttgcttttagcatccactcaaagctgagctcagggtaatggctgaggggcgagaactgatcctggacctggagaagaatgagtaagtggactcctcctttgtctaaaatgaaacaaataacttctgtgtcaacgccggacgcaggtgtcgctgttctggaaggaagcagtcaatggagtgaccccaagctctcagtccttggtttctttcaggcagcatcttgcaaagccagagcctttccacagcctcttgactcgatgtgagattgctggactgctaaatgtgttgctaaaatttccttaggcagtatttcaggggcccctggagttcactgcgggcacacagaggtctgtgtatgtgtgagattaagggagtggatggaccagaggtctttggcagctgccttactagcgccagcctagtgtgtggcaggaaatgaaggagattagaggaaaacagcagagaggagcgagcaaagcagggtgtgctggggcttggagcctcagactcagattgttccatgtgttctggttcagccgcatctgagattttgtcaacagggcatcgtcaacagtctcctggctacatcgggcccggctcttccatcttcttaacctcattcatcttgggtggtagcctggctcagaggcacttgcacattgatttgccatcagatgcagtcatatctggattcatgtaatggaggaggtgaatgggcacgatgcatggctatgtctgtggctcattctttggccattccccatctacttagccatgaagagctctccttacttggccgggggactctgaaaacatttggtgtttccccactgaccgtcccacttttcgttctgccacacagacgtcgcagataaggctgcgtggcttggagagctgcctgtctcctcttggcagcctccagaaccccctggaagccaatgagtaatcaaatgcatcactgccaagaaaaggatgaagaaggaccttcctgtatacaaaaggatgggaatagcttttaggcttgggtggaaagggagaatataatttattccaaatttgggctttttgggcacttgcaaaggaggatgagtgctgtcccgagtgtggttaaaatacaactcacagcttgtgcagtggtggggcttcatccacatccttcctctgcctccaggacatggtggcctcgggaagccagaaagatggggatcacagtcatttttgttcctctcctcttgagagtaaagccagtttaggctgtgtttcttctctcctgtgtccctggaatagacctggccagctgcgtccctagacagtgcagcgtctattggccctggatttttccttgcattgtcttcctttggtcctacaagaaaaggcccttagagggtttgttcttgaccgtgtctctcgggggcctgcctttgttgctcacggcagctttgttcccattaactctagtctaagtgttccctgttgttgcctgtgtctaatctctcctgttctgcccccagtagagcctgtggcccttcagctccctctggtcagcccaagtgatagtgttggtgttgtgggaaaatgcttaggagttggactggccaagcaggagtcccaggactcaagtctctatccttccctcctattttgaaacatttgctacagaccataggaagctaaagcaggaagatgccttagaaaacactgaatggaatgatcttagaaaactctgaaattatggatgcagaagttttgattcagagagggataggcatttgtctgaggccacccagcaagtaaatgaaagagctgaaactaggatcatgtgtattcttggtgtgagtctggagttacagaatgtgacccagggcaaatggctgaatcttttggaacttcggtgtccttgtttataaaatgagggtaataaggccagcctcgtgggatggttgtgaggataaatgaggtgaagtgcaggaagtgcttgcacagcgcatggtgagtggccagccactgttgggatttttattgtcccacactgaggctccagaggagagcccggggctgtggttctagcatctgcttttccgagagcagctctcgtttcccattgagccgcatggggctggatgtggttcctggcctccttgaattggcagaaggcagcagagttggtaaaaatggaagcagcagagccaagcaatatgacctcaccaggtgtccctgggggacggcttcctgctattttcatccaaattgggctttttgttttgaacatgtgttagtgagcggaactccaactgcacacgacttcctagtgtgtttatttcccaaagccttctcattcatggtgcgtgcgagtccggattcaaaacagctttggagcgggggagatgattttctaatttttcaaatcactgtgttgaagtttctataatctcatgacatttgggggaaactaggccctgggccaagccatttctcagcctctggttcttaacctcctcgatcaacgtattcatttttttttttttttaatctacgtgcctctgtgacatttcaggcaccagtgcaggtactggggataaagctgtgaataaaacagtacagcctttatggagcttctattctagtgggaaacagtaagcagacaagtgagtgcaccgtccgtcaggtgatgggtgctgtgcaggagacagaggagcatagggagtggggccaggggagtgtggaggtagaatgggagctgctgtttctgaatggcagtcagggaaggcctttcaggtgaactgatacttgagtcaagacctgaaggaggtgatggagtgagccatatgggtagctgagagatgacaattccaaggagagggaacagccacgttccaaggccctaatagatgatgaaggtttccactctccctctgtacatttccccatacactggattctcaggtctcccaggagcggtgagcaagggcttctgggactctggggggagggagaggacattttaaatttctttttcatcatcctgccgtgtctggccttctcccatcaaatcaaagcccacgtattaatgcatggcccaaaatagcagtgagcaagcctttaatggaattcacacatggagagatcgccaagaatggtgaggatggaaaggcatggggcatgggccaggagaggagggggaacacagcaaagtgagcttcagctcaggcagcagacacactgaggtgtcctacaatagcgcggcagccggcagcctgtctctgctttgaagcaactcagcaactcacggatgacatccgtgagaagcacacattcttttctctattgagtgcaggtgaaaaacagtgaccctttagggataatctgagcattgcttttgtgtcggttattcctgtgttcagatcctggctctgccacttactaccttgtagcctctttaagcctcagtttgtgcatctggggtgtaattatagtcccatgtcatagagccagagccacagggaggatgaaatgagatggtacaggtgaaggacttagcagagtgccttgtttgtattccaagctcaaggtagctatgattatttcttgctcattgtttttaaattgcaaaagcaaagcatgctcattgtaaaacatgtagcaattccaaataaacaaaagaatgaaagtttccctcccacgaggaaaatccactgctgtttggtgagcaaaccctggaccttttctatgcatacaagaacatgcacatgaatcctcacagacacaatcacatacagacacagtcacacagaagctgctatttttgttggggagggaggagcagaaatgagattatgtcagacatattgctccagcatttccttttttgaactcaactggatgtcatgaagacagtcttctgctctaataaagtatatattacattgtttaatatttatacacacatgtaatcacataatttgcaaagattggtgcatagctgctgttggagaaacttgtgattgaggcagtgtggtacagtggacatagcattgacctcagagacagatgatatgaaattggtcaaaaagccagccagctcccctgagcctctgctttctcatctgtaaaatgcagattttggccccggataggctctgaaggctctttctgcactacctcttttttttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcactacctctttaaaggatgctctgtgagtagaaaaatgcaaaagaagtctctgcctcaggaaatttgctctacctgtggagacatcctgggaaatagtgggcagtgggataaaggaaaaaggtgccccaaatcacgggaccttgaagttggggacgaacttctaggtcagaacccgcaggttcaggcaacagaaaatacaagaagggaaactacagagcagaaattatagactgctgtttgcacaacccacagatttgagcattaatccatattttttctctatgttcttttccccatgtcctgagactacctcaccaacccaggaacccatatttgacaaaaacttgtttgctgaaatcaaatggaatcctccttagttagctgcaggcatccagggagatgaacagggttatgtgagccccagcgccatatcctgtcctttcttggctttttcccaaaaggagggcacactgaattgctcaaccagattcctggatgctcactgggccgcattactagtgagcaggatcactctattacaagatcaccttcaaaagcaaatgaatggctcaactagtaggcactttgcccagaggctctttggccatatgcttctgtcttctagtatcttaaacacattctaggactctcatttcttcaatacactgtccttcctcaagtccaaatgatgatggcttgagaaagggagagacgtcctttggtctaaccccatccatttgtgctccagcccagttagctaaagagagatcttatttgctcaagtttagttaataagaacgggcgtttgttttcttttgtgagtatgtctacctccaaaccacctggggaacagcaattgtcaaggcagaatttgggcatttagaggtttactgattttaatacctatcattacttccaactttaatctttcttcctatccctaacttcttatcagtccttcagtgatatcatagggaaggagaaggctttcattgtcctggaaatcaagctacaatctggaaaattaacattcagtgctaatggagtaatctagctccctaacattctcgtttttcctcaagtccattatacaatttggattgcataatactggtggaattgaggaagggcagaattagcaggcaggaaaggaatttttcagcaacacacggggcagattagttgccatctcttattcctgcacttctttttcaaggatacctggtagaaatagtagcagacccaaagcaaaactatgaataccacttaggcagtggagctctccccacctccaccctcccagcttcctcccaggtcaagagtagactttaacatcttacctaggataaaggacagctctctttgaccctctcttgtcaggagcttcatttgttgttggcaaaattcaatttcctggatcaaagagcagcttagaaaggcttagatggtatcccaatgctcttagtaaaccatgcttcactgagttgcatttaaatgagtcatagacatatggattacattgcacttaaaatacacatggctcaagaaattaaaggatatcattctttaaccaagtatttggcagatctaaagtattcaaaatgtttttccaaactctactcgcagctgggctccccattccccatggctaaggttgtataacccggggagacaggtgctgaggaaacagttggatgaatgggtggggacaccagaatttgatgagagctgcctgtggtgtctgaaattttcttcacatgttctttggaagtatgaagaactggtttaaccctgctgtgttgacgctgaaggcagtgaatgcatgagtggatttaaattccaagtgctttgctaggcacgtcattccagagagacctggtagtcctgtttgagatgtagtttctaattgtagctttgtagactgagaatgatttcatttgcatttcccatgttgtcccaaatgcctggagttgcagaacaaatggattgccagccagtctgatgtgattttttataagccaaactctcaaccccaccccagcataagcagggtctccatttgcaatgtactgaatgtttatgtctcccttcaaattcttatgttgaagtcctagtccccaaggtgatggtattaggaggtggggccttttggatatgattcgtttatgagggctctgctctcatgaataggattagtgccctgatagaagagacccgagagaattagctcaccttttccaccaggtgaagacacagctagcagctaccatctatgaaccggagagagggccctcactagacacgaaatctgctgatcccttgatcttggacttctcagactctagaaccgtgagaagtaaatttgttgcttatttgctacccaggttatgctgttttgttatagcagccagaatggactaagatgccattatttctaaaatattggacacatgatatcactttcttagggtccattgcttaagctcagactcagtaataagcctggtgatctgaagggatgcagcttcatgatacgcttgtctaaggtatcagagagcatccaaaattgaaatagcctagatgtgttgattctgaaagccttgtgcacacaagccttaaacatcctaatccatagagtagaacagatttggactttggtcccagagaccctgattcaattccagatactgacacttccggttgggtggtctttggtaagtcacttgccttctaagttttacttcttcatctgtattcatagtaatactacttggccaggtgcagtggcgcatgcctgtaatcctagcactttgggaggctgagccgggtggatcacgcgagcccaggagttcgagaccagcctgggcaatgtggcaaaaccctgtctctaccaaaaccaaccaaccaaacaaacaaaaaacccccacaaaaattagccaggcatggtggcacatgcctgtagtcccagctactcaggaagctttagtgggaggatcttttgagcccaggaggtgaaggttgcaatgagctgagatcataccaccgcactctagcctggttgacagagccagatgctgtctcaaataatagtaataatactcactgctttgtgagcatttgctgagaatggatacttcggaaaaggcacttcacacaatgtcttattgaatcctcatggcaaccctttgaatgagatattgttgtctgcattttataatgaaactcaagcatgaggagtttaaataatttacccagtattgggcatagccaggagtcaaactctggcctgcctgcctcttactacattatagcacttgcatagaaaatagagacattgataccttcattgcagggtgtggaaggctgaaaaatgcaccctctcccctccaatgataaccacattcgaatccctggaacatgtggcagaatctttgcagatgtgattaagttaaagatcttgaggccgggcatggtggctcacgcctgtaatcccagcactttgggaggccaaggcaggtgaatcacctgaggtcaggagttcgagaccagcctgactaacatggtgaaacctggtctctactaaaaatacaaaaattagctgggcatggtggtgcgcccctgtagtcccagctactcgggaggttgaggcagaagaattgcttgaacccgggaggcagaggttgcagtgagccgagattgtgccactgcactccagcctgggcaatagagtgagaccccatctcaaaaaaaaaaaaaaaaaaaaaaaaagaaaaagaaaaaaaaacaggttataaaaaccttgctgataaaacaggttgcagtaaagaagagtcacttgagcctgggaggcagaggttgcagtgagctgaggtcacaccactgcactccagcctcagcgacagagcgagactccgtctcaaacaacagcaacaacaacaacaacaaaatcaaagatcttgagatgagaagattatcttggattacctggatgggccctaaatacaatggcaaatatatttataagagggaggcagaaggagatttgactatagacagaacaggagacagtgatgtgatcacagaggcagagattagagtggtgcagccatgagccaaggagaagctggaagaggcaaggaacagattctcccagagggcacgcagccctgctgaccccttgattttggcccaataataccgatttcattcttctgacctctcaagctgtgtgaaaacaactttctgttgtttgaagccaccaattttgtgacaatttattacacactagccccaggaaacacacacacagggtttgtgaggttaggagataatgtatgacaatgcacttagtacaacgtctggcacatagcaagcaggttttcaatacatgctaatttgtactaatgcaacgtccagaacaaatgttttcaggtgttttggggatgcaagctgtgacatgtggcccttgcagctttcttcaagcatgaaaatgacaagagaaaaaaacatattgagcaataatctgtgtggttattgcttatctacattacccaagttccgggtcatgttctctgatgctctgtctgcccttagggaacttctggctgaggataactaggaatgattgtcacatattaacaaatggtgatagctaaaaagtaggagatgcctgtataacaggcatcgtactgtggtatttatatgggtcatctacttcacttgtcacaaccaaccaatgaagagtagattcctatattagccctatttggcagatggggaccctgaggtgtggagcagtgtgacttgctaaaagtcatgtgggtgggaagagcagggccaggatgtgaaactagatctgtttgactcccaagtccaggcttttaactggggcagtatattgcctctcagatgcatagtcctggctcattatgctttgggctcttttttggttagcactggcatttcttcttcattgttctactctcccccttccctttcctcctacctttcccaggccctggttagaatttgcatgtcagtgtaatgtgatagtgtaatccaggcaggtgtgcatcccaagcttggctccttgcactacctggaggtgtaagctttggcaagtcgctcaacctttgagagtctcagttttctcatctacgtgatggggataataacctcataggatgtgtgtggaattcaataacgtaatgctcttaaaggatttacagggtgcctggtgcactatgagagcacaataaatagacactgttatttgtgttttgcagggtcagaaaagcatttaagaatgaagtcagagggaattcccctgagttggtttccaaatgtaattaagaagagttgaccttaaaacccattgcccctgggaggaaattacttctgctctccagcgatgcccagtttgacctaattgtatctcgaaaacactgctttgcagtgttctccagtgggccaaactgtacctcttttctgtgcctgcagaatcagatgaggccctgaactgtccaatatgaggttgggatttgttcactggttccggctctccttccagggatccgcagccagggctgcctgtgcagccaggaaggatgtccacggttttcttttgtctcaagcttatttctcctggctgctcttcagcaggagcacggggtaaaatgaatgggaggaagctgtcaactgccctgttggccttagatggacccttatccgaactaagggaagctgtggacttggaagaagtcaggatgcttgggtttggggacccctttatcatcaggctgcttaccttcagataacaacaatagctggcattgagggagtgagcatttaccatgaacttaatattttatgtagattttaaaaatccctatgtatatttatatacaaatgaggtcatagtgtattcttggttttgtaacctattttttttcacttggaaatatagcatgggcatttaaaaacatttaaaagattttacatggaactttttggaatgtttgacatttttcataataaaacttcagagaaaaattaaacaagttatagagtttttaaatgcatggtatcgtactttatatactattttataattggcttttttattttttgtcttcagtgtctttccacatgagcacatttatagacctgtttcattctttttaatggtgacataggattccactgaatggatgaatcaaaatttattaatttccttattaactgacagttaggtttctgatttcttgttattacaaataatcctagcaataggattgtacataatctttaagcacatttgcaagtatttctgtagcactgatacctagatgtagagttacaggatcctatggagtacacaattaaaacgcttttaaattttgacaagttgtacctctcactccacaaatacctccccaaaggctgaatgtaccattttgcatttatacaacaacagatacctccccaaaggttgaatgtaccatttcacattatgagcatattataaatatgtctccatgtacctttatcatatttaaaaaaattaattagaagttctatttttacttactttttagcccatgaaacaaatctcagtaattttatcttttccttttttaatttttaatttttgtgagtacatacatagtaagtgtatatatttacggggtacaagagatattttgatacaaacatgcaatgtgaaataagcacatcatgaagaaaagggtatccattccatcaggcatttatccgttgcattgcaaacagtccaattatactctttattttaaaatgtatagttaaattattatagactgtagtcaccttgttgtgctatcaaataataggtcttattcattttttctattcttttttgtacccattaactatctgcatctccccactacacccttcccagcctctggtaaccatccttctactctttctgcccaggagttcaattattttgatttttagatcctacaaataagtgagaacatgggatgttgatctttctgtctgtacctggtttatttcacttaacataatgatctccagttccatccatgttgttgcaaatgactggagctcattcttttttatggcagaatagtactccattgtgtatatgtaccacattttctttatccattcatcccagatagagacttaggttgcttccaaatcttggctattgtaaactctgctgcaacaaacacaggagcacaggtatgtcttcagtatactgatttccttttttttttttttttttttttttgagtagagtcccgctctgtcacccaggctggaatgcaatggcacaatctcggctcactgcaacctccacctcccaggttcaagcaattctcctgtctcagcctcccgagtagctgggactacaggcacacaccaccatgcccggctaactttttgtatttttagtagagacggggtttcaccttgttgccctggctggtctcaaactcctgttgcccaggctgggcttgaactcctaagctcaggcaatccacccacctcagcctcccaaagtgctaggattacaggcatgagccaccgtgcctggcccactgatttcctttcttttgggtctatactcagcagtgggattgctggatcatatggtagcatgacatagtggttgtactaatttatgttcccaccagcaacgtacacaagggttcccttttccccacatcctcaccagcatttattattgcctatctttcaactgggtgagatgatatctcattgcggttttttttgttttgctttgttttgttttttgagacagagtcttgatctgtcccccaggctggagtgcagtggtgcgatcttggctcactgcaacctccgccttctgggttcaagcgattcttgagcctcagtctcttgagtatctgggactacaggtgcacgccaccacacctggttaatttttttgcattttgtatttttagtagagatgaagttttgccatgttgaccaggctagtctcaaactcctggtctcaagtgatccatcccaaagtgctgggattacaggcatgagtcaaggcacccagcttgttgtggtattgatttgcatttctctgaagatcagtgatgttgagcaccttttcatatgcttgtttgccatttttatgccttcttttgagaaatgtctattcaaagcttttgcccaacttttgattggattattagtttttttttttcttatagagttgtttgagctccttatatagtcttgttattaagcccttgtcagatgggtagtttacaaatattttctcccattgtttgggttgtctcttcactttgttgattgtatcctttgctgttcagaagctttttaacttgttgtgatcccatttgtccattttttctttggttgcctgtgcttgtggggtattgctcaagaaattttgcccagaccaatgtcctggagattttccccaatgttttcttgttgcagttaaatggtttgaggtcttagtttttttggtcttttttttttttttttttttggggttggggggacagaatcatgctctgttgcttaggctggagtgcaatggcgcaatctcagctcattgcagccactgccttcttggttcaattgattctcctgtttcagcctcccgagtagctgagattacaggcgtgcaccaccacgccagctaattattttctttttagtagagacaggatttcaccatgttggccaggctggtctgcaactcctgacctcaggtgattcgcctgcctcggcttcccaaagtgctgggattacaggcatgaaccactgtgcctggcctgaggtcttagatttaagtctttaatccgttttgatttgatttttgtatacaatgagagataggggcctagttttattcttctgcatatggttttcccaccatttattgaagagactatcatatcattttcgtggctgtgtgatattatagtctatgtgtatgcatgattaactcttacagcttcttatagtgaaaaattatcaaacgtgcagagtagagagaatgatggtatgaatcactgtatacccaactgagtcaaagcgaatttacatgtaacgtggatatataaaggcaagttgcccttggctcctctgcaagtttatatctcactgcccttgttgagagatcctgttttcccaaacacaccattgagttgattattgagcttgggcagactctttaaacccaagctctcttgtctttttttttttttttccaaacagctttactgagatacaactcacataccatatagttcactcatttaaagtatacaatttcatctgttttagtatatttacaaagtcatgcagccatcgccataatctgattttagaacattttcaccactccaaaaggaaaaaacatcagcagtgttatgagttgaatggtgtccccccaaactcatatgttgaagtccttatccccagtacctcaaagtgaccttatttggaaattgagttgtggatgtatttagttaagatgagatcatactggagtatggcaggtctctaatccagcatgagtggtgtccttttagaagggggaggtttggaaacagacacacactctgggagaatgccatgtgaagattagagttatgccaccacaggcgaaggaactcagaagccaggagagaggcctgggataagccctttccttgcacctgcagagagaggatgatagcttgatcttggacttttagcctcaagaactgtgtgacataaacttccgatttttaagccacttggtttgtgatactttgttacggtagtcctagaaaaggagcacagtcattcttcattctcccccaccccacgtcagtcctatgaagctggcaatctgatgtctccagatttacttattctggatgtttcatgtaaatgggattatacaatatgtggtctttttgactggctactttcacttcgggtaaagtttttgaggtttattcgtgttgtagtatgtatcagtattcttattgctatatggtattacattatatagatataccacattttgttaacccattcattagttgatagatctgccttttaagctcgagctaatttttctccattctacaagtttgatttcaggggatactgattgagcacctctatgtagaatcctgtgctaggtgctgtagagactaggcatgaaaacaggatattcttaccttctggcagtttagactctgtgggagagaaaacagcatgcaaacagcataatccaaaacagattacaaatttacatggtagaattgaaagtaaagaactgcgaaggcaagaggaacgggaatttgtgactggggaagaggggagccttccctaatgagggttacttgaaatattgtcttgcagaatgatgggaggcttttgatgagggagggagatgagatgaatggagaatgagaaaggaattcagactgagaaaacaatgtgtaaatgtttggtctggatcaaagggaacctaaaactgtagtgctactaatcttttaggaatttagtatccctaactagccaaatatttgaattcagaagagtgatatgttgaggttggggaacgggttgctttttcttccactggtgggctaccagaggatttgagtggcatagagctcaatattttaattctcccatttttgactttgagttgcattctcttgcctcaggcagacccatgtggtcagggaagtaggtgagctacttctaggaaacatacttgaagtgcacttaaaagctaggctgtatttctacaccttggaagagaagtagctttcctcccacccctccccactgaagaacaatttgggctgagccaagaggatggaggtgtacttggtggatggagcccatggattggaaggggctgagcacaaggcattgatggcttcttcacaacttctgtagatggggaagcctcctgagatgcaaggctggtgggcgggatgcagacggatttatggatatacatttggatttgggagaggctctttcggccttctcttttctcccagctccgaggatgtgattaaactcttcatctaggctctctggaaattggagggtgtttcctactctttaccctttgtggttgggcaatggagcatgactatcctggagaaaaatgagaggaggctgacaatgtggcccctggacagattctgtcctgaaaatgaaactacatttacatttcacccaggagatgtttttgattttgagcaattaagatttgctttttctttatttagaactcagtgacatacacagacctttggctgaccccttgaataaactaagtgaatagtcttctgggtactatggggcaagttgctaggtcttgcacaaactcaactggggcaggtattgagtcagagaatccctggcttttctggcaagtctcttcccagtgtactgggcttgagttctggactactcattgagaattcctaatttatgttattcctttcttctcttccttcattaaacaaatattgtgagtgccaactatgtggcaggcactgggataggtcctggttattcccgggagaatcaatggtgatcagaatagtctctgccatcatggggcttagaacgtagtagaggggacagataattaaacagttacagaacaatgtgggacctgctaggagggaggaagtagagggtactgtaggaacatggggaaggggaacttcctctggattgggggcacgggaagtctgataggaggaagtaaagaaaagggggagtgtgatggtggtggagagtgtggcagagttggctcatacaatagggagtatgtgccaggcagcacagatcacaggatcaaaggcccaaaggcaagaatgacattgaaaatgaaaagttctctatagttagaacagagagcaggaggaaggaaatgatgagagaagaaattggtgaggcaggcagaggtgagtccttaaagggccttgtaggcaccttaaagagtttgggcttttatctctagggcaatgggaagcggatgaagaatattttaaaagtcacatagtgacagcatccaaaacgcatttgagaaggactaatttagggaagaggtagctgatataaagagaagaggatagattccagagatatttatagggtggaatcatggaaactgggaaatgggttgcatgtgggctgagggagagggtggtttcaagggacagtccaaagtttctagcttgaataagtagcaggatagttgtcttaattcattttgcattggcaaaacagaatcctagagactgggtcacttataaagaaaagaaatctgtttctcacagttctgctggctggcaagtccaacatcaaggtatcagcgtctcatgagggccttcttgctatgctaccccatggtgaaagggagaagggcaagatagcacatgaaaaaaagagcaagagagcaaacttgcagcctcaagcccttttataacagcattaatccactcattatggtggagccctcatggcctaatcactcctcatgaggcctaccttccaacactgttgcattggggattaagtttccaacacaggcttttgcggggatacattcaaaccacagcaatggtggtgtctgtccctggagttttccttagcttgtggtgggaccttggacaagccacctctttccttggatctttaggtttctcattagataggtaattagactcaatggactaattagactaggtaataattcctagtcaccaccttggcaggatcatcatggggatgcaataataaaacctgtgtgaaaagcagtgtcctgtactctttccataacgctgacaggcccagcagaagcaaaatctgtgcctcccctggttttctctgttttctcctccttatctaaaattctaagcacttggtctcttaggaactggtgagacctctgcccattccagcagctgaggcttcattggggacctctctagggattctgaaaccggcttttgttgaaaacaatgatatcattgagtaggtggagctgggccggactttcctcagccggttgaaggagaaatggggtctttatgacttctgtacttgtggctcttttccagcctcttccatggctcccatgtgtctcacttcccccctttcctccttgcagaaaactggcagtctccacgttttctcctcttgcatcagtctccccggggagagggccagaagggccaaggagctataatggctgcattatatcaagcatggtttctttttccaaggccccccttctggagaagggaagggcaagtcatggaaagggactcctttggagggagactggagtgctggggaaaagagtgatctaagtgttggaaggaatgtcaggctctttgtattctagaagctctttatctcttgactcactgatgctagatttggggcttgggtaagaatgcaaaggtcaaactggcctctcagggatatggtgataggaatatgggtttggagaaggagggcagccatgttgagtgagtatccttaattcctgatccctagactggccttgctctctgctctcaacacgcacacatgcatgcacacacgtgtgcgtgcacatatacatcccttctccataactgtgtagacagctttttaggagaaactagaaattggttaccacactggtttgcagctgttccaggaaggaagatgagctgtgaaacagtgccttctggggaccagacagtgacacctgccctctgcatggtgtcagcatttgccaagcacttgggagctgcaggtgccaagccaggagaggggcaggaaacctaggcctgcctcactggctgctgaagccccatcccctagcatagtgcctgcacatcacggacctccatacatgtttgtggagggtgcaagtggacttgcaggtgcagggcctgcaaggcctgatgctcagaaaggtgctgcgtcttgatcaaggacccccagcaaatagtgacgaaatcaagctgtgagaaactctggcctcctgatgccaggtggcctgcagtttgtaccacattacactgcttaatatgcagttattcatgagattgcatgaagagcctttctctctgcctactgggtgtgtctggatggcccaactcttggcttgtctaccactgacatttagcttactctagtttattgaaatgatgggtttagaaacaaaaactgtgtgatgctgggcaagttgcttttgctttttttcagattcttcatctgtaaaagtggaggtcagggttgggcagagagggtggtatataaataatgtttcattgcggtagactctgtaacttacacactaaccctcgcttctcctaaacaatctttttggaaaggatatggggcaacgcatagaatgagggaaaagttgaaaaactaaggtttggaaaggttgagatcctagaatgaatagacggtcccttcatgtactatcatcttgaaattctgagatgagatctgactgtccaggcatatcatgaagcattcatttggccaggcaagggcagggatcttgaccaactccaggtgccctagtcagcaatgcaacgagaggggagtatttctttaaatgcaagttgggccactgtttatctcaagaaggtggcatggatgctgggcaggctctgacaataggtatccactatgatctatgagggctttccaagttctgacatccttgacttatgctttgggtgcggtctgtgtcttagtatgctaagaaacattgggcaagtttatgaaagttactgggatatttaatcagagcttaaaaagggctaagcacctacatttagcaggctggtttgtggtcctcacctacctgttttatgtttgtttgttagtttcagggagtggtccgcttattcccttttttctaagcatattctcacagctccagtgatctcagagggtccttctcttcatttcccctgtgtcttatccacaccgtttttctttatgatatggcagtttcctcataccctcttacattcgtctttcccttcaggttttctgtggtatcggctaatctgatcaacactgtggttatttaccaaaaactggttgctagagaagttgttcctactcaccattttcgcttttagatttttctcagaaattctaaaggtagcacctcatttccccgaactgttcttatctaattccaacaaatacacataatgggctattcgggacactggaaaacaaatttgtgaactcttcttgggtgagccattttgagggccccgcaggtccctgccagttaagttgtctgatctcaagaagtcagctctatttgtgcagagaggttacccatcttcacagaggcagccacgagggaggcctgaagaggattaagtaaagaccctgctggccaaaggagtcagtggtgctcatccaaacatcctttggtatataatgtaaaagcaaaacacaggaccagaaactggtcggaagggtgccaggtcttgtgcggactgggagaagatgtcgtgggaagtggttggtgaaagggagtgttgacttaacgcattgtttggaaacttccttaataggaagttaaagaaaacatactgagtagcattggccttttgccaggcttctggatggcgccatttttgccttcggagtgttgcttccaaagctggtcctctggcaacgatggtgcttattcaagggagtccctgggataggaggaggtcccaattttttactctaggagcaacctccaaagttcccccttccttcgcctttctgttccctcataaaggaatgtgtctgcttgcagccccctggactcatcagtcccttatttggctttagggccatgcctttggcacgttggtttgtttccattcctttggagtcagaggtggaatgagtactgatgtagaaatcttggttctgaagcagctctggctgtctcttccctgcttttctttcagcatcttagaaaacaaaacaatactcactgaatttattttgtcccaaatctagactagtgcaggccatgacattagaatagcactctgcttttcagagacactttccagtacctgtctgtcctgggcattgccatttctgcttgatagaaagggaaactgaggctgagtagtttgtgacttgcaccgtatcacctagccagttaaaaaatattgtcaaaatttacaaacccagaaggagagagactagtattataaacctcagatgcccattacctagatttaacaatgatcaagattttgccacgtgtatatatagctagtgctggagaaaatgatagcaatatttgtaaagcacaaatactttctactttacaaataattctttcacatttgttcatatgatcttcctatatgccaggcactattctaacatcttacaggggcactgtgaagtagattttgtcattctcctcattttatgatgagaaaccataggcacggagaagttactgaccagtctgaattcacacgacttataagagctaggatttgaatgtattttctcatttgatcctcagcatcgctgtgatactgatggtgattattagtctgttcattttgcagtctagaaaatggagggggtttatgtggctcacgtgaaaacaatttttatacaaatacatagtgagcacttctcgaagttttatttatctaattaatgggctaaccagcaagatgataaaactggtttaaaattggataagggaaactaagacgtatttgtgtgggggtgtgtgtgtatttaatagtgaaaaaaggaatgctgagataagattgctaaattagacacaaaactagttaatatcctaggggctgtaaaatcataacctttggggttatcttttctactagatggaaatatttgcatttctgttgtatcttattaagtttttacaagttaacatctgattttacagagtggaacaagggctgtcctaattaattgtaaatagtacatctttcaaagccacactcttcccataaagtccagagaaccgtagacaggcctctgagagtctaaggcttggctgtgctcccttagtgttttttaatttaatgttttgagacagaatctggctctgtcactcaggctggagtgcagtggtgcaatgtcagcttactgcagcttccgcctcccgagttcaagcgattctcctgcctcagcctcctgagtagctgggattacaggtgcgcgccaccacacctggctatttttttttgtagagacgggctttcgccctgttgtccaggctggtctggaactcctggcctcgtgtgatccacctgcctcggcctcccaaagtcctgggattagaggcgtgagccattgcacccagccctggctgtacgcttgtgtgacattgagaggaaccatagtcatcttttgcttcatttccaggctttggaagggcagttgcctagtgcagctgctgcttaaaccaaagcattccgactttccctctatgctgggttagcaccatctttagacttttggaaggtgattaggaggctagaaataaaaaaaagaattaaaaatgttaaaattgctcaaatggagtagaataattcccagaacccgaaaacataaatcacctgaaaaaaaaaaaactattaaaaatacagatttcttaatccttccctagaaaagggaggggattgtgtatttttgaacagtctttccaggtgttgtgcagttgttgggctaagtcgcatggtgagaacattattactaacataggcaggatgaagaccctccaggtgaaataagagagaccagaaaagtggacctcccaaggcatcatcagggtataaatgcctggagactcttggaagaattagatagagaaaggcccagagaaaggaggtgtcagcaaaacttgctactgagatgagcagagtgatgctcgcctatgctgagctcgtctgcagagggtgtttttcaaggtaaatgggaaattgttatcactttatcttcactggtttgcttatctgaagcaggaggaagaaggtttgagctcccagaagatgttttgcaaattcattttagtgtcactgctccttcctctctagagggtggtttagcctagagaggcatttgaaatttgtctgacgataaatagaacttaaaggaattgtcctgagtttgaagcttctgagccttaggaaagacgggtctgagctgttttcaggctgcagtgtactttcagggcctggctgcttgtacaggttccagttcttcttccctagagagtgacctaatgttttatgtccggtatttgggggtagcttattttcctaggtgggagtctgaagatgcaggttttgctcagggactttggaatctaaatgacccagattttgctcaactctagtgctggctattattatgatggtgccgagacatggcagagtgtcctactgatttctgcctgtccgtgggctcctgagcacagagcagacagagcagggggcagcagggtagaacagaaattgcttttcttttaaagctagaaaaaaggagtgggcggaatgggaaatcttgcacagtcctttctcttcctggatgcacatcactcacaagtcgtttcctgaaaatcctaatgcaatccaatggtgagagacggcttcctgccggtctgctgagccagcccctcgtcagggaggagatgagaacaagatgtggtcagagaatggggcagctgggctgggccgggctgctcagtgaccatgtgccctcctctctgtgggacagcagcgtcctttggttctgagagcagcacctggacacatgggcgtatgtggacctagcttgggggagctgcagagttgttcaaacagatggctggccctaaccctagagtttctgtctgattcatgagtctgggtggagcctggcaatttgcatttttaactagtttctagatgatgctgatattgctgcttcagaaagggtgattaggtggaaaatgaaagcggattgttttatgtagattcagaggccagaatgaaggcctgtgggtgccagtgacagaggtgtagtttttaatccggagtaaaacattaaactactgtatgtggtcagaaatggagtgggtagtctcaggagtagcctctccctggaggtgtccagtggtgaatagccatttggcagattcctacacgagataaaaggttcattcattcgtttgcgagtttattcactcattcacagaatgcacatgtactgcctgcttgctaggtgctgggggccggggagaagacttcaaagacacaaggtccctgtttttggggagctcacagtgtaattggggtttgactacatgatttctagggttcctttcagtgctgagggtcagagaggcctgtgatgatggggtaatgtcactgggtgaatgatttctccccccttgctaagtctcagaagaggctgagaatatttttaccaggagtgcattttctgtgggaaaattcacacttccccactggcacctggaatgaactattaaactctgaactcctgaccagctgtacatggcgcagtctgtgaaagcaaacccaggaaatgggctgcaggaatgagcacattgcgttttaccacctctcttaagtgatgtactggagagttcatggctggggaaagttagagagagaaactttctgggttcttctgtcataatccctgttgaaagcaataatgattatcactaacttttacccagctccactttgtgccaggcatggcattaagtctgctacatttattatgttgtttgatcctcatcacagccctatcaaatgagtatatcatcctcttttttgtgtaagaggaaacaaaggttcagagacatacatgtacttgttcacggccgtagaggcagtgaatgtcagagctggaatcaaaacttcagttttccagtctccagaccatgctctaagctgctagtacactgaactactcatccatccattcattcggtaactagttaagtggttttctcattgaacaaatgttaagcactgacataaaccagtgagcaaaactgcttggcctctgccctcatgaggcttacagcttttctccctcaggcaaatgggtgactcctccctcaaatcttggactagttagatgctaaggagaaagagaaaggactgggagacagattctggcaggttagccactgacccaaagtttccatgtgaatgagaatttctcttcacaaagctggggtttgtgctttgctttatttttacattttcctgttgggcttcttttcttcttgtccaaggcgagaagttgaaggccttgacatagtacaggagacaattcttgtggcatttgccttctgaccacacactggggatggagggaaatctgagcgatcccagaacttagagctggaagtgactctagaggaattctagagaccctctgcgatgaccctctcttgctgggaaatgtcacctctttcaaaacctgggttatccctgcagattcctttggctttctgtgctggcctcagcctacattttcttctttttaagagcagttttaaattaaaatttcagttttcaaaacacctctctgacagttaatttaaaagtcaaccaacttcagaaatatgcaacttatattgtaaacatcttctgcaacccctgagataatcaccatcaacaaagggcatttgtttctctctctctttttttttttttttttgagacagagtctcgctcttgtcacctaggctggagtgcaatgacgtgatctcggctcgctgcaacctccaccccccaggttcaagcagttctcctgcctcagcctcccagctaggcacctgctaccacacctggctaatttttgtaattttagtagagatggggtttcaccatgttaaccaggctggtcttgaactcctgacctcaggtgatctgcccacctcagtctcccaaagtgctgggattacaggtgtgagccaccacacctggctgaccttgactttctgtagatcaattctgcctttaatgtggctgaactattaatagttgaaacatccatttgactcttatatttttcttttaatttttagagaaaattctaagaacatttcttgaagttgcctggcctttggtgaggggattcttaacctgtacttcaaggggtctgtggtgagagaaaccaatgtccaagtttagaaaagaaaaaaaggaatttattggaagagtaacatagaattaccaggtctcaggaaatcggaaccactaagtgtccgaaagggcaggcaacggaagcttagggaacccttgtagcaggaacagaagaacagatgcattgcttccatctgttcagacctggcagtatctctccactggcttcgcttgaaatacaggtcaccccttggccagggccaagtaggacaccttgattgacaatctcaccaaaatatgcatcagggaagagttattcccttaaagaaaaattggtctgctgatactaaaaattggtagatccagtgctggaaaaatcaaccacggtacacaacagggttcataggccccgggaaattttgcatgtgtttgcatgtctgttttcccaggacccagacaaatattaagatcattgctttagttctgtcaattccatctagttggagtgatgttcccatagtgatgataaattatatttaatttacattaaatataaaattaataacaaacttatggttttcctttttgttccttagccccttgtggctgcctagtttcttttgtatggagatgcttgggatagtcctgcctggttcagttaaaatcactcgttgttgctaggagggtggagttcatccacttatgatataaatgtctctttttattttttgcaggcaactttttgctccttcctacacagaaacccattatacttcaagtggtaaccctcaaaccaccacacggaaattggaggtgagttcaggtcaacaaatgtctatccagcagctgtcctctcccagccctactcctaggacctcaggagatgcctgatggagttggtctctcctctgaagggagtgtttcccccaagcgaagaccaagggagcaaacgagaagcaaaacatgtatttgatgttcataggtgctcctcctcctttgctgactacaatggctaaagaaacatagactattttagggtaattgcatctaattacaattgatgcaaattactgtgaaatatacatgttctttgctttatgttaattacccacatgttaacaaaagttttagtaaaaggagtgacttactcataatcctgtcgtctcatccaattagatgtttgattagtcctttttaaatggatgtataacatttacagagttgtaatcactgtgcatatacattttgtagtctgctattttaatgtgatttttaagttatgaatattttattttgcttctatattcatattggacattttttccctcaaagttgtttttgagtagggatgtttacgcaatgtcaaagatctttcatttagaaaatggtctttcagatggttacatgtcagtttgctttgccacactccactggtagacatttaaagtagtgaatgatacacatttcatggtggctagctcttcttacagggatgcctattggaatttgtaggctcagaacgttgattctcaaccaggagaaccaatggcgttgccccgaccccgagggacacctggcaatgtttgcaggcaatttttattgccgtgactggcagggaggatctactggcatctacattctataatgcataggacagacccaccactcccccacaacagaattatccagctccaaatatccatagtgcccaagttgagaaaccctggattcgaatgaccattctcaaagtctgggctggtgagatgggggtgaagaagggaagacgcacactggcaggagcagcagtggcctttgcctttggggcaggacataatggactactgaggcacacagactgggagttgtggtgtggagaacagcaggagaggtccctctgcatcaggactccttcagcagcttctcatggaacctgagtgttctaccaggcccattctttaaaatatccctgctggagtgcaagtgtccagcaagataacactggccactatcagtcattaacagctcagattagttcgccagattacccctggatggggaaagggacacaggacaggtaattttgtgtgtgtgtgtgtgtgtgacagagtttcactctgtaacctaggctggagtgcagtggtgcgatcttggctcactgcaacctccgcctcttgggttcaggcaattctcctgtctcagcctccccagtaggtgggattacaggcatgcatcaccacacttggctaatttttgtatttttagtagagacagggtttcaccatgttggccaagctattctcgaactcctgacctcaggtgatctgcccaccttggcctcccaaagtgctgggattataggcatgatccactgcgcccggctaattttgtatttttagtagagatggggtttcaccatgttggccaagctggtctcgaacttctgacctaaggtgatccacccacctcagcctcccaaagcgctgagattacaggccactgtgcccggccacagtttttgatagatccaagagacgtggcgcatagtaactgggtagctcaggggctgtgttttgtggctgaatgtgaagaccagtgctgccttcttaaccaagactttcttggatggggaaggagttggtagtgtggccggtgcctgcagcaaagttggactgtgtcttctcatccccagggaggctgtccagttgtgacttcatattcttcaatgccccttggtcaaaacttttcctctcttcttgagacctctgttctctgcctccaggggcaggggtgggatgggggaacaggcatgcctagaaagctgttagccatgacagcctccttcaaacactctcctctgagtttggatcctgccacttctgtacccacagctcaagaatgggtctcagtccacgaatttgccatgagctcacgcttcctgctatgaaagcccccttggggtggccccatcaggctgagaagctgaggaatgcaatgacttcatgactgatccttgacttgttctttgtgctctctgcttgtgcattaggcagagatgttgtaagggcctttcagaaagagaggattggaaaagaactccccctctcccagaatcccctccttccagaaggtcttgttgactgaagcacatcctagctgaaccttgggatggacaactcattgtttgcttacatcccctgctactagactcttgcaaagctcccacccaggcccatggggttctcagtcagacttcccatttgggagctgagagctcaatgaaaaatgggaatggaataaactactcagctgcccttgacccgaatgttggagactgcactctactaccaaacttggcctggggtagctggagttctgggaaccttatcaagactcatcagtcaggcctttaggcgacagcctgcatctaggtcaggcggttgggggaatgggtctgtgaatgtgttccaacagaaaggatgacagggtttgcaatctgcagccagggttgttatcttggctttaactagttatatgaccttaaacaacccccttgaccacactagtgttgagttttctcatttgcaaattgcatatgctgatatctgactcgcagggctgtggaagggtaagatgaatcactaatttttatgggaattcataagcaactcttccaaccccacattttacagatgaggaaactgagaggagaaggggaaaagtaacttgcccaagttcagttaaccagtaagtggcaaggcttaggctagaacttgtctcctttgttgctagagaaggtggggataaaagagctctgacaagccaagttcctcctttgctactgctgggagaggcagaggatggagcttggggccaggctgctggggttccagtatccactttgctgtgtcaccttgtgaatgacttaaaacctctctttcaatttccccctttaaaacatggcaataataatatctgcctcataagattgtggtcagaatcacaaggaaaaatctgctaagttgttcagcaagcagtaagagctgggtagatgttagctcttttattttagacatagggcctcgctctgtcccccaggctggagtgcagtgacatgatcatagctcactgcagcctcaaactcctagcttcaagtgatcctcttgccttggcctcccaaagcattggtattataggcatgagccgccatgcctggttagatgttagctcttattgttttgtttgtttgtttgtttgttttgagacacagtctcactctgttgcccacactggagtgcagtagcgtaatcttgactcaatgcaacctctgcctcccggattcaagcagttctcatgcctcagccttccgagtatctgggattacaagtgcccgccatcacgcctggctaatttttgtatttttagtagaaatggagtttcaccatgttggctaaggtggtctcaaactcctggcctcaagtgatttgcctgcctcggcctcccaaagtgctggggttacaggtgtgagccaccccacccgacctcttactgttaataatagtaagttgtaggtgtcatcatcacaagagatagtgtatgtgaaagctctgtaaattataaagcatgctacagaagccaggtgctctattttcgagagaactagggctgtgaacactcttagcatccattcaaagataggaagaggtgcagggattcttcacagccatccctgggtttcagttctttcttttttctttttttggagacagagtctcgctcggtcaccaggctggagtgcagtggtgccatctcggctcactgcaacctccgcctcctgggttcaagcaattctcctccctcagtctccgagtagctgggacgacaggagtgcaccaccatgcccagctaattttttgtatatttagtaaagacagggtttcaccgtgttgttggccaggatggtctagatctcttgacctcatgattcgcccaccttgacctcccaaagtgctgggattacgggcatgagccaccgcgcctggcctcagttctttctgttaaccagcgttttgaaactgtagctgatacacgtttctgaactccttgattctctgtcattccaacttctctgagccccatttactccacacaggcccggcccctcttctccccatgagtaatcctgtgctacggggtttgtggctcccctgttgagttctaaggaccaggttcaggacttgagtgcttcatgaggggcctccaaatcccagatcccacgggtaggttgagaagccacatgacaggctggcatttgaaagcagttggaatcctggccaggaggagggttttgcctgccacgccttctttcataatcacagcacactggctttcctttgtgctcctctcaagggtggcatctgacttgtttaaagtccagaagagtttgatgcaaagacaggggttggctctgtccctcctcctgactatgagcttgaatgggcagaggagccacatcgctggccgatggatcatatgcagatgaaagggcacctgtggtctggagaacgaggccgtgttgagtgtcagcttggcctgtatcctttgatctggctgcatggctggctggatatgctggagcattggcacagctagggctttggattcagcctcttggtgggcttccaggcgccttgaggccatattctttgataaaggagaatttcatgattatttggttgccgatgtttatcgcctgccactctcggccaagtactctactagctcctttatgtacgatattctcaccaccactctggggtacagaggctaaagacactgaaggtcagagagagttgtggaactgcgtatgcttggatttaaatatgcctggctatgccaaaatgtttgaatttaattatttgtctatactcaggattagagctgggagggaggtggagccagagaatacagacacacggggtagctgattattgggtcacatccctgtctggtggggacaaagaagcaactgcaagcagcatggtcctagagatgggggaaaagagaaagcttccatgtctgcaactgtgtggtttgcatccatcccttttgagatctttccagaacttggctctaccctgtgggttttatcttctctctgttctgaccagtgcatctctcttgacttatttgggaggaagcctctaggaatgtgtctcttgttgttacccctgattcgttggacaccgtcctgatttcacccccttctgtctggtttagcactttagcatgcccaacagtgcgtatttgcttcctaaattctatggttacctgacttataaaatgctcggccagcacttgaaatggttatttcaagccccttcttttggtttgtaattatatctgtttggatttctcattaatgactgcctctcacaagaccataagccccacgaaggctgaagctgtgactccgtttgctggctatggtgtctccaggggctggcccctggcctggcacagagcggtggtcacagctgtttgtagtgatggagaaattctgacagccatgagacacagtggctggagagcagcagcagacctcacgggcacaggtaccaaatcaagtacaatccagatgtggagggatttgtgtgaaagagcatcttgagctgtggaagagtagggagtgtttgtttcctagggctactgtaacaaagcaccataaacttaaaggtttaaaacagtagaattttactttctcacagtcctggagtctagaagtccaaactcaagatgttgtcggggccatactccctccaagcctctggagagaatccttccaggctcttctagcttctggtggcttctggccatccttggtgttccttggcttgcaacttcatcactccagtctctgcccccatcttcaaatggccttcttctctttctgtgtgtgtgtctgtgtgtccttccctcttgttagaaggacacaaatcattggatttaggaccttctctaattcagcatgacaccatcttttttttttttttccttttccttgagacagaatctcactctgtcgcccaggctggagtgcaatggtgcgatcttggctcaccgcagcctccatctcctggactcaagcaattctcctgcctcggcctcccgagtagctgggattataggtgtgcaccaccacatccggctgatttttgtatttttagtagagacagggtttcaccatgttggccagggcggtctggaactcctgacctcaagtgatccatctgcctcagcctcccaaagtgctgggattacaggtgtgagccaccacgcctggcccagcatgacatcaccttaatttaactacatctgcaagaccctatttccaaataaatcacattctgaggtggacatgaattttagggggattctattcaactcattgcagggggttgcaaagataacattggtggggaggcaagttctttccatggcatgcttttggccacagaaaacactgattcctgaaagagccctgaactaggaaaattctggattttccaatcagcagggagaccttgggcaaatctctttgctcctttgagcctcagcttttcatctgcttcatggagataatgacatcttccctgccccgtctcctaggattattatgggaatcagatgaaatggtggcttggaaagctctttgcaggttgtaaggtgctataaggttgggtaggtatataataagccatgagtcatccatgaccatcctgagatattaacattgccatgcttatcagtgttctttagcctgaccacctcctttctccttgctaggatcactgcttttaccacggcacggtgagggagacagaactgtccagcgtcacgctcagcacttgccgaggaattaggtaagagaccctgaggctgcaggtggcaccgggcactctccccaggaatggaagtttcaagatagacaaggctaaggcaaggaccttgggaaggagtccattgagaatgtgtgcaagccagcccagagaggggctgagcctgggaggatgggcaagggaaagcctaggtaatccagaaatccattgggatttaactttcctgatgaacttgatgttttaaaatataggttttgttattatttaggtatggtaaggccaaaaaatcaggagatgactgccattgaaaagatggtcatactcacagaaaagggaggggcccggctgtgccatggggggcggcacggggaggcactggggttggtcagcgggcagagggagtctggagaaatgtcagcagacgcccttcttgtggtttctgcgggaaggaatgggcgaggcagagaaagcaggtttaggattggctagtttgcatcatttcagcaggctctggggtttatgggctctctgtccttagttgtcctatacctggttctggggtgattagggaagggggatagtggcccagagggtgagagtgcccataaaataaatggctagggtatggactctggattggttggcttgcatttgaaaggcaaggtagctgggaaattgttgaccatctctaggaattggctaatcctggaaggggcagtccctctatggtcagtaagacccagatgtcaaagaaacagaagataaaaaagaagacacatggttaatatgctcgggatggatgagtttgggcatttggttccacacctcctcagttcttctctgggagatgtacttggaggtggtgaaataggaaatggacggttaatgaacagagagtaggaagtgaaaggaaaggcaaggataattttcaagacagaaaatcaactgaaaagttctgaccagaatgtgcttttgagagtgacccttccttctctgagtgagactacctggctttgagctggtagcagtttaccagctgggtgaccttgggtcccagtggtctcatttgtaaaatgtggataaaaagaatatatgcctgcagttgtgaggattcagcttgtgaatagctatcttacctaggaacttgcagtggcacactgtcagcatgcagtgaactcctaggactttgcttctctaggtgtgttccatggatgggcagcatcaactttacctgggagcttgttcgaaatgcagcatctcaggttccacgcagacctactggattttaatctgcattttaccaagactcccaagtgatttgtgtgcccattacagtctgtacctgagaatgtgtgttccttgagaatatggagtatatctcaaatatctatttctctccaccagcctgccttaatgccttgcttgcagtaggatctacacatgtatgttgacataataagtcttatttatgtagaccactttcaatctccctcctctttttttttttttgaagaaggatgatgatctaaaaaacctggtatctcattgcatatactaattgcctgggttttgattgtctgtactatgtggtgcctctgtgcagtgatagacagtgagctacagtttcccagaatacacaggctcagtgagagacacttcagcccagtgtaaactggctctatgacaaaaaggaaaaagccctgatttgtagcatctgccaatatgctgacaaagataatcccaccatgatcaatttcaggctaccgatgtgatgttattgaaggcagaattgggaagatatgcctttgattggctctggtgagctgataggaggtggctccattgtgtgttcttcctctcttgactgattgcttcattcattcaatgattgcatttttcattcacaaatagaaattgggtgtcttcctaatgcccataccctacacaggtggagggaaaaccagcactgtaattttggagccctcagtttccttgtcaataaagtgaacatcagtattaagcatggtagagattattgctgtaattatagtacttttaaacataagggtttttcctcctcttacgtcggtgaaaccatgctaagacttatgcaggctcctatacaaatggaaggtttctcacactgcaggtcccaagtgtctgtttataaattgggccatgactttgtttgaatgctgcatggtgagttggctggaggaaatcaggcaggaaatgggctttggatgggaagcaataacagagtggccccaaatcccctctgcttaagtgacctgattgagccaagctaactggcctcgcagtggtatttacaagcccagccaccgccacctgcagtctgcaagtaaacaaagtttgtcccaagaaggaggaaaaagaacatgcaggtgtgacctgcttctgtctgcctcttcctccatcccctcagtctggagcagtgggaacttggcttggcgtcttgtaaatcattccagcagcagtgctgaaagggagggggataccgggtgagctgtccgtgtgtttctgttttgcatgcttccgtctggtgaggtccacctgccttactttcccagccttctcactacacacgccttaagaaaccaaggctgtgggtggactgatttaagagctggagactcatgccagatggttccatttgaaccctggagaaggagcagctgcaacagcagcaacattcaaacccatgtcgtcaaaacactaggcgcctcccaaagctcataaagcactgctgcagtgaaaaatctccatagtgattgttcttctttcctggaaacatgctcccatgattggagaaataggtaggatttctatcaagtgagatcttcaagctgatgataccaagaggaattcagctgagcttctaggtggttgctaggccccctcttctcttcaaagcagttctttaggttactttaattgaagaagtcatgtattatcttagtaaaaataaattcaaaaagtacaaaagagtgtacaatgaaagataacatctctttctcaccccagatttccagattttcccccttcctagagacagccgttgttactagtttcttgtatatccttttaggaatattccttgtgaaaaaagaacgtagatatgtaattgatatggtttggctctgtgtccccacccaaatctgatctcgaattgcaatccccatgttttgagggagggtcctggtgggaggtgattgaatcatgggagcagtctccccatgctgttctggtgatagtgagggagttcttacaagatctgatggtttaaaagtgtcagtttctggccgggtgcggtggcttacgcctgtaatcccagcactttgggaggccgaggcaggcagatcacaagatcaggagatcgagaccatcctggctaacacggtgaaaccccatctctactagaaatacaaaaaattagtcaggcgtggtggtgggcacctgtagtcccagctattcgggaggctgaggcaggagaatggcgtgaacccgggaggcggagcttgcagtgagctgaaatcgcatcactgcactccagcctgggtgacagagtgagagtctgtctcaaaaaacaaacaaacaaaaaaaagtgtcagtttcccttgtgctccctctctcctgccatcttgtgaagaaggtgcttgctttccctttgccatccaccatgactgtaagtttcctgaggcctcccagccatgcagaactgtgagtcaattaaacctctttcctttataaattacccagtctcaagtagttctttatagcagtgtgaaaacggactaatataggaatataatgtctgtaatcttatttgggcccctggaccctttgagaattgattggaagctatgggtacttataaatgacaccaataggccaggcgcggtggctcacgcctgtaattccagcactttgggaggccgaggcaggcagatcacttgaggtcaggagttcgagaccaacctggccgacatggcaaaactccatttccactaaaaatttaaaaattagccatgtgtggtgttgcatgcctgtagtcccagctatttgggaggctgaggcaggagaaccgtttgaacccgggaggcagaggttgcagtgagctgagatcccaccactgcactccagcttgggcgacaaagcaagaccccatctcaaaaaaaaaaaaaatgacaccaataaaaagatgtggcatcccatctcactggggatgtcaagtttcattctcccaagcctgtctcagattaagacattctctaaatatctatactgggttaaggtgtctctgactgagcctgtgtgttctgggaaactctgtgtgtgagtctgtagctcactgtctatcagcaggaagtgtatctggttggtaagttgtttacttttttaaaaatttttttttgttaaaaattatcattatataactatacaggtttagtgttaaatgttcaaatcatgcaggaatgtgtaagctttaaaaagtgaaagttgtttatcttgtcctacccttccaaccaatcccattctccatctgttattactgttggaggtatccttaattactgttggaggtatcctttattgaaatacataattgtgtgtgtgtgtgtgtgtgtgtgtgtgtatatatatatatatgtatatatgaacatatttaatccaaatgagatcaccctatgcatacagttttgtattttttttccaacttaagcattatgttttaggtatacatagatctatctcattcttttaatggttgcataatatcgtttgtactaatgtctggcacgtttcattatatagaaagtctttcagaggtatgcaataaatcatccatagtggtctatttgatggatcacccttatattacagcagccctgccttcgaaaacatagggctcactctcactgtaattacaccttaaccgtggtccctggactcagattctgtgagagagggagagagggagaacatgagattgaaaatgaatgcaggagaatgtgtaggaaagtgtgcatgatggcctggaataagctcaaaatgtaaagtcaagggatccacgtttaagatctagctacatacttcctggctgtgtggatctctgtgttttcctctccccattaaattttttccttgtctttgctgtggccaggctggtccctccacaggcccctactctatccaaaaggtggctaagtcctgggagtggggtgggtggtcagtgggggtgaggtcaggggcataccccagagtcatgaacctgaacattaggagagctgggattagccccggctctcacattaactggctaggtgagcttgggcaagttcttttttgggtgggctttcctcttttctgtaaaacaagagtagaccagaccattaaaagcttccttctgtgttggaagtcctgggatgcagagaggttgggcagagtctcagggaggtgggagcctggggcagaaggaggtggctcatatacacacagccagccctggagaagaagtggcaagtcctttccacctttgaattccttgccttccttctgcagaatggatcataaatgctacctccgtgtcaggcattgcacagattaagccctcagaggacagtgttattaagttgtgatgaatttagattctggagccagacacttcctggtttaaaccctgccaagctacttaagttctcaagtctcagttgtctcatccataaaatgggaataacaatattgacatcactggtggatttacaataggtgaggagtgcaaactccttgacagcagggactttgctttgatcatgctatttcccgagctgagaacagttcctgtcacacactgggttctcagtacagatgtgtagaatggctatcgaataaaacactttgcgctttgcttgatgtataatacacaatcaatgaccgttagctgttcttttaaaatgctgctttggttattagtaaatattgcctattcagtccattatcacagcaactctgtgagatgggcagtgttattacatcacttaccacacagctaggagacagcacagccagagtttgaatccaggtgctatatgggggcaccctgtccttgagaaagtacatgacctacaagccttctcttctcttttttgcaggctttggagttccctgtaactccttttggatggatataatttgcagagaaggggagaggaaagaagggtagcagggtagttactttttagggcacctctgggtatagggatgtagaatgtgtcccctttggtttagctctgaatggacaagtccccaggaagcagttgttggcctagttccttgaagaatgcatttggtgaatccttcagttatgcaggggttaggcatgaattgcttggtgcctgcctggcctggcctgcccgggttttcctatacaatttcatttgtatccatctcttaacgatgagcaataggatggagaacagaatggagaatggcatgtgaggctggccacccagcctcctgggccccagctcatgccttctggctgagttctgcctttgccagggctaacattcagcaaattagatcaaccaaggctcctagaaggataaacaactggtggtgcttggaagagggcagctaaaggaattagggttgagggcggggacagcccctggaaccacattctcagacattcccccagcaacaaagctgcagtccactgacagtgctggggcttgtgccagcctctcctccatccccaggccgtctgagaggattgcagtcgtgacatgggcaaataaccaggaacagcagttggaggaagggagggaagtggccacagaatcctattgctggaacgaccttcagggtccttctgagcctctgtttctctcaaattgtaatctgcccactccctgaatcagaattactatgggcctggtgaaaagcaggtgcctgctacagagggtggtctgtaggccaaagttcctgagtgtggctaggcagggaattactcaggcctgcagctctgcgttttttaggttgggccctgtattagtccatttgtgttgctataaaggaatacgtaaggctgggtaatttataaagaaaagaggtttattttggcttacagttctgcgagccatacaagaagcatgacaccagcatctgcttctggtgagggcctcaggctgcttccactcatggcagaaggtgaaggggagcctgtgtgtgcagagatcaagtggtgagagagaaagtgagagagaaagggaggaggtgccaggctctttttaataaccagctcttgaggaaactctcatgggaatttgctgagtaaaaactctctcattaccaccaggatgcaccaagccattcatgagggatccaccccatgaccctaacacctcctaccaggcccacctccaacaatgggaccacattctaccgtgagacttggtggggacaaataaaccatatccacagcagacctggatacctatgttttcaatacactgtagaatattctaatagatatccctgagacctctgctcctagagatctctgacacttaggcttggaactcactgatggaggcagaaagcacagaggctaaggggatggggtccagagtctgtggaccttaaatctttgacttcagattacctagtccccatgcctggagcccacactgcccttaaccatgagagcttgttatttaatgtctctgagccacagtttcttcatctataaagtgggactcatgagggtgcctccttataatgatgatgtgggaatgaaataagaataacatttgtaaacacagtgcctggcatccagttagctcaatcaatggcatctgaaggtgaaaagtaggctgcatacctccttcatcttttctcttaggaaactgaggtgaggccaatcacccctaagaagagagctgctggcaccatcactggagccatctgtagactggtggtatctttctaattcactctacagggtatttttttttcttttggagatggagtcttgctctgtcgcccaggctggagtgcagtggtgcgatctcagctcactgcaacctccgcctcccaggttcaagcaattctcctgcctcagcctcctgagtagctgggattacaggcacccgccagtacgcctggctaatttttgtatttttagtagagacaggattttaccatattgcccaggctggtctccaactcctaagctcaggaaatccacccgccttggcctcccaaagtgctgggattacaggtgtgagccacagcgcccagcctctacaggactatcatgattgaggcagtggaaggtcagggtaaggttgtgggacttggaactagaatgcttccattcaaatcccgactcctttaatacctaggtgataggctgatctgtgcagcaaatcaccatggcacatgtttacctgtgtaacaaacctgcccatcctgcacatgtaccctggaacttaaaataaaagttgatgaaacaaaaacaaaaaacaaatccctactcttactcttactgtttgtgtgactttgggttaattaaccttgctgagcctttgttttcccatttgtacgttggggacaatatttgtaaggatcctaggaaggtggtgggaagaataaaatgctcacttagcacagtgccaagtccatagcaaaggctctataatctgcagccactatgaggattcttatttattgtgcaccacactatggcttggtctctgtcctgtttagctcacaggcttgttcaagtgatgccagatcagttgcgccttgtgaacctccattggaactttccctgattcctctatggaactttccactcactgggtgtaatcttggcaaccacaacctggtgcacacagaaccatcagctggttggtggtcaagccctctgtgttcccaaagtgtgtagccgttaggggaaactgaggtgatgggagaggccttggttggctgagatgaaaagataacttgggaacaggatgcgtgcagcagctctctcctctgccctttcctggctggattagggagtggatgcgacccttgctccttgccacgctcccacccccagatgttcagggagtaccttagatgtccgtcagagggggtgattgggtactgctgcgtcagactgggtgaggcaaccaggaagtcatcaggcttcctggatctggaatgaggtcagccagggatgggatccgggaaaggctgctgcccatcagagcctggcgctgattttccagagagcatcacaggctcttcccaaagggcaaaatctgggcaggaatcccaagtggcggttgtggtggaggtggaagctgagataagctaagagagaggtcctgccaatttacagtggcaaagactgggttggagatgctgtaggttctgagctctctgcatggatgagagcctgcctgaggttttagagcatacaaaatgctgctagagtccatggggcttactcctgggcttcctcctcccactgagccttgattacatacctttacaatcatgtttatctcattgtatcaaggttggcagatatctgctgcctgggccttcactgatcattagcaatagcaattgataataagtcatggtcctctttcttgctgaggctagaaaagccctcagaagccttggtgatgtaacagttgaagcagctgcctccagtccaaggggtgatgaaactttttgctctctctgttatacattagagtgacttattccaatgtttacactcaacgcttcacaagggtaggcacttggtgtgtcttgttcgctattccgtcctcagcaactggcatgatacctggcccgtagcaggagcccagtaaatgtttgtgactgtcttccagaggactgtgagtttctcaaggacaaggattatgtctagattatgtctaggacacatgagtttattctgagttcagtgctagtatctataatcaagggaggaaaaaaagtagtccctcatgcttggtggtggatgtcacttcaccaaataactaccgtgctgacgtggggcaggtgggacaagtaggcgtgtcatcactgatgcatctagctctggtttccaagcacaaagacccttgtctttccacttaatcatccagtagtcttgataagttatcattgccgtgttagggatgaggaaactgacgcttggagagatttaagatgcttgttgaagagcatgtgacaattgaatgttggagctaaatccagaacctcggtcacctcacttgcaggccactgttctttctctggccactgtactgcttttcctgagtctctaaagttttgacccatgatttgtcatatgccatgttttggtttgggaggctttttggaatcctggacctaccatccttcataagttttaagtgtcacaggtacagccttcttagaactttttgagatttcccagtccagagacttttaacctggagtctcacgatgagcttggtggtggtggttgggtggggtgggggttggggtggaggtccaagtgccctgagctcatgcaccactttttatgtataagtgcattcctctagagaggaagtgtgagcttgcatcagagtctcacgaaggggtacatggccccataattaggttaagaaccaatgatcaaaacccactatgtcattttgcatatggagaaactaagacctacacaagggactttttcagaaccataatctttgaccagagattctatttctcctctcaacagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcagggtgagttttgaggctctcagtgcagaaatcaacctggggacaggcttgtcccctctgaggttgcttactttgaatccaggagtatttctaaattgaaggtgatgcctaagaaaaaggaaatagtgtttttcttttattctgtcattgttgagtgtgaaataccctcatcatagaataactgcttttgggggaaaacactactacctttaaaacactcagatgctgacttcagaaagcttaaaaagtgaaaagaaggctgggcgccatggctcatgcctataatcccagcactttgggaggctaaagcaggcagattgcttgaggccaggagtttgagtccagcctgggcaacatggcgaaaccccatctctactaaaagtacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgctttccctattggagtagacactacaccatatgcacacagtcctcatattgattcatactgaaaatggcatggtgtttcgaggtttcgaggttctgtgggaacgtggtggttagcacactccctctcatatgctggcctctgtcctgcctgtgctcatcagctcatctcagtattttctgagaataaaggactgaatccagggtcccagagcagcctccagcaataaccaaatggcagtggaaggtgttatatgagtgatggccaccacagccaagaacatctctagtgccgaatgacaaaatcattacggaggtagctgctgcttatccagcagctctgtttcttagcagttttttaaaaatgaggccaagtccactatttctacagcgctgatctgtttctctttcttagatgaaaagggaagatttaaactccatgaagtatgtggagctttacctcgtggctgattatttagaggtaagggggaggcaatgggtcttgcagaaaaactgctctcttgatagcttccattccaggctccagactgctttggggaaatgttgcccattcatctttctccagttcatctatgattttgaccttaaatctcaccaaaggctgggcgcggcggctcacgcctgtaatcccagcactttgggtgggcaaggcgggtggatcacctgaggtcaggagtttgagaccagcctggccaacatggtgaaaccccatctctactaaaaatacaaaattagctgggcatggtggcacatgcctgtaatcccagctacttgggaggctgtggcagtagcatttcctgaacctgggaggcggaggttgcagtgagctgagatcatgccactgcactccagcctgagcaacaagagcgaaactccgtctcaaagaaaaaaaatctgaccaaaggctcattttgccattttaaacatagttggggggaacttctccaactacagtattgctttacttcactagtaaagacacagtgaaatctccactggatcgggacatataccacgctatacattaagacagctgtacgattaacatttattgtgctgtgactgtataccattagatactggtgcttagactgaggaacccgtgatagtctatagaaaatgtcaaactttctatggggaaaagatgaaaaatatatttgcgagggctccacacgaatactgaattcttgccgatgtgtcggacctattatataatctttgtgcagacacacaactaccctaatggctggggcccaaaacggggtttctggatcaccataatcctaaaatccctagtgttaaaacaaatactcagaccgtgcaccgatctccttaaactagaatgtacggtggggtcaaaaatgcttgcttaacataaacatggaaaactggttcgacaagtatgttattacccccgacggagggcctaggcttagcgttaactcttctcctaagtcaaaccgttataaaattggtgaaccctcccagataatgtggctctggttataaaagaatnnnnnnnnnnnnnnnnnnnntggcttgttacatcagtcacatagaaaatcaagacagttgtctgattaacatttcttgtactgggtctgaagacctttagattgctggtgtttattctgaggaacccggaattgtctatggaaattctaaaacttttttttttgcaaagatgataaatatattcccagtcatccgactgaaaactgtattcttgcccatgtgtgggtccatttttataatcatgttgatgccaaatgatgacctaaagccatggtccccaaaatgtggtccccagagcaccagcatcagcagcacccttgtgtaagatgcaaattctcgggccctgcccccgacctcctgaatcccagactgtcagggtggggtccagaaatccatgttttaacaagacctctgggcgattgggttgcacagtcaagtttgagaaccactgacctaaaggcatagcagttcagcctttaactccatgttcctcaaatcagacaggttctaagaatttgaggaaccctcacctggctcatcatgtatttcatttattcatcagtgatctcttgattttctattatgtgccaagcacctggatatatagatctcaagaagacagaccctccccaggcatcgcagaatttgcagtaacagcacacaaacctgtaggtccaaagtgtgataagcactaagatggaccattaggagggatgaaagtgcagataatgggggattcaacatggttttgggaattagggaaagcttccctgacattgaagcagacacctaaagagtgagtttaggccccagagcccatatttgcctaaattagccagatgttacctccaattctcactttgtttagtgactccatcatataagtactaagtgcatcttctgtgcattggatgtcattatgagctgagcgctcgctgtgttcgagcagggcagacactggccttggtctctcctgaggatagagcccatcacaactccagtctgtctgtatcccatccacatagtttagctaccatcttcccaaagagctcattctaaggcagctgtacctagtcacatttccaaagcatgtgtcctggcagcagggcctggtgttggggagagcactaggctgcaggccagaaggtctttgagtgttagtcactggatgttagcagcagaaggaggtggcccttgaagctgtcttaaaagacaaggaggagttaactgggcagaggagtggaggtgaagggcattccgggccgagggaacattgtgctctgctttgaaaagcgtttagatttattttaactgatgttgatattggtttttccaacagctgtttgtgtgtgtgtgtgtgtgtgtgtgctctatgttttctgtttcctctccaaagactagtgtgtctataggatgggggaatagtgtggggagcaaaatccaaagctggtttaaaagccagctgaggctccatagtcgtgggaggagataactgactctggcctgccctgcctgactgcccgtagtgggaggactggtggaagaaaactgagctcctctgactctgggacatttttccacttaagttctgcatctgtgatcatctgatacaatggtcttgagtcatttttttcagctacagaatcctttggttacatggaagttcctgggaaccccagtagttaagcatatagagcccagctgctctgtttaaaggtggggtgtttctcccctttggccttgcattgttctcagaggaatctctgtgcaggctttcaaacccactgggtgtgaatctccagcagctggagaagtgggaagcatggtgggaggcagggattaggcatcttctatctcctgacctccagagtcacagcacacctccagagaaaaagtgtccactcaaggtgcctccaggactctggtgtcagctagagccatctttctcttacaaaggagagtgtctcagcaacagccctgggttcccaacagggctgtgattcatgcagctgtggtggataagggaacgtgctcatttctcagtcctggacacccctccgctgaaggctttgaatgattcatttgagggactggggtgggggtgtgtaacaggccaggctgggttcacaggctcacgaatcatcccctctccacctgtctccatcctctgcagacagaaatatattcttgacaattaattaattaatctgagaggatgggaaggcaggaaaggggagggctgctttaccatgatttataacctgctgcagagacagagccttggggctctgaatgcagagcagaaagtggagacacagatagggagagcaagaccctgctgctgcctagagagagagttgtcagcagtaaaaatgagcaggcagctcctcgctccctgggcctaggtgggagcttctagggtggttctcagtttattcattccccaggtggaacggaatccaggtggggataaagagtaaggtgggctgttgtaggagtagacaggataactgtaaacacaggcctgtaaaggacttccatgatgctggcacagtgcagagtggctgggaaaggatggtgctgcatgtggtactcactgtgtcaccctagaaaatgtaagtttgagacagtcctttctttacatcaggggtctgcaaactataccccatggtcacatccagcctatcctgtgtttttgcaaacaaaattttactggaacacagccaggcccattggtttctgtattatccaggcttctgtattatatatacaggtgtctgtattattctgagccaccactgcacagttgaagagttgtagcagagactatggggccgcaaagcctaatccggcctttgcagaaaagatttgctgactcctgcttcagaatactctggacaacagaattcgctccttaaattatggtggtctcattgggcagttctttgaagagaagattaatatttttttgaaagacaatgaaatctggccctgatgttctaataaatattactaaatgaatggaaatgctgcaacgctgtctgtgccgagagaccaatttagaaacaggaggcctctataatgagaaactcctggattaacaccttggaaaggtctaagttacagtgtcacactgaatctaactctagaaagcagtggtaacagattctcttctggtgagtggcagttttaaggaagcctaagaatgtccacaagctgtggtgaaagggaaatggtggatttcttccctgtatcagggctggtacacacctctggccaaacaaataccccaggttgttttacttggctgttcttgttctttcttgcttagatattctcatgggatggggtggaggaaggacgtgaagattttgaatcaaaataacatgtatagtgggtacctaagataaattagagaggacccagattctgtgtaacaatggcagtgtacaggacatgcccatcatttttaaatgtaatttgcagttgtagcaggttttctctttacactgtgaagctttccttcatcattgcagctcagagagatctatctttttgaggcaggaatggtaaataggaggtattcatactaaaatgtcctctttctggtacccatggcagatatttctaatggaacacagctttctttcctgtgcttggttagaaatgtctgattacggccaggcgcagtggctcacgcctgtaatcccagcactttgggaggccaaggcagatggatcacttgaggtcaggagtttgagacaagcctgaccaacatggtgaaaccccatcattactaaaaatacaaaaattagctggccatggtggcgagcacctgtaatcccagctactcaggaggctgaggcaggagaatcgcttgaacccgggaggcggaggttgtaagccgagatcacgccactgcactccagcctgggcaacaagagcgagactctgtctcaaaaaaaaaaaaaaaagaaagaaatgtgattgaatcgatgcagtctcataattcttctcattcttctcactgtagaaggcactgccagtggatctgagtggtgtgcaagatgaagcctatttgccagtgtcttatggtcctcctcgttggcactcatgtcattcacatgacctcccactgtggttatttctgtgcacgttttcccggcaggttttctcaaccatttcagttctatactccttaagtacagggtctgtcactcagcatctgccacagttatttctggccctctctgttttaattgaagctcctctaggctagaaccaagatctcacacttctttgtgtcctacatagtgctaagcacaatgccttgcccatagcaggcattcagcagcaattcgatgattgttgattgaccacatgtagggaagcctcgtgagatctgtgtaatggtggcttcatgttggggtgatgaccacggtgaggattggatcagtcctcctaagccccagtgggagtttgccagaggccatgtaattcgaaggacaggagaataagatgtgcttcaagggttagaggaaggcaattctactccgtgcataattattgcatgcctactgtgtgtgctgcgctgagctagtagctgtggatatgaagatggatgttgacaggtcctaccctccaaagctcttactgtggtggggaagacaattgcataaaaatgatggctcatagaagacagaagaaaataagagcaaattcaaagacaagtaatggggcgcaggaagcatcctgtgagaggttctgggatctcacatggttctgcttgtcccatttagtttcagaagaatcgacgagaccaggacgccaccaaacacaagctcatagagatcgccaactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacattgtgtatatgaaagaagatatttgttatagtacaaaatgcagaataggtaacctagaatgacagtagcctcttggtaggctagtagtatatagtttttaaaagtagtttttcatgtgtttgggatcaaaagtctctttgagaatctggtaacgtttattgcacaattttagaatactcataacattgatgaagcttaactttgggcctgctagggattcatgaattccaggtctaaagggaaaatcattttttcctaaacactagagaatataggagatcacttaaaatatgttttagggattaataggcaaatgtattagttctgaagtcatcagatggcagtttccatgcccatggtttttttctgccctagatggctctggaaacaaaggtcagtggtcagtgacaggtgaaagtcaaacactggcatttcctggaaggacagactctagggacacagtccagtcctccctctagctcctgactcactcaagaataacatttaaataatcctacaacccaaacatttgacatctgggaaaacaagggaagcttgtttccctggggagaatatgggaggctgactctgctttcccccatgtgacatctattgtttggagacctggcaggttcggacttggctgggtatcccctctgtggggtatgtgatggaaccaagggcgctggtgacaagtgaagggagaagagaggcaccagcaagccccagtccttactgaaagccctaagcctgggtggcccatgcatcctgtgcagccgtcttggctctctcctcgcggctggtgttagtcactcctggcgggtaagggaagccacgcccacttctctggagcttgctgacctagctacttgaactgaactattgttgaactaaaactggaatgaattggactcgtgctgagtcatgaacccaatccaaaatgtttttctgtaactgtgaaaaaaagccaagtttacttccttcaaaagctccctagtaaagcaaattcaaattggaatctgaaccttttattttctgtaacgattgaactggcacaaaacagaaaaatcaaaatttctgttgaaataaactgatatttcactgaatctggagcccatcttgaccagcgtttcttggagcgagtggattatctggatgtgtaggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggtgaaaaatgccagatcataaagattagatgtagctctagcctcgaggaggtcgagtcagatcttgggtatagaatttcaggatctctggtttggacaaaaccctgaagattaccaagaacgtctgtagtctattgcttgcaacctgcttattccatccttgacaaaacctgagactatccagggatggggaagaaaatttgaagagtaagcatatctgtgcacttttatgtcatttatactcatttacttccaaaatgagtgggagacattttataataaaatatccatgtattaatataatttggtatatccatacgaaagaatattattcagcaataaagagaaatcataaacgaatacactctaacacatggatacatctcaaaaacattatggtaagtgagagaagccagacacacaaaaccacatattgtaaaacaaatgtccagaaaaggcagaatagaaacaaagtagatgcacggttgcctgggctgagggtgagaatgggaaatgactatcaatagacatgagggatctcaccgatgtgatgaaaatattctaacactggatgatggcgatggctttattttatttttatttttttttgagacggagtttcgcccgtggcccaggctggagtgcaatggcacaatcttggctcaccgcaacccctgcctcccgggttcaagtgattctcctgcctcagcctcctgagtagctgggattacaggcatgcgccaccacgcccagctaattttgtatttttagtagagatggggtttctccatgttggtcaggctggtctcgaactcccgacctcatgtgatccatccaccttagcctcccagagtgctgggattacaggtgtgagccaccacgcttggctggtgatggctttaaaacttggtaaatttaccaaaaagcattgagctgtacacttaaaatagatgggtattatggtatgcaaattatacctcaatgaagtggctttaaaaaatctatatacaagagaactttttagatacccataagaaagataaggctcacataaggaattgggagaaaaaaattgtaccagacagcctggccaagggcactgattacagaagacagcaaagctcagctctgagctatctcatgaccagctttgtttgaaagccttcttcctattttaaaatgaaatttatgttcctgtctgttttacctattgacctaagccctacttgaacatcatgcagaacaactttttccacatgatagacctattcatatctgaaagcaattttatgtcctatctcagtcatctctaaacaaagtcactgcagttctgccaccagaatgtcctgctctctctcaggatctcattttccctttctaaaaaatgtcagtaacaccagttgcctccttctgttggagccatgggcagaagagaaatctggtatctgtgctctgagttcttaggctaggaaggagctttttttttaaatttatttttattttttagttttagtttttttctttttaatctcaagctccaccagaatgaaaggaaggggcttttaaatcccaggtggtattgacagatactgtggtttttctgtgtcctttcagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgtaaatagcctttttccatatgttgtgttgtccttggctgcaaagcctctgcccacccagcacatgctcagagtttgccccatggcgagtgttggttgtacaaggccattctgactccctggtccagagaatcaggcatttcctaaacatgcgctctgtacccagcataccccagaaaatgtttaaaagcctgagtcacattattcctaagaaatgtttacagtctaatgggaaaattagacttacacatattccattgagcatctgaaataattgtgtatgtatttgggaagggactgactgttggtcaggtcttagactttctaagagactcatctcaatcttcctggcgctttgttctaatacatgagctgatctcccaacacaggcacaggagagcgggctccttgtgttgtccttcacttggttcccaaggggcacaaggctgagtgcttgagagagtccaagtgttagacagtgcaggaactgagggtttggttggagggagacattgaggagggattgtgctagattttcatcagcctgggagagacagtgatgggggtcacatgtgacagtgccccagggtgattatttggtatttattagtgttgacttctgaaggtattttgaggcagttacaacaaaaggcatatagataataaaaccatttgtcttcttttcttttttttttttcttttttgagacagtttccgtctgtcacctaggctggagtgcagtagcgtgatctcggctcactgcaacctctgcctcctgggctcaagcaattctagtgcctcagcctcccaagtagcaggcatgcaccaccatgcccggccaatttttgtatttttaatagagacaggattttgccatgttggccaagctggtcttgaactcctggcctcaagtgatccgcccgcctcggcctcccaaaatgctgggattataggcgtgagccacacatgcctggccttcaaaccatttttcttctgttccctaaatatagctgagttaataatcatttaaactttggcttatccttttaaagaaactgggaaaaataactgtccccaaaacctgggctgtaaatagttactacatttgcctaggaagagtctttggctattagaacttttggcctgaactttggaacatgtagaaaataactagtaggacttcatatcaatttgcatagattttgcatatttctttgcagattgtttctctgaagataagtctgcctgtaattcagcaaacatttattgtatacccactatgtgtgagattctgtgctaggttctacgatcccaaaatagttaagatagtcttgctgtcaaagatatcatggtctagatgagaagacaaacgtggagataagtaccacataatgaatttccatataggttctttaaatacattacatgtttgtggcatgcacagaaacactggtagttttttttttcttctcctctaccctggatgtatataactgaaagagggatgtattcaactggggaaaatgaagcttgctgctggcagattaggatcccattgcaaaacaaaggcagaaacagctcattcttgcatccaactgcactttgtgaggctcctgatggggcacagctgtttccttggcccctgagtatgtgggaatgaagcatcatcggccccacagctgctgccccgatgcccccacccctaccctgtgggactcacaccacagagccaggggtaaggtattggatcccggcagctggtggaagtgggcatgattcacttcagcatcagaatctgtgccacccttccatcaacctctccttctgaccttttcctgtgcagcaggaatgcaatgcagctttgcaaaccctgcccatttccttccaaggaatcagctatgggtatattgtgggagataaacgacctttctctctctctttgtgttcctctggagtcatgagggagtaggtgagaggaagtgagaggtgtggtgagctggaagttgtccagttggcctggttacaagggcctctccccttgggaatgacctgggaaagtcagcgggtccagggaaccccgtgatggccacttactcccaggcacattggaacagccctcttagtctcgtccccggtcaccgtctctccttgcctcctgcaggggcatgtccttccacggcaccaccatcggcctggcccccctcatggccatgtgctctgtgtaccagtctggaggagtcaacatggtgagtctcagcccgtgtgtgtgcgctgcagaaggcgctgagctgcctttcaagaccagaggtcatcttttgaataataagttgatatttattattgtagcagaaaaagctttgacatcaggaagggcaattgtttaaaatgaagtcattaagttctaagagatggaggtactgaagggtgaattttcatttattatagttcattccgtatcttcaagctcaggaaccctgaagagattacatgcatacatcactagatctcatatgttccaaaccaggggctggaaaatagtaagagagtagaggttaaaagtatttttatttcaggtcgtgtgctgttatatatgtcattaagaaacaagaacctgtctcaaagtcatggttaggaaattactgccttcttttgaaattcactctgacttcatgagactatttgttttgactcttcatttctaacctgtgaagtgcatatcaaggaagacttgtcttcatctatttgtctgtccctctatccattctgtatttatcgacaaagtagcataatggccaaaaccacaggctctagggtctgagcctgttgggttcaaagaacagctgtgtgattttgggtgagttaatgagtgttctcagctgtaaaaaacgcatagttttacagttgataatcataggataggaatgggaattaaatgaaataatgcaggaaacacacttccatgtttagtaaatctctttctgctgcttctttcctgctgggtttttttcctcttgatttctttagcttttgcatcatcagacagtacaccaagtgctgtgcctggagtgtatctgtcttgtgtggttttctcaggaaacactaagccaagtacaccctatgtttgaatcaaggtcgtgttttctatgttgatttccttatgtctggagaaatatatatgttcagaagaagaatggggaaaaatcttcctcttttatttattctgaaagcatttattggtctggaagttcatccataggtcagttgtggtctgcaacctttgagaactcaggaaacatggacttttaaacatttgatttcctcctagtgacagcagattcagccttgctgtcagaggcacatatggagagtctgtatgctcagtgacagtggaattggtggagacctgcaagacttggctaaggataaggcagggatggggggcagaggcagatctgtccccttgaccttgacctcaactctgtcttctgagcaggaccactccgagaatgccattggcgtggctgccaccatggcccacgagatgggccacaactttggcatgacccatgattctgcagattgctgctcggccagtgcggctgatggtgggtgcatcatggcagctgccactgggtgagtcaaacagcaagagggaggatggggaggagggcgggcacacctggacagtgtgacccaggggttcctcccagctggccccactgagactcccttaaacttctgatggggccaaaaaatgtagtttttacaacaaagaaattgagagaagaccaaggcaaatgtgcagcaagaacttaactttccagcaggaggtttggtgctggtgtaaccctagatttatttaatttctgttttaaggtgttgagttataaaattggcttggccatatgtgtcttttttatttcatgaattttttatgaggacacattttgatcatagccacagcccttaattcttctatcccaagagagttggatcagtgctgtttcaattccaggcttcactgaaagctccgatgtaacagaacaagttgaagaagagggccatccacacaccccacagtgacttctcagggagtttgcaggccacattacccatgaggaacagggtgaggcagctgcatctccctgtggtcatgaggaaatttttttttttttttttttttgagacagagtcttgctctgtcgcccaggctggagtgcagtggtgtgatctccgctcactgcaagctctgcctcccaggttcacaccattcttctgccttagcctcccgagtagctgggaatacaggcgcctgccaccatgcccggctaattttttgtatttttagtagagacagggtttcaccatgttagccaggatggtctcgatctcctgacctcgtgatccacccgcctcggcctcccaaagtgctgggattacaggtgtgagccaccgcgctggacatgagggatttttaaaaccagagtctctgaagagaattagggagtttcttcaaaggacttgtcttctagcatctgaactcaggcagcacaaagcattgggttcttccaggctctttggaaggcatcacgttgggaccttgtgttccttcaccccacaccattagggcctgtttatgattcttagagaatggtgtttcaatgtctccaagaaacagtgcagctttcttagagctctggtgtcaattttttaaaattatttctcagctgcttagagcacatcaannnnnnnnnnnnnnnnnnnnnnnnnnnnnnnnnnnnnnnnnnnnnnnnnnnnnnnnncctggccaacatggtgaaaccccgtctctgctaaaaatacaaaaattagctgggcgtggtggtgcacgcctgtggtcccagctactagggaggctgaggcgggaaaatcacttgaactcgagaggcaaaggttgcagtgagccaagattgtgccactgcactccagccttcagcctgggcaacggagcaagactccgtctcaaaaccacaacaacaaaaaaagaatgaggcaggatacagcttcacagtcatgcctggatccctataagctcatggttaagctcacccctttctctctcaatctaaaaagcgtatctgaagacaaatgattgagagttatattgattactactctctttcatttttaaattattcacaaatatggatagtttaacaattattagtaacaaattccttggagcataccttcccactgaaggaaaagctccagtttcttggagggtttaacctttaattggtttagagaattgggagcaggataactctccttttgtagacccagatggctgtactatttgtccttttcaccaatggtgggacccaggaccttccatactcctgtgataaagagcatgcgtttatgagttggctggttgagtttggaatgccctctgcatccttagaacagcaatgagatcactggcccaaaatgaaataaaacttatgatcttggcctttttttggcctggtcctctgtcacaagagaatattcacctgatatcagcttcaggaaaagtttaggttggctggtgttttcttcagtgctaagtctcaggagacctcttgtaacacactcacaaccctttacttatcgcagccccctcatgcaatgggcagaaattgctactcctgattctcaaatgctttctgcatgccgactaagaaaaatagaatgttatggggtggttaatatctcatcactaaggatgaaagaattcttttttttttttttatactttaagttctaggatacatgtgcacaacgtgcaggtttgttacatatgtatacatgtgccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtggagggtacacggcagagcccggtcatttttaacaaatgcatgtggtttctgcagaaagcagaactggattgtttcgtctctattttttgaaggctgaaaatatgtatgtttatacatgcataacaatttggggtagataacaagtaacagtaaattatgggggtgagactgaggttctgtataaatggaaaaaaaaatctgattttatggccttctctctctcactctgttgcccaggctggagtgcagtgacaagatctccactcactgcaacctccacctccagggttcaagcgattctcctgcctcagcctcctgagtagctgggaatacaggtgtgtgccaccacacctggttaatttttttttttttgtacttttagcagagacagagttttgctacattgaccaggctgttctcaaactcctgacctcagatgatccacccacctcggcctcccaaagcactaggattgcaggcgtgagccaccgcaccctgcctgtgacctctgtgatgtgatttttctttttttaatgccagtatgtcactttcagaataaaacaagaactagtcaaggatgccacccccaccaccatgagcccagagagatcaacacagacccatcagaaaggagggagtggtatgaacatggagggccactggggttgaggaatggcctgagagtgggcatggccagttggcttaggttctgagcagttgctcattcaacaggcacactgagtgtgggctactgtgtctggtcctagggttaggatgagtggcaaaaatgacatagttcctgtccttggggagctgatagtctagtgggagaaacacatattgaaataattgcaaaagaatatatgtacagtccatggcaagtgctaggaagacaaatgacacagtgctctgaacatatataatgtgagggggaacctccttgcttgtgtgggaggtgacctggagcccatatctgaaggctgcattaggagttagtgaggcacgcaggagggaaggcacatttcaggtggaaggggagcctgtgccttcgtgggaagaaatatggtacattaggaaggcaggaatacaggtcttcctggagcccaacatggtgggagaataatgggaggaaagtgttctattccttctcttaggggagacaggtggacaggtgtctgtggtcaggggatgggatgtggctctccaatatgctagagccctggacagttaggggtataaggttgataaacatgaggtaggcctcaggcagacctgacttgaattcagcaggtgtgtccctcggccagctactggacttgcctgagccacagcatccctgtctgtggaatggggtcaaggctgcctcataaggctgtggtggagagatctgtggagccccgtacacttttcatcaatggctgatggattggcctgttaatactgtaagagtgtgatgaggacgctcagggtcactggaacgcctcataatcttttaaaaatctcaggctgggggagagcaaggaacccatggagatcttctgttccagaaaggtccaggccaggaagggcttaggaagagaagcagatggagaaaaaaatctaaggaaacagacccaggagttgacataaactgtttggagaggttgttccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctggccaacatgacgaaacccaatcgctattaaaaatacaaaaattagccaggtgtggtggggtgtgcctgtggtctgagttacttcggaggctgaggcgggagaatcgcttgaaaccaggaagcagaggttgcagtgacccgagatattgcatcactgcactccagcctgggtgacagatcgagactccctctcaaaaaaaaaaaaaaaaaaaaagagatagttgctagagagctggggttccaggggtgtgtgggcaagggtggggaaaatgttgggggtggtgaaggccctcccccactcacacccaccccactgcctccccaggaatgtaacaacccctgctgcaatgcctctaattgtaccctgaggccgggggcggagtgtgctcacggctcctgctgccaccagtgtaaggtaagtggcccttttctccacgccttgggccctggcctgacagtgggaccacaggactgctctgctggggtggatggctggggatttgcctccatcctggggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatccagagagagtgggcttgattttattgagctcataaacaataataattatcatcatttgtattgacattaatggacctcttagtagatgccaggcactgtgctgggaattttatgtacgttatctcattctctcctcacaaaaaccccataaaatatatgtgactatccttattttaagatgtggaaactagagcttataggggataagaggtttatctggaatcaggcagtcaggaagggactgaatccagctttccctgactctggtgcccacattcctaatattgatgtgagagataaattgtctgttgctgctagtgttaccgtagaaccacaatctctcttccacaattctgaaattaagggagttctaaaagctgaaaaaaaatgtaaacacatttggtggcaaaacttgacctgaattgacatgagatgaattatagtctttttaaaaaaaaatcactcctaaagtgaatatttatattgcattacagaaatattaatatgtttgatcagaaggtgttatccccagccttgctggggggttatgtaatatacatatgtagttatatatgcggacatatgtaattatccatatccatatatatatatatatatatatacatacacacatgtgtaattatatatgtacacacatgtacatatggacctatgtattacaatatctgctttctaaatctgaaaagcctgaaccccatctggccccatcattttaggcaggaactgtgggcctgggcttctgcctagcacttgctgagtgctcgttaggggccagataccattcacatacttagttctaactcacgtttaatcacccattagtgggttattatcctgagttgtgggtgagtgagcacacacaggttacacagcaggtgcccaaggccccgctgccggttaaggagctgggatgtgtgcccaggcaggctggctgtggggcaggtcctctttgcctccacctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagggaggctgtaagactcttcgccctttgccccaggtgtgctgttgatcaacttattgatctgcaaagtgggacaaatagcagtatctatcccatggaagctgtgaggatcccacgagatacgtgtatgtcacacactcagcccagtgcctggccccatagtggggatatattattgctgaggtgctttgtaaactcacagatgttatgtgaatgctagttttgtgtgtgtgtgtgtgtgtgtgtgtgtgtattagtgggcctggctcctctgccacttactatgagtctttggatgcatcgtctaacctctttaagcctacagattttatcatctgcagaagggataattatatcacacaggactgtcatgaaaactaagtgaagtcatatttgtactggacacttaagtgggagctgcataaaagtagctgctattactaaagcatgtaggaaactgtaaattgttgtataggtattatttcttgcctctttcttaagacttctatgaagagaaagtgagttagcatttgtgaaaacagcttgaaattctgtcagtattcacatgagaaggctgaaggtggtttgggctaatgaggtcatgtaaaaagtgctgtgaaatcatggtaatggaaaattctgttctatgagagtgatccttatgagcccttgggcaacagggttgagggtggggaggagattgactgtgttttcctctcattccttggctcagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggctgcagtgagccactccactctaggactccagcccaagcgacagagggatgtaccatctcaaaaaaaaaaaaaaaaaaaaaaaaaaagactgggcacagtggctcacgcctgtaatcccagtactttgggaggccaaggcaggtggatcacctgaggtcaggagttcaagaccagcctggccaacatggtgaaaccctgtaactgctaaaaatacaaaaattagccaggcgtggtggtggacgcctgtaattccagctactcgagaggctaagacaggagaatctcttgaaactgggaggcagaggttgcagtgagctgagattgtgccactgcattccagcctgggtgacagagcaagactctgtctcaaaaaaaataaaaaaagaatatgcttccattctttattagatagattatctctagaagatacacacagaattatacctaggagatacagaaattagagatttaagtatctttagaaaatatactgttaataagtgctattcctccaggatgtagagaagtaggaactggatgactacaagaaaaattttccaagacatacttatatctttaaaatattatgcatgtatgacctattttttaaaatcttgaatcggaacatggcttcttcattagagagcaggcttagcatgcaaccctccccacacacaaatataaatcctcaataaggtaggaagaatttacataaaacaggccaggtgtggtggctcacgcctgtaatcccagcactttgggaggccgaggcggggggatcatgaggtcaggacttcaagaccagcctggccaagatggtgaaaccccatttctacaaaaaaaataaataaataaatacaaaaattagccagtcatggtggtgggtgcttgtcatcccagctactcgggaggctgaggtagagaattgcttgaacccaagaggcggaggatgcaatgagccgtgattgtgccactgtattacagcttgggtgacagagcgagaatccatctgaaagaaaaaaaaaaggatttatataaaacattattctctgagtagatcttgttgagaatatggggatggagtaacctggagggaacaggaagaagaggctgagtattccctcccagaaaatattcttaccttcatgactttaccaaagatacctttgcccttgggggcttctgacagatgagtatactgatagatgttgcttgcccacccaggagcccgacctgcccctgacctctgcttcgagaaggtgaatgtggcaggagacacctttggaaactgtggaaaggacatgaatggtgaacacaggaagtgcaacatgaggtgatgaccaaagggcaggcctcatgaaatgaggatgaacaagcagtttctgctctgtcctcactgttgcccaactcagcagtgtgactggccccagagctgcacctttacgtcaatcagttgaagtcagtcatctattctcggccccctgtttgacaatgcacttttcagctctgaggaagtcagaggagggtgtgggtggcagtgcttcctagaaagctgatcgggcttcctttggggaccatcttacagtagggcagggaatcagcccttttgggtcatttctgccaaattctaatcatgccctaatttgaatagctcctcattcattaattcactcattcattcatttattcatcattcattccaaccaaccatccactcatctgtctacccatccatccatccatccatccatccatctatccatccatctaccacccactcacccactgatccatccatctatccatcctccaccacccactcacccactcatccatccatccatccatccatctgtccgtccatctatccatctactatctattgaagatttactgtctatctactatctattgaagatttaccatgtgcaagatattgtgctgagtgcatggaacttctaattaacaatatagtatgacaatggcaatgtggagagagccatccaacccatcttagtgtgtcagagtggtttcccaaaggaagttatacctacactgagatctggagcagttacctcggtgaacagggtggaaggtggtgctggtgcataggagaataatccaggaagagagatgaatagagaaaaactggtggttgaaagaactgagaacagtttgatacagttaaagtataatgttggggtgcaaaggagaaggtctgctgagaaattagcctggatagtttagcatggaccagatcatgaaaagcctcaaatgcatggctaggggagtttagattttagcttgagagcagtgtgaaaattagactcctatgaggcagactggaggcagggaaatcaatcttctgcagaccaggtaaggggggtggggcagtgtgaattaaggtagatagataataagatagataattaaggagggaagattgatagggtttgaaaatggcttgagcccaggagtgagggagaatggggagttggagatgaccccagatttctagctggaactcctgggtggacagcggtataaggggcaaaaagggaaagattgctcagctcaggtggctattcttggagttaaggacttttcgaggccagttctctggtctagatttgctcagggtcaaggagcctgttctcttcccttggtgtcagtccacatggaatctctcctggtgggttccaaagcacatgactgccctaaacctttgccccaccccacgcaagcctgctgtcttgatcaagaaagactgaagctctctggtgccccagctcttcctctgcctctgattccgcttccttccctctctgtctcttgtgcccagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatgtgagtcccctcccctgctcacctaggagccagctgcagagcagagtgattgagaagtgaggtctgagggaaggatgcctgggctcagatgccacctcgccaacctctgagccttggtggctcccttcatgaagcgtgtatagtgacagcaggcacccaccccagagaactgtcggaaggattaaagaaaatcatcccagtaaagcacttaggtggcctagctagtgccactttcatcctcatcgctaattatcataggaattaaaaatggactaggagttagggaagcctgagcaaaataatagcacagactctatcctccagagtcgattctgataatgaaactatggaaaacatgaagcatttagcatagcacctggcacagagtactgtcaccatcattatttttaaatataatgttaaaattgatacatattaatgacaagtaattaacataatcaacataatagtcctttaatgtgataacacataaataatattgtattgttaaatatgatactttaacaatatatttgtcgttttctccctaatcacaaaagtaatagcagaatttagttggctgttgtcctgtccttagcgttgtgggctgttttccatttttcactttgatagtaacctgaagtgtgctgcctatttgggccctcatactttttttcttttaagatggagtcttgctctgtcacccaggctggaatgcagtggtacaatctcggctcactgcaacctctgtctcccaggctcaagcaattctcctgcctcagcttcccgagtagctgggattacagacacaggccaccaggcccagctaatttttgtatttttcgtagagatggagtttcaccatgttggccaggctggtcttgaactcctgacctctggtgatccgcccacctcagcctcccaaagtgctgggattacaggcgtgagccaccaggccgggccatgggtcctcatatgttccaagtgcaaaatcttgcctcctaactcccaaccagcatccctcccattgcactgatcgttctgttttctctccgtgcagatttgctttgaggggcagtgcaggaacacctccttctttgaaactgaaggctgtgggaagaagtgcaatggccatggggtgcgtgctgggttctggcttctctgtgtcatggggacgtcatgagggcaggccctgtgggtggctgatgctctctggggtgctgatgcctctgccctttctttgctccaggtctgtaacaacaaccagaactgccactgcctgccgggctgggccccgcccttctgcaacacaccgggccacgggggcagtatcgacagtgggcctatgccccctgagagtgagtgccagcctgctggggccactgcccgcttttgtgagaagagcgggcatcaggggcaggtggcatgttgcagagcatccacattgaatcagcttcattgtcctgattttgtagagaggaaatcaggataaagacagaccaagagagaggagcgactgctcatagtgtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtctttttgtttctttgtttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcaggtatgacagggttcaatggaggactcagggtcaatttatgggtcacaaaggtctccataaatggtacttagcaaaagtgttggtgatagtgggtctaattcagggaagacaagtgcaagatacatgctgccctctcccctgctatgactgtgacaggcattactagttgatcttattgtaagtactctactgattctggtcatcactcctgagttcttctcagcagaatatccccaaccaaatcaagttgaaatataaaataaaatctatttgccatcctttgtctagttgatttattccccattttattttatttatttttgagatggagtttcactcttgttgcccaggctggaatgcagtggtgcaatcttggctcactgcagcctccgcctcctgagttcaagcgattctcctgcctcagcgtcctgagtagctggggctacaggtgcatgccaccatacccagctaattttttgtatttttagtagagacggggtttcaccatgttgaccaggctggtctcgaactcttgacctcaggtgatctgcccgctttggcctcccaaaatgctgggattacaagcatgagccaccatgcccagccccctctttgtctttttaaccactgttgctttaaagtttgtttcatctggtataagaatagctactcctgctcgcttttggtgtcccatttgaaaagtgatgtattattttggatatggaagatgtacagtctctgagtcacctattaaataacacttgttctggaggggattttaagtcccaggtctttctggatctatgcctgatggggattggttgatggctcgtgacacccttgtgtctcctcacaggggaagggtcttaaaagggtgaagagaaggtgctgagagagctctgctttgtataaggccaactctgtttccttgagagttctccattggccacacgtttttctacttaggaagatgtggttcgagaagaccaatcccactccctccagagcagacttgggaaagatttagctgcttgctggccgtgcttgggtcaaagggaactcaggcactgtcccctgctgaacatcgtcccctttcttttcctcccccatttcttgtttctagttgtcccttcagggtttctcagaacagcgggactggtcatgccaacccaactttcaagctgcagacgccccagggcaagcgaaaggtaagagctttgcaccactgaactttgctacttttcctttatccctcagggccatgctgtatttttctttttgagatggagtcttgccctgtcgcccaggctggagtacagtggcgccatctcagctcactgcaagctccgcctccagggttcacgccattctcctgcctcagcctcccaattagctgggactacaggtgcccaccaccatgcctggctaatttttgtatttttaatagagacggggtttcaccgtgttagccaggatggtctccatctcctgacctcgtgatccacccgcctcggcctcccaaaatgctgggattacaggcatgagccaccatgcccggccgccatgctgtgtttttctaagagcctctgtgggcccatgggattggtaataaaagcccttttattggctggagagacatgttatttggttctgacatcccctaatgactttaaaggttgcatctgacttctgggatcctcaggggtttaatagattggtgtgtctgttctccctttgggctctggtttatctcaaagagacacacaaggccagccctgagtgatttcttgtctcaggtgttccttgacttgtgcgtacaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctccccttccttttatgtggggcagaggtaggatggaaaaatccatgcagaaagagaggaaagattgacagggagagagaaggaaagaggaaaggaaaaaagcaagagaggggaggagtggagagagagaggtggagagtgtactcgtgtgctgagggtgctatagcagagtactgcacactgggtggcttcaaaacagacacttattttctcacagttctagaggctaagagtccaaggtcaaggtgctggaagggttgatttctgaagcctctctctgtggcttgcaggtggccgccctcttgctgtgttctcacgaggcctttcctatgcacttctgcctccctggtgtctgcctgtccaactctcctcttcttatgaggacaccagattggattaggtggcctcattctatcctaatcacctctttaaagaccttatctctaaatatggtcacattctgaggtactcagggttagggcttcagcatatgattttttttttttaaatgatgagtgcacagttcagtccctaacagagagatgaaagaaagggagaaagcaggcgtgtagagacttggggttacaggagaacaggggtgccagcagagggaggagggagtgggtcgggcgagcagtccactcagactgttgttctgaaaaacccacactagaggcatgttcagagaacacggggccagcctcacccctgtcacccctaggtgctgagccgtaggtcaggaagtgtcagggacagcggggacccagctgtctgttaagtggtggaggctgtgcataccctgcacctgcacccctgggactgctggcaggagtcccgggtgcaggaagctgcccagccagtggcaggcaccccaaaacacagcccccaagcacagcttctcctgggccccgggtcccaggtgggtgtctctctacaagcgaacagtgggaggcagctgctctgagtgggggctgctgtgatgacattgggctgccacctgcctcctcacagccattccaagaagggagttgctgcagccctcatttctcttggaggttgccaggcctcataggattgaagggacttgcccgacattgcacagttgtgagtggaggagctaggacttgaacccaggtctcatccagctgagtgagacagcctcctgccctggggccactcacagtctccagtctgccatcaaagattccccacctcctagctgggggacatggaccccctggagaagtgatagatgaaacctcatcacttcttcagttctgctattctaaaccggcttatgcacctgcactctgggccaggcaatgacgaggaaggcagatggcagctttgcctccaggagctcacattctgctggggcagtgactctgggatatgtgtcactgcaacagtgatatgtgctgtgaaggagaggctcagggtgctcagaagagagtaacgaggatttgacctaatctgggaaatccaggaaggtttccctgaggtggtgacatttgagctgagacatgaaggaggaacaggacttaaccaggctgtgagggcaagtgatgaaggagctttcctggtcccaggacccactagtagggaggctctgtcatgggagagggccctgtggattgaaggaacttaaaggtttgtgtgcttgggtcccaaggagctatgagatgaggctggaaagccaggaggagcccgtctatgcccaggccacatagccttggtcaggactttggtctgtattccataggaagaggacagtggtgacatgatgcaattttctgttgacaaggattgatcactctttgggatatctttaggcaggagagaggtgtagttcctgcaaggggcccatagatgcttctgaagctgttaatctactgtttgacctgcatggggattacttagtgtattcacgttgtgataattcatctagttgtatatttatgatttgttcgcctttttctgtgtgtattatatttgaatttttaaaatagttttaaaaaatgaaagtcactctagaagcaaatgggtgtcctagttagaagatttaaaggttgtcctgaagaaagatggtaaaagcttggagcagggagtaggcagggctgatgaagtgaagctgatgagaaatgtgcagaagagaaaatagataacgagttgaagatccattgcttggcaggggatgacgccccgtgtcaggcttgtgcaatctgattgagtaagatgccatcccttgtggaagggagcatgggccagagtagctgagggactgtttctgctctagaaaaaggaaaacagtgctgggcgagggccctggtagggctgagttggatcatcgcagatgtggcctgtggctggttgccctgggaggcccagtgctgacatgctgatgaggctcctgcccaaactccagcccctcagtggctcatttgcacagctcccttgggagcacagcctttcccagttgcaacctgacatctgcacccagctgtcacctgccccagaaggtctctatcctggcttccagcaaccattgcaacttggcagctattctgagctggggaaggtggtggtgaagggggcgggttgtattgtccttctagatagagctgaagaacatggctttttggccttaagaatttgctttagtttctgattccatgaagcttcttggggaaaatctcggctctttgtgttattcctgccctctctatgtgcttgccttttgtccactttaatacgtggtagtgaccctctcgagaagggaaggaagtcaaggggagcaggcactggaactcccttctatgcagttggcttccccttaaaccccaacagcttgggggcctgcgggtgggacagtcattctttgccccttaaaaaacaatggatcaactaatacgtgttgagcacctactgtatactaggcactgttctggaagccaaagatgtatcagtgaaccaaacagatacggaccccacactgcttccactctagaggggaatggagagacacaaagtaaaaatcaactggataagtaaataaattatatatgttgtaaggcagtaagtgatatgaaaagaaaagaagaggtatattaggataaaaaggtcagggaatgtcagggtgggggctgttgtaattttaaataaggtagtcagggcaaagccttgtggagatggtgagaacatgaaggtaatagtaacacaggaaggacagaatccatgaaatgtgccacacacatggacaaccaacatgaacaaaatatagctgctgctttgtttaaattttgttttaatcttaacaggcaatacacgtacatgctcttgttaaaaaaaaaaaaaaaggaatgttcaagggctgggcgtggtggctcacacgtgtaatcccagcactttgggaggccaaggcaggcagatcacctgaggtcagagttcgagattggcctgaccaacatggcgaaaccccgtctctactaaaaatacaaaaattagctgggcatggtggtgggtgcctgtaatcccaactactcaggaggctgaggcaagagaatcgtttgaactccggaggcagaggttgcagtaagccgagatcatgccattacactccagcctgggggacagagcaagactccatctcaaaaaaaaaaaaaaatggaatgttcacctggaacacacccctccccttttgcaccccatcccagtgtaatctctttggtctgtatccttccttttttctgttacagacatttctattaggcggtgagcgtgctgacttattttatgtcaactatcctctacagcttgtttgttccacctaacaactcttgaacatctccccacgccagcccctatcaacctacttcattctttttaagtgctatatcatctgtcactttataattttagttatttttctgctgatgaaattttgcttatttatagtttctttgctgttacaaacagtgctgcaaggaacaaccttgcagtttcatttttgtgcacgtgtgcaaatagttctctaacataggtcagaagaagtagaattactagatcagagaacagttatttgtaattttttttattatactttaagttctggggtacatgtgcagaatgtgcagatttgttacataggtatacacatgccatggtggtttactgcacccatcaacccgtcatctacattaggcatttctcctaatgctatccctcccctagccccccaccacccaacaggccccagtatgtaatgttcccctccctgtgtccatgtgttctcatttcatgttcatctcccacttatgagtgagaacatgtggtgtttggttttctgttcttgtgttattttgctgagaatgatagtttccagcatcatccatgtccctgcaaaggacatgaactcatccttttttatggctgcatagtattccatggtgtatatgtgccacattttcttgattcagtctatcattgatgggcatttgggttggttccaagtctttgctgttgtgaatagtgccacaataaacatacgtgtacatgtgtctttatagtagaatgatttataatcctttgggtatatatccagtagtgggattgctgggtcaaatggtatttctagttctagatcctccctatttaataatggtgctgggaaaactgtctagccatatgcagaaagctgaaactggatcccttccttacaccttatacaaaaattaactcaagatggattaaagacttaaactaagacctaaaaccataaaaaccctagaagaaaacctaggcaataccattcaggacataggcatgggcaaagacttcatgactaaaacaccaaaagcaatggcaacaaaagccaaaattgacaaatgggatctgattgaactaaagagcttctgcacagcaaaagaaactatcatcagagtgaacaggcaacctacagaatgggagaagatttttgcaatctatccatctgacagagggctaatatccccaatctacaaagaacttaaacagatttacaagaaaaaatcaaacaaccctatcaaaaagtgggtgaaagatatgaacagacacttctcaaaagaagacatttatgcagccaacaaacatatgaaaaaaagatcatcttcactggttatttgtaattttaatagatactgccagcttgctctcctgacttcctcttgagaatataaacacattatacatacagtttctttctaaatgggaccatacagtatataacttttatctatctgattttaacctgtaagatatcagggatattttctttcaaacaggcctctggccttcaagtgaggcttattgctttctctccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaagagggaggggtggctggtcagcttgagataggggcacctaccacaccccttcctgcagggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttatctggtttggcagctctttattgtgtgtttgttgtaatgtcctactgctcagattagataggattcatgacgtggacttcagaaagagttcccacaaggatggtcagttcagcctataaagccttcatggtggaccctgagccacagcaaagcctatgttttcctatgaccagtagagggggctgtttgtctttacacctggacgcaggctgcttattaaaggcctgaatgatcctgagattcttcgatatgttttttctcatcctacactactgcatatagaagacagctgagagcctctgctcacctcctcatcttattaaggcaagggatcatactttaaagaggggagacacttgccccaggtctcttgggctgggtaggcaggcacagccagggataaggttgggtgtgctttctgattccagaaccctgcgtgatatcacagctcgtattcattagtgcttcccagtccataaaaggatcccacccttattctctcattgatccctacctcaattttgaggttctctcagagagatggaggattaataaccatgatcgaaggtaacagttactcagtacagtcggccccccatatccgtgggtttcaaattcatggattcaaccaacagcaggttgaaatatttgaaaaaaaaaaagtacaaccataaaaagtaatacaatttaaaaatacggtataacaacgatttacacagcatttacattgtattaggtattatagaaatctggagatgatttaaagtatatgggaggatatatgtaggttatatgcaaatactataccattttatataagggacttggccatccttagattttgttatccatgggggtcctggaaccaatcccctgcagataccaaggaacagctgtatttaacatacgtgagccactcactgcatgctgtttacaaataaggattatctcgtttaatcttcacaaaaaccctgagagaggcttcttgctctctgattttacttttttttttttttttttaagacggagtctctctctgtcacccaggctggggtgcagtggtgcaatctcagctcactgcaacctccgcctcccgggctcaagcaattctcatgcctcagcctcctgagtagctgggattacaggtgcccaccaccacgcctaatttttgtatttttagtagagatgacctcaagtgatccattcgcctcagcctcctgaagtgttgggattacaggcgtgagccaccgcacccagcctgattatatttttctaacctctcatggttatgaggttgcctatggaccctaaagacatctaaacacaaatgctttcactactaacatgcctgctcatgaaattgcttcccactcacacatccctacctggttaagaggccactcttcccctgctgtcagccagtctctggggtgatgctcacgtgttggtcactagcataatggagaaagcctggttgggcagaccctggttgaagtcctcactctgcttgctactcaatagataagtgggcctggataagttccagatttctgagtctcttcactatacaaataatatacctgcctcaaaagtgtcgtgatcatcaatgaaattctgtatgtgcaagtccccaacagggcctgtcgcaggctatgtgctgagaaactgctgactacatcagtttacagttgctttgcttaacatgcagagttctattaggatctgccttgcattgagtgctggtccccaggagagtttgggcaaggaaggactgtgatattgttccttcaatcttttctttttcttttattcttttagtgcgtatgatgtgctaggcactgaggataagcagtaaatcaaagccaactctcatgaagcttatatccagatggggaaagagcacagatcacaagaaaataaatgaataaagtagtagcagattatgcacaaggcacagtggctcaggcctaaaatctcagcattttgggaggccaaggtgg

SEQ ID NO: 17101 - DNA, 51835 bp, Human
  misc_feature (1)...(51835): n = A,T,C or G
aggggcccaggcaaagtctccaagtacccagtcccctttcttcagccttgcccacaccctcagccttcctgttaatccaggcgacccagggttacccagaggtccaggtcccagttgttcacttgagcatctgatgtaccccaaacacctgtgtgaaacgctctctgtccaggatgcgtccatagcgcagggtgacgtagaaggtctgtttcccactgtaccgctggatacgcacaaacatctcctgaggccggtccttggtttctgtcaggggaatcacatctgccatgggacagtatgtgtcctgccgccagccccagaagttcagatgggccacccgcagcatggtgccagactcattcagatacaggataccaaccagtctccgtaagaaatagctcatccagcacagcatggtcagggcaaagcccgatatcccactcatgaggcacacggtgttgagagtgaggaggccctgggagtacaagtaatagcctggtggcaaagctaccactgtcagggcagtctgtgccaacttcagtcgtgacaggaacccgaaggttctgatggcatcaaaacggtaaaacatccagaatttctcagtctctgcgtttggtagtttctccttcgagatgggtgaactgctgcccacccacctcttaggatcctcctgcccactgcagcaccacagcccatggagaggcctttcccacacagcttttccccgaaacctacgcacagctcggagaagggcagcctgaaagggagacagtagaccatttctctcatggaactcaaccacattaatcacacggtgaacatctgcaaagcaccatactctaaggcttctgccaatcctgcaaggtaaccgttattgccagacgagggaagggtaaagccagatgctatctcatgtgggcatcacaacagctatctaagatagttatcactatttccactttaccactagggaaactaagcccagagagggtaagatatttaccaaagatcacacagtcagtgagtgcagcagagtcctccttccaccaggcaattccaaataaatacaggaaaggaggtgcggccgtcattaattcaaaacatatccagggaggacaaactctgggctggacaatgtatccacaagggggtgtgaacatttccccaagcaggaaactaaataatcagtgtcttagtggggaactcgagcaacaaatctgtgagatatttattccaataaactttctaattctctgtttgattcatatgctatcttgggtgctggagggaactgctgctttctcttagcctagtctggggaaggggaaacagcggagaaggagaaggagcgaggcagggaggccccaacacgtagcacaagggtattactaggtgggtagtgaagcagtaaaagctcttattccaattctggctccaacagtaatttgtgagcaaattactccacacccctgagattcggtttcttcgcctttcaaaatggggactcagaagacagtgaaccagaggatggtttcagagtcctcaacttagtacctaatgcactgtgagagctcggcgagttttagctactactactgtgcgcatgtgacccaaggagggcagagaaagcccgggaaaagcgaactgtaacacacgccagagcttcctcccacggatcctcggagtccgaaacccgagcgtcgggcctgcccgccccagccctgaccccgaccccaaagagcatcaccccctcaaggctcgccacccgcctccttaccatggccccaccacctgctgccggaagtaaatcccaccggcccccggaacccctaagagcgcatgctcgaatgtacaaggcgggcgtgatctgcgttgcaccctgggagttgcggtccaggaatcgtggctgccgctactcccaggcgttatgggaacggagtcccctcctcttcccgacgtgccctgcgactcagcggccgaacccggaagttccgggccgagttcctcgtgccaacgtgtcttgtaaggtgcggctagaaactggggacatggcagcgcctggcccagcgctctgcctcttcgacgtggatgggaccctcaccgccccgcggcaggtaagtggcggccggcgggctgctggcagccgacgcggagcccgtgctgttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgccggccccaatcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggactagggagatggaggagccctaggttattacaggctgcccgctgagagcctctttgggcccttggaaacttgctttccactttcagattttgctgctacaggcacagataagtttcagttacgatcagccttgaggtgaggctctcctggccccttttcagaaattggccactgaacactggccatttcaacttgagactggaccccaatggtctcactatcctcagcttctaccctcacccctcatagttttcgcttggtggtaacaatggtgtgctccagaagtccaggtcaaatgcgtgtgaccttagacgtatcattttgcccttctcagccacaggtttgatttacctagtgatgacgctcaactcccaagttcttcaaaggctttttctgattctgaaattcagtgatcacacacttgggtttgttaaaagcccatagtggtctaaaactccggtccccaattcattttttgtaaagggccatatagcaaatacttctctgtctttgctgactatgtggtctatagtaaccactcaactttagtgcaaaaccagccataaaccctatataaataagagtggctgtgtaccaataaaattttatttatttattacaaaaacaaacagctgcccaatgtggtctgtgggccatagtggtctagggtttacattgccaccctttttcatatcactgaaccctctcaaccttcctccatctttcttcccaggtaggatagttgttattaccgttttaaacataaggaaacacactcagtgaagaactaacctcctcagtttcacacagccaacctggtacaagtctctgggcctcaggatattggttcctgtcaagtttgccatttcctatctgtgctaaggtggaagctgttctagtcactgggtatgccattcaggaaagtgcttctgattttctgattttcacagttctgactctttttttttttttaagacagagtctcactctgtcaccagactggagtgtagtggcccaatctcagttcactgcaacctccacctcccaggttcaagcaattctcctgcctcaggcaaccaagtagctggtgctacaggcaggcaccaccacgcctggctaatttttgtatttttagtagagatggggtttcactgtgttggccaggatggtctctatctctggacctcgtgatccacccgcctcggcctcccaaagtgctgggattacaggcgtgagccaccgtgttctgacttttaaaggccactcctccaattctagattctgtctaataggtccagattccactgtgagagtagaaaagattgcactctattacaaacccttctgtacaattttaatcacattcatgtattactctaaaaaagttttttaaagaaaaatcattgaactccaagtgtttatatactgaggttgaattaaatggttttttgtattttctaaatttctagtaaaaagatattcagccgggcacggtagttcatgcctataatcccagcacttggggaggctgaggcgggtggatcacttgaggtcaggagttcgagaccagccttgccaacatggtgaaacccagtctctactaaaaatacaaaaagattagccgagcatgatggcgggcgcctgtaatcctggctacctgggaggctgagacaggagaatcgcttgaacccaggaagtggaggttgcaatgagccgagaccacaccattgcactccagcctgggtgacagagcacgacttcgtgtcaaaaaaaaaaaaaaaaagacattcagtgtaaatgtacaactgagattgctcaaagtgctgagttataagacttgtaaaaatacattgtgatgtgtcttaatgtagggctattttttcatcttagtttataacttttttaaaattatcacacagtttggaatttaccataagattataccactaagaccactctttctagataggagctttgcttttagaagagactaaaaaatctagttatcttactcttttacatttttgttttgttttgggtgattgcaataaaatcaattctaagcttctcctttttttttttttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaaccaaagtccctgcacaggacatgattccatttatgtttcaaaaataagacctatttgtatatgtgcccatagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttgggaggccaaggctggtggatctcctgaacccaggagttccagactggcctgggcaacatggcaaaactttgtctctacaaaatataaaaaaattagccaggtgtgctggcacataactatggtcccagctactcaggaggcagagataggaggatcaccggagtccagggaggtcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttagaaaattaccaaagaaatggatgacttcctacaaaaattgaggcagaagatcaaaatcggagtggtaggcggatcggactttgagaaagtgcaggagcaactgggaaatgatggtaaatgatgggttgctaattacatctggtaaaagattaacttcttatgaggatattgttgccaagtatcataggctgccctaaaaccttgtccccatatggcgggctttctgcttccttttttgggaaacattttcttggcctttgcttttcctctgcttttaatccagtacatttctggagttactgatggagaactgggtactcagatgtgtgagtagattcacctagaaaggtcagtggctgtatctgcacatgataatctctctgcctggaatacttcttgcttgtacccgttgacagcccttctagccccagtcagaccgatcttcatattgtccctctgacagcccccctcacctccccatcactgaaacagaatctccagcacaggaccccgaaaaaccagagaggcttattgaccccttcactggagagtctgacttgataggtctgtggagcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgcatctagttgtgtatttaaccacttgctcagggaagttttgtgtagtgtagcatagtgtctgcacctgtcagagacatgcaacaatagaatcaaaacattcacaggccaaaagacagttgaaggcccacctgtatcagaatcacctgggaagcttattaaaatatgagtgtggggtccccacccaacacataggggatctgcattttaacaggtacctgaagtttgagaatcccttcattaaggttgacaacatggatagtttccaaaccaaactgattataagaatcactgaagagctttttttaaaatttattttatttatttatttatttttatttttttgagacagtcttattctctggtgcagtggcacaatcttggctcactgtaacctctgcgtcctgggttcaagtgattcgtgtgcctcagcctccgaagtagctgggactacaggcgcccaccagcacgcccggctaatttttgtatttttagtagagacggggttttaccatgttggccaggctggtcttgaacttgcgacctcaggtgatctggccaccttggcctcccaaagtgctgggattacaggcatgagtcaccgtgcctggccaccaaaggtcttttagtgctttgttttttgttttttgggttttttttgttttttttttttttttttttgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcacccgacccaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacaggtaggttcttgagtatctgaattactatatactattaaaagtgttttctaaaagggcatttcacaatgaatgcctctaggaagatgaggaacgggtagaaatgaatctttactctgtattttttgttttgcattttgaaccatgtgactattacatattctacattgataactaaatttttatactttttaaatctaatatttctctcttttcttattttgtttttgagacggagtcttgctctgtcacccaggctggagctggagtgcagcggcacgatctcagctcactacaacctccgcctacctccgcctccctggttcaaacaattcttacgcctcagcctcccccatagctgggattacaggcacacgccaccacacccagctaatttttgtatttttggtagagacagggtttcaccatgttggccaggctgatctctaacccctgacctcaagtgatccgcccacctcagcctcccagagtgctgggattacaggcatgagccaccacacccagccttttcttctttttttaaaaagatggggtcttgctgtgttaaccaggctggagtgcagtggtgcaatcccagtggcctagaactcctgggcacaggtgatcctctgcctcagcctcccacgtagcagggactaccggcacatgccaccaagcctggctttaaatctattaataacatttctatgatgataaaactagagcagactgcttcactataagcatttttttttttcttttttcttttttcgtggtggaatctcactcttgcccaggctggagtgcagtggctcaatcctggctcactgtaacctctgcctcctgggttcaaatgattcttgtgcctcagcctccctaggtgggattacaggcatccaccagcatgcccggctcatttttgtatttttagtagaggcagggtttcaccatgtttgccaggctggtctcgagctcatgacttgaagtcatccacctgcctcagcttcccaaaatgctgggattacaggtgtgagctgccacgcctgggcactataagcatttttaagaggtactgtgtagctcttagtagtagtaagatcattctattcagacataagagaatgccgaagtggaacaaatatattgtctgtcaatatctggagatattttaattgaataaaagtggcagcagtaagctctttggaccttacaggaagcatttgaacaataatgagtacaaaaatcttgggtgatgaagcagaaaatgcttttgactaaagcttttctggcttgcctaatgcttttgaccagagaaataagagaaggaattaaacagacagtggggcatgtcaccatcactgctacatcagcctactgattttcagcaatcgtggctgaagaccctgggtttgctatgaagctgttttgaaaatgctcctgctaaatcaagtaactcaagtattttcttcatctagaatattcaaagtcatctgggtgaggccctaatccaagatttaatcaactactgtctgagctacattgcgaaaattaaactcccgaagaagaggtgggtttgcttttaacaaagaggcgtcacaggaacatagcgtagtgtcacatggtgggctaatgtgggcattctccaaataggattataaaaatcacctaaagagttttaaaaacaaagtctgatatttagcccgccccttggcaattctggttcagaaagcctgagagccgagcttggaaatccacattttctctggctgccctggtgctgctggttcacagcagggttcagtagccaccatgggccagcgaatttaaatccgaatcccagcacttagtaaggaataattggaaacagtccacaaagccaacagtacaagaatgattacgtaaatgatggcttatccacatgatggaaatttatacaaccattgaagaccatatgctttcaaaggctgtcagtgagaggaaacagcagtgaagcagcatgtacaaaaagcaacagaaaccctagatcgggaagtctgagacaggaagccttcgggccagatccacgtaaaacccaaatctggttggcctgcagtgttaaagaaaatcggattaattgccatcatgtaaaagtctgattttatgtttgttttatttatttatgaatttatttttgagaccgagtctcactctgtggccgaggctggagtgcagtggcaggatctcacagctcactgcaacctccgcctcccaggttcaagcaattcttctgcctcagcctctcgagtagctgggattataggcgcacaccaccatgcccagctaatttttttttttttttgtatttttagtagagatggcatttcactctgttggccaggctgatatcgaactcccaacctcaactgatccacccaccttggcctcccaaattgctggtgtcaaaggcgtgagccaccttgcccagcctgattttatgttttaaacatctggatttctggcttctgttggcaaatctgagacctggctactccggctcccagttacctgccggcaggtgccacctgagcagctgccacctgactcatagacatttgttccagtcacagactgcttctctcattttctgtctccctaggctttctttttgtttttttgttttgttttgttttttgagagagaggatctcgccctgttgcccaggctggagtgcagtggcatgatcatagctcactgcagcctcaacctccttggctcaagtgatcctcctacctcagcctcctgagtagctgggactacaggcacatgccgccatgcctgactaattttttaattttttgtagagatagggtcttgccatatggcccaggctggtctccaactcctggcctcaagcgatcctcccacttcactctcccaaaatgttgggattacaggcattagccactgcccctggctttcataaatgtttggtttggggacctaccttctgccatgggtacaattatctcagttccatttttaaaataatagtaatactaataatgatgaacataaatgccgacagtaaatttaaagactggcaggaaatagacccaaatgttaacagtggctatttcttgatggtgaggttgcaagtgatttctttgaaatccttctcatttttacccccagttttcaacacttactatgtaacaccttaatcatcagggttggaattaagtggcaattcaatttcagggctgggtgtacttcagaggctgcttcacactattaggattcataacctgagcgcctcctgctcagcatctccagccagagtgcaggaatgtcccttagccgagggggaggcctgcatgagacaggctggacatggacttggttattgttgcagctgggtaatgagcacatgaggacttatcctattctgtttacttttgtgtgtgttagaaattttccatggcgaaaagataaaatatacaaatatcccaggtcagttccatttttactttgggctgagcactaagggaggatttaaaaaaaaaaaaggcataatcctgtcctcaaagagcgtatcatttagcgagggagagggatgtggagagccataattccagaacagtagaagagacctggtgaatccaggaggcagaactgagacccaccttgatccacatttgtccacatttgcctgacaacactaactacatgccccacgacggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaactccgggacggcctggacatgggattattgagagagatttttaggctcgcatattttgttacatcatttgcctctttctctgcaagttgagcaaaataggagagaggatccagacgattgagattttgctgtttttactttaatgagtattcattgcttcccagtttacaaagtacctttacataactggcatgtttgatttttaacaaggccctttggaggtaaccagagcaagtgccattagcctttctgtaggtgaataagaggaggcttggagaggtgcccagagccacacagcctcctaagaggccacactgacatggaatcaggtcatcagccctgcacgtggcatgtggtctctcggtatttccaatggccaatgcccaggacatcaggtctgtgagattaaaatagtagaaaaaaatgagggaaaatgtttcataagggttcccaagcatcaacgtttaaaaactggaaaaacacttttcactgcatagtttgtcaaaaaaatgcttaaaatttcattggtcagaatgatatttactttacaagttatctgaccttttaaaaaattgggttggtttcttttttttgctgtggggtttttgttggtttgcttgttttgttttttttgagacagagtctgtctcccagactggagtgcaatggcatgctctcagctcactgcaacctccgcctccgggttcaagcgatcctcctgcctcagcctctcaagtagctgggactacaggcatgcgctaccatgtcccgctaatttttgtatttttagtagggacagggtttcatcttgttggccaggctggtcttgactcctgacctcaaggaatccgcccgccgcagcatcccaaagtgctgggattacaggtttgagccaaagaaactgttttcagactcaaactggaaaccgtggaaaaaaactctttgttttttgttttttattttttgtttgttcgtttgttttttgagacggggtctccctctgttacccaggctgtagtgcagtggtacgatcttggttcactgcagcttccactgcccgggcccaagcaatcctcctgtctcagtctcccaagtagctgggaatacaggcatgtgccaccatgcccggctaatttttgtattttttgtagaaacggggttttgccatattgcctaggctgctctcaaactcctgagctcaagccattcacccaccttggcctcccaaagtgctggggttaataggtgtgaggtaccgcgcccagccaaaagaacatctttaaacatcgtcatttgaagtgactaaactaatgttagcttctcattttctgtgatcaaatcaaacatttaggagctgtctgctactgggtaaattgaatttcctcagttattactgaggctcgttggacaattctcagagcctttttctgtgtagctttgcttggtactatcagtctgttcagaagctccgtagcaaaatagatgtctggtacatgtattttcaaactcttcagggaaatgactgctgttgccagtgctggaaatcattttcatagctctttattaaccacaaaattatctgcccagtagcagcactgtgcaacagaaatagaaagtgagctatgtataattttaaattttctgtagccacattttgaaagaatgaaaaggaagaggtgaaatgaattttaataatatattttatttagcctgatatttctaaaatatgacttttttttttttttttttgagacagggtctcactctgtcacccagactggagtgcagtggtgtgatctcagctcactataacccctatctcccaggctcatggaatcttcctgcctcaacctcctgagtagctgggattataggcatgcataaccatgccaggctattttttgtattttttgtagagacagagtttcgccatgttgtccaggctcaaaatatgagcattttaacacaaagtcaatatacaacatgattgatgcaattacattcctttttcatactaaatctttcaaatctaatctcaattcatattagccacatttcaagtcttaatagtcacagtagttcatggctaccatattacatagcacagagctgagaaacattgaccacactagcctctgctttttagaatttcccaagattttaggctgtttatctatgatgttgcccaaatgaataacgtgtttttggagaaactctgtcaccctttcattcccaggggtactttcattgaattccgaaatgggatgttaaacgtgtcccctattggaagaagctgcagccaagaagaacgcattgagttctacgaactcgataaagtacgtctttctgaaatacctttggtgaatggctgggtttatggaaataagatatggcctggtgtggtggttcatgcctgtaatcccaacactttgggaggccaaggcaggaggatcacttgagcccaggagttcaagaccagcctgggcaacatagtgagacctcatctctacaaataataaaaacaaaaattagctgggcatggtggcacacacctgtggtcccggctatttgtttggctgaggtaagaggatcacttgtgcctgggaggttgaagctgctgtgagctatgatcatgccactgcgctccagcctgggcaacagagcaagacccccatctcaaaaactaaacaaataaataaatcaataagataatcctacctttgtggccagtagttaaaactgtgctttctaaactgcaatacaagaaacaattggtatctttttgtttttctcagaaagaaaatataagacaaaagtttgtagcagatctacggaaagagtttgctggaaaaggcctcacgttttccataggtattgtatatattgcctgtgttccaaacttggatacccatttcccagagtttgttgtgggccagtgagctattgataatgaagtatgtgcagttttaggtgggcaggaagattaaatgagcagtccagtctatagacaaaaaccaaccactctcttttctgcataattagccataataggacttgcctagtcaagaaacagcttacacgctgttgggcttggttctaaattcttacccaacagcattcttcctacctggactcctctcatcaaaagaggagcactttgattactaaagagtaggaacttctcacacctttgggcagaagagaagcactatagtgaactccataagggagacatggaattgaaccccttaggtaaactagaccgatgttttggaatcatagaatgtttcaacagcaaggaaccttaggggccaattgggtggcttttacagatcaagaaactgaggcccagaaaggagaagagacttgtccaagttcacaaagctgttgtttacacagccagtgtgtgaacgtttctggtgtctaatgcagagttcttcctgcagcacggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccgcaaaatatgccggatgcaacctgcttccgggcatttccccctgagggtgtgttaaagcccgagacaagcacagcagaatgaggctggtatcagatttttcataagcatgcttcctttaaaccacacgcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtctttcctgatggatgggacaagagatactgtctgcgacatgtggaaaatgacggttataagaccatttatttctttggagacaaaactatgccagtaagtagagaagtgtttgtgcaccttcattgttgcatttgcgcttgatgggggaaattgacaactgggctgtttttcctgtacctacactttacccacccgccctgctcaaactgagcagtggcttctgtcctggagaggtgggtgattgagccaccttcccctctaagctcagaccccctacgcctctgtggaggcaaggatcacactgcatgttagttgaaccttttcaccttggctttggaattaaacgttggccaccctatgtgccttccagaataccagtccccggtgccactgtcaaaccctctgcgtttcaaagctctggctgtttcaacctcatttttccactgtatttgtccacccgaggcattcattctaagttgaacacgaggggccatgaacgatgggaggatagggaatgatctcatgagcctgaaacaggagaggacaccagcaacagcaaagaggccaagtgagtcccaggcatcacacacggcgggtgcttggagctgcccccaagggatgtcagaaatctcgagttcagggccaaatctaaactgagaactgagagcagagcccagtgttaaaggccagggccagcaggaggaatacatagaagaaatgcccccaggtgtcctctccgtggggcaaggtggatccccaggaggtcagagaggcgttgctgccatcaaaggcccaagaggaggctcatcaccacccagctttgggccagctccttttctttctcttttttttttttttttttttctgagacagagtctcgctctgttgcccaggctggagtgcagtggtgcaatcttggctcactgcaacctctgcctcccaggttcaagcaatccttgtgcctcagcctcctgagtacctgatattacgggcatgcaccaccacacctggctgatttttgtgtttttagtagagatagggttttaccatgttaaccaggctggtctcaaacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggccgcgcccagccccatcaccttttcagttactcccatcctctgggcccctctgcctccctcccacatgcaggctgggggtgttggttaccttgccatcagcaggcccgtgtcaggctttctcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttgtccaacagatctgtagaacttacacatcttacataactgagacattacacccattgaacaacaactctccatctccctcctccaccgccccgtccctggcaaccaccgttcttttctctgcttatatgactttagcacctttagatatctgatacaaggggaatcatgcagtattcatccttctgtaaggggcttattcactcagtatgtcttctcagtttactcatgctggcacaaatggcaagtttccttattttttaaggcggaataatgtttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgcctcagcctcccgattagtggctgggattacaggagcctgccaccacgcccggctaatttttgtatttttagtagagacagggttttgccacgttggccaggctggtctcgaactcctggcctcaagagattcacctgccttggcctcctaaattgatgggattacaggcgtgagccaggcgtgcccggtcagaatatactccattttcttgatccattcttctgtcagtagacacatgagttgtttccgtatcttggccattatgaataatgcttcagtgaacacgggggtacagatacctctttgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaaaaaacaatttaaaacatgagcaaaggacttgaatagacagttctccaaagaagacatgcagatggccagtgggtatataaaaaaaggctcaacatcagtgttcagggaaatgcaaatcaaaactacaatgagataaacctcacacctgccaggatggccattttattttattttattttgagacggagttttgctctgtcacccaggctggagtgcagtgatgcgatcttggctcactgcaaccactgcctcctgagttcaagctattcttatacctcagcctcccgagtagctgggattacaggcgcccgccaccatgcccagctaattttgtatttttagtagaaagtgggtttcaccatgttgccagcctgtctcgaactcatgacctgaagtgatccacccaccttgacctcccaaagtgctaggcttataggcgtgagccaccacactgggccaggatggctaattttgttttttttaatgttggtggctgggtgnnnnnnnnnnnnnnnnnnnnctcagtcccaggcaagcactcaataaatgttagctagcaatactataatcatccttttttggcagaataaggttcagagaactgaagtgacttgcccacgatcacccgtctagaaaacagtagagctgggtcattccactgcctccccaggggaaggacagaatatagaaaacaggccggcacagtggttcatgcctgtaatcccagcactttgggaggccgaggcaggcggatcacctgagctcaggagtccgagaccggcctgtccaacatggcgaaatcccgtctctactagaaatgacaaaaaattagctggggttggtggtgcatgcctgtaatcccagtcactggggagactgaggcaggacaatcacttgaacctgggaggtggaggttgctgcgagccaagattgcaccactgcacgccagcctgggcgacagagtgagactcttgtctcaaaaaaaaaaaaaaaaagaaaacgaaaactgtgcctctttaacaattattttttggttttattttattttttgagacggagttttgctctgtcacccaggctggagtgcagtgatgcgatcttggctcactgcaaccactgcctcctgagttcaagctattcttatacctcagcctcccgagtagctgggcatggtggtgcacacctgtcatcccagctacttgggaggctgaggcaggagaattgcttgaacccgggaggtggaggttgcagtgagctgagattgtgccattgtactccagcctgggcaacaagagcgaaactcggtctcaaaaagataaaataaatgttggcgagggtgtggagaaattagaacccttgtacactgttgtgggaaatgttaaatgtcatagctatgatggaaaactacatagtggttcctcaaattaaaaatagaactgccatatgatccagcagttccacttagagatatatatccaaaataattgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgctttccactacgataagctctctctcagtggggtagaaagatcttgttctaaatcccagatgaactgggtactttgaaggaggtgtagcattcaggtttgttcttaatggcagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactttgcagaatggaatgcagttcttggataatcagaaaatgacttattttgggaattcttcatttgggaattagagggttttctattctgtttaaccattgcattaccatgcctggattctatttttaaaatcttacctacgttttaaaaaatgagtattatttaatggaagctttcccccaattgtaaattaacctgtgcattcattatagaaaattagagaaagtacgaagaagaaaaagaaagtcacctataatcatccaacaatgtcccagcctttctatgtatatgatcccaaaagtgggatccttacatgttgttttagttttagttttctttctcttaacgtattttatttttatcatattagtgaatattctttgcaaagaagatttttttttttttttgagacagagtcttgctctgtcacccaggctggagtgcagtggcgtgatctcggctcactgtaagctccacctcccgggttcacaccattctcctgcctcatcctcccgagtagcttggactataggtgcccaccaccacgcccggctaattttttgtatttttagtagagatggggttcaccatgttagccaggatggtcatgatctcctgacctcgtgatccgtccgcctcggcctcccaaagtgctgggattacaggcgtgagccactgcgcctggcgcaaagaagatttttaatggctgtataatattctctcattaggcatcagttactcacctcccttgcagaggcacgttgggtggtttaaggggttttgctatcataactaatgctgtggtgaacattcttgcacgattctttgcccccatccctgatccttttcgtcagcggttttctagaaatggaaattagcagtccagccatgtaaaccttcaaacaacctatcagttcttgaaacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcttttcaaaatatttgccatcttcagaaaccctgtcattcttcccatcagccacaaaagccagtgtttcttaaaatctggctctgagttcagcatggaggccctgggcctggcatggagtaccttggtttgttgcagagagagagagacggcaagggcagagagcacacaccacacatggctctgcatggctttccagaaaccaccctggctggatcaccctcagccactctgaattcgcaggcaagagaacctgtacttacccatgctttctgtaaaagtcatcttggctttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctcttaaaaaaaaaaaaaacaataaaaattaaaaatttttaaaaattgaaaaaagggaggaaatgtaaatcttccagcacttcctcagtgtcagaccctgagctggacacttatgttgtacatgctcccaggggagacagcagcatcctccctcttacagaggaagcacagtgggaagtccagggtctcagctagtcagagactaagctgggatctgaaagcctcgcctctgtcattctcctacatcgcttctaaaatgctacctgccttccttttaagtaaattgtgcaacattttattctccagaaatgttaataaggaagatctgcctttaaaattagcttaaaaatacaaaaattagctgggcgtggtggcgcatgcctggatcccagctactcaggaggctgaggcaggagaagcgcttgaacccgggaggcggaggttgcagtgagctgagattgtgccattgcactccaggctgggcaacagagtgaaattctgtctcaataaacaaataaagaaaaacaaaattagcttaaaagaggtttgtatcagtgtggaccatgttgacccagatctggccccaccattcaccagtgaccttgtgacagtgaggacagtgacagtgacctcgtcagcccagtgaggacacagttcttctttttttttttttttttcctgagacaaggtctcactctgtcacccagactggagtgcagtggcgcaatcttggttcactgtaatcttgaactcctgggctcaagtgatcctcccacttcagcctcctgagtagctgggattaccggtgcccaccaccacgcctggctaatttttgtatttttagtagagacggggtttcaccatcttggccaggctggtcttgaactcctaacctcaagtgatccgcccaccttggcctcccaaagtgctggaattacaggcgtgagccaccactcccgaccacagttgctcttctgaaggagtcatatgagaatgaagtgaaggcatctgaggaaagtgggtgacgcagggcctgactcaggaaaggcagctgggacatgcatctttggcctggtccacaaccagcgtctgcttccttcactttctaagaaagttattcaaaggctcatctgttattgagattttcctaagagattggagcctgccaagtccctcagtgaagggccatccttgtgagtgagcaccttcctacacaccttccaacagttcattagagcgtgaattagtgaaccatgtcctcctgtcctcaggttccaagttaggctttggatggcagttggcctttgcgatcctggacttaaccatgcctagcatctgtagctctttcaggactcaaggctaaggagggcacagaatggattctgtggatagatctgtcttactacttattgctgggaccacatgatttgagacccaggtcttcttgtgtggctggtggcagacttagcttcttaacatgtgagtccctcactcctggagggaccctgagtgaattgccgctcccacagtcagcttccagaactgactggcagaaattgatgagaggttctcagcctggtggagatgtcccacccgctcctgtgtgggaggccaggaagcagggtgtcatgcatgggagccacgagcttcagatgttcctgctagcccaccttcctcctgagtgccagactccacagagtccatggccctgggtgttggtcccaagaataggactgtggctaacaaccagcccacagagtgagcatccctgcctgtgtctgtgctgaagctctttcattcagggagacactggcttcaaacccctggagtggggctggccttccagggagccccttgatgtccgcagaatcggcatctcctgtgggcattccaggcccagatccgtcacagagctgtctcctctgcccttgaaggccggagaggtgaaatgagagggctgtgctcagagccgtcaacagacccaagggtcactcgccctagggccactagccccttggccagctcaggttccaccctcgcccccaagccaaggggtgttttttcctagattctaagtcactggtgctcagccctggatatatattggaatcacctgatcactttcaaaacatcatgaccctgggcttgggccatgccccaaacaagcatttttaaggcatccccagggactctagccagggagagccactactgctctacgccatttcagagcaggctcttgtctcattggccctgtaactgcccaacaggttctccttgcccactgcctagacaagagccgatttatcaagacaggagagttgcagtagacaaagggtaattcacgcagagctggctgtacaggagactggagttttattattcctcaaatcagcctctccaagaatttggggatcagagtttttaaggataacttgctgggtaggggcttgggaagtggagattgctgattggtcggcttggagatgaaatcatagggggtggaagtgagtttttcttgctatcttctgttcctggtgggatcaaagagctggttgagccagattacctgtctgtgtggcatcagatactgcatcagaacacagggtctacaaaatatctcaggcacaatcttaggttttatgacagtgatattattttcaggagcaatttggggaggttcagactcttgtagctaatttgttagtcctacaaaggcagactggtccccaggcaagaagggggtttatttcagggaaagggctgttaccggcattgtttcaaagttaaactataaactgaattcctcccaaggttagtttggtctgcatccaggaatgaacaaggacatcttggaagttagaagcaagatggagtcatttaggtcaccatcataattttctcagttaaaatttttgcaaagacagtttcagttcctcctgttgggttttataataccttattcctaatacttcatactgtgggatatgaagatgggaaaagagtgataaccgctctagcttctttctgctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttagacagacagattggggtagacaggaaagaggaaatttaaatatactcatccttatctttttagtcagttttcctagtcctaagactagatcagttcagttaaacagctgtttccattatcaagagatggcactggagatgggctaggcatctttagttatagaggaggaaggcagtggcaatttgacatgtttttgtcatctgtattacaaagaataagcttcagcttgcagggcctcaggaaaaaggtagtagcaatttaattgagtccaagtcagaaaagtgggaaaaaaaaattgaaagcattagtttgggaattgtagcccacagagaattcaggatttagtccaaattgcaggaaataataaaaactcaagaacaaaggacaagactagaatctaacagcagggtgtatcatagttttttgaaacacttttttccctctcccatccttatttttattaaagacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttctcatggtcctaagataatttggggctcctgggcctgtcaaaaagtgacagtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggcaatatgctctaaattttgctcacagaagtatactttaactcaattgttaaagttataaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagcaactgcctgtgggtaacaaaagtctcaggacagccgtagttaaagatgcagtcaacaaggaaatctggtcatctctgtgacacacagtttaacagaacagttataattattactcataacatatactgagacgtatcagaattataggagtcttacacaattttgtaacacatactaataacatagttatacgactataaacccaaagaaagttaaacacttttttatatttgacagtgcttcctacataattttaatacaccaaataagccaaatatgcctcttttggactttaggggactttttttttttaacttagaatttgatcttgggaagtttgttaaatatcaaaggtttgaaacactagatatcacaaagtagaatcccaggtcaccataagtaattcatttagccacaatgataactcaaacattttgtaacaggaaaaacctttactctgatagagagaagactcagctttctaaacaacaaaacccagtgaagatagcatgaggccaactgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgtcattctcctgcttcagcctcccgagtagctgggactacaggcgcgtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccactcctggctaatttttgtattttttagtagagactgggtttcgccatgttggccaggctggtcttgaactcctgaccccacgtgatcgcccacctcagcctcccaaagcgctgggattacagttgtgagccaccactcctagccaaagctagtttttaataaaattttacaaacaaatgtatccgattttagtttgactgtagggtaacattttcataaaccttttatataaccctttataattgtttgttaacaaatcagtgttcaaaaataaaacactattttttttttttttttttgagatggagtcttgctccattgcccaggctggagtgcagtggcacattctcagctcactgcaacctctgcctctcaggttcaagcaattcttctgcctcaacctcccgagtagctgggactacaggcgtgtgccaccacgcccggctaatttttgtatttttagtagagacaggatttcaccatatgggccaggctggtttcgaacttctgacctcgtgatctgcctgcgtcggccttccaaagtgctaggattacaggcatgtgccaccgcgtctggcataaaaccctattattttgatatatgggcccagattctggccctgcatcagtatgcttttaatatttaatttatggaaaaaattaaataataccctttcgattttagccagcttgctcacacacagagttgttcacaaagttaatttttcacaaacctacaatttgcttaaactttcagttttattttgtctttcaaccaaaaataatctttaaactctctaaattagagaagattttctcttttaaaaaaacccatattcccatgtctttaagcagttttaattacataccaagtgcagagcctagaatacaggacagaactgcagataaagtctgactctctctggcctagctaggagtcatggctacctccatatgtccccaggccttatctggaatctaatggctctaaagtaggtaaattgaacaattacaaaagtcacagaagccacttatgaccttaaagcatccagcagaaacagtatctgatctgcctaattcagaccaaatgaagacagttttatttcatcaataatctttaaaactatctttatttaccaaagattactaacgtcatgtgaactaaaatgcattagagttgctatttctttgacaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcacgactcacagagaccatctatgccatgcttggactgtctgacttgtcctatgtgtccctctttcgtgaataatcagtcgttctattttaggacaagaatttaccatacaagatcttttctcatataaatttctttttttataatcatccttaccaaaaatacatctttatagcctcaacttttttcacatatctctttcccctactaaagtaattcctgatgccctcaaaagtgaaaaaggccaagtaatgtgattcaaaacagaacagagccttagattttgagaggggtctgtctgcttacacttcttggggttttatgaggaaaacagagtttctcccaaaacagggtctgtggagccttctctctttttcccaaggagtccccagctgtcagaaagtaccttaggtcctctcatgtgggcattcagagtggcaggaagacagactggggaaataattcagttgactgagaagaaagacaaacaaaaactcattcctcgaagaaaaaaaaaaaatccaggaagagaaaaagcacaaaggccttttttttatttttttatttttatttttatttttttttgaaatggagtcttgctctgtcacccaggctagatagagtgcaatggcatgatctaagctcactgcagcctctgcctcccgggttcaagtgattctcgtgcctcagcctcccgagtagctgggaccacaggcacacgccaccaggcctggctaatttttgtatttttagtagagacagggtttcactatgttggccaggctggtcttgaactcctgacctcaagtgatccccctgcctcagcctctcaaagtgctgggattacaggcatgagccactgcacccagcccacaaaggccttttaaatgtgtgcatatatatatatatatatatatatatatatatatatatatatgcacacatttatatatatatatttatatatatttatacatatttatatatttatataatatatattatatatattgtataatatataatatatatgttatatattatatatatgttatataatatatgatatatatgatatatattatatatattatgttttatatataatatatatttataaatatatatatatttataaatttatatatatatataaaacttggatatccatttttaattaagcagattttaactgtagaactctttttttttttttttttttttttacaaaatctttttaaatttcttattaccagactctagccaggatagacagccagtatttctggcttttgaactttaccacaggtaacctcctagcaaaattaataagtcttatctaagattatgacttaactacggaagtataagatgtctcaaagggatggtaagcagttttttgtttttttcttttacaagatttagaatctccccaaacgtagtttagagaaaagaaaatttaaggcagatttcaaggcaagctgtccatggtggggaaagaatcaataaatggcacacaaaaaaaacttacataaataacaaaccagagagcacccattccgtaagctgggaaccagacccaggctaccactgtgaaatagcaaagcttcagctactgagctaaagctgaaggctgttacactgctcttcctgggaatccaggactttactcaagataattcttaaggctagacatgacactgtcacatgtcctctcagaccagctaccgacatgaacccaaaaattcatgccctctggatgccggagaccaaaagagggtaccctgacatggtcccaaagtcaagtttttcaggacgtaaaacaagagaagagggaaaccttatctggtttttgttggagcaaagtttggaactgaccagtctgccaggctggattgaacagcgggcttagaggggtcctatgtccacatcctattctgtggtcctgctctccatgacagaggatgcagctgtgagtgggtttggtttgcgctgtatctccagctactaaagcaatgcttggcaggtagtaggtgttctagaaaggtgtgtcgtattaatgtgtgaatactgactccccctcctaagtcactgagtgaggagagaggatgtgtgattcatctgaggcatgcgagagctggttgtgcctttgtctttgtttttcttttttcttttgagatggagtctcactctattgcccaggctggagtgcagtggtgcgatcttagctcactgcagcctccacccaccgggttccagtgattttcctgcctcagcctccagagtagctggggatttgtattcacagcacagagtgcaccagattccctacagcctaagtctaggctcataagattttttctattaatcagacccttgcagaggagacaaacagtgatgttttccattcatacacggcgagaggggccagaagcctggctggtaagaaatgtttaccctttttgcctgcatgtcaggtttctgggttcccattctctgtagcttccagaagaacggagcagctcttgatgaccctgctcgctgcacgctagctgtgggcgccaagtcgcattgcaaaggaaaaccatccgtttctgttttatggaaccacaggcaaaagcctctcaatttttcaagatgctgcccaatgggctgcatggggaactgaattaacattttccatcctggccagagcagagtacacatgacaaaactagtcactatgctcagtgcccagcatcaacttggcaaggctcacacttgctcccgttggtctctgtcatctttgatccactccactcaaggtgggaagggacggcttccaccgggaattcaaaggatggtctctgagccagatggaagagcggatggtcaccctcgaggcagccctgtcaaacttccgagcttctgctgacaagtccttcagggttcagtgaatgtgaccaaccagacaaactaggagagcctgatggacttccttcagcaattcccttagacatctcctccacatatacaaacacatacagcaaaacaccttccagaaagagtttccagactaaatcacaaaccaagagtattcctccaaacaagtcccctattctctgtacaattagggcagataccccatgctggggctacaaacagataccacctaatagagctagagatgccccatgatggggctacaggcagacacccaatgatggggctacagacagataccctgtgatggggctacagttacaggacgtctccccaggactgtttattgcagttaaatccatacaccatgggttggcagcaccccattagtagagatggtgccagtgtcagcccccagtcgaagagaactaggtggccgcctgggctggcctctggatccatcaccagtgaggggggttggggaggctactgaatcactggaagatagccacaagggagatcacagatgagcccccaaatttgtaaccccctccacaggttctccttgcccacagcctagacagccaatttatcaagacaggagaattgcaatagactaattcacacagagccagctgtgcaggagactggagttttattattactcaaatcagtctccaagaatttggggatttgagtttttaaggataacttggtgggtaggggctctggaggtgtggattgctgattggtcagcatggagatgaaatcatagggggtagaagtgagtttttcttgctgtcttctgtccttgggtgggatcaaagtgccggttgaatcatattacctgtctgggtggcgtcaactgctgcattggaaggcagggtctgcaaaatacctcaagcactgatcttaggatttacaagcgatgttattctcaggagcaatgtggggaggttcagactcttgcagccagaggctccgtggctccaaaaccataatttctaatcttgtaactaatttgttagtcctacaaaggcagactggtccccaggcaagaagggggtttatttcaggaaagagctgttatcctttgtttcaaagttgaactataggccgggcagggtggctcacgcctgtaatcccagcactttgggaggctgaggcaggccgatcacttgaggccgggagtttgagaccagcctggtcaacagggtgaaaccccgcctctactaaaagtacaaaaattagccaggtgtggtggtgcacacctgtaatcccagctactcgggaggctgaggcaggagaatcacttgaacctgggaggcagagattccagtgagccgagagtgtgccactgcactccaccttggtgacagagtgagactccgtctccaaaaacaaaaaaaacaaagttgaactataaactgaattcctcccaaggttagttcagcctatgccctggaatgaacaaggacagcttggaggttagaagcaagatggagtcaggccagatctctttcactgttaacattttctcagttataatttttgcaaatgtggtttcagtccctgcatccataatacctagaaatttgataaatacttgttaaacaaccaaaataaacatccatagcaagaatcgactataaggcatggtggtgcacacctgtagtcccagctactcaggaggctgaggtgggaggatcgcttgagcccaggaggtggaggctgcagcaagacatggtcgcaccagtgcactccagcctgggcaagagtgggaccctgtctcaaaaataaataagagtcccgaccacgagctacagagagtccatctgtgctataggaggcatccacacagcacacacccactgctaccagcgaagcagttcacgcaggctgtgatagatcacactgttcctctctttggatgattggggttcactgctacactgcacaggtcagcaacagcatgtacagaaatgggctgcggtggggagactcatcagccccctggcatctgaacatggccaacactatgccttctgtttcatcctcagactttgggactattagggatttaaatattaatgcgcggatttcactgagccctggcctctctttggtgcctgtcaggtacactataatgagaaattggatcgttcattcttccctccccccttccctcccttctccagggaacagggtttttgttcttggagcttgggaggtggctgagttccccaactagaatcaagtaacctttagtgcatatgcaaatccagcatttgaaatttccggttctctagccttattattctagagggcagccagctttcctttcatttcatttggggtccgcttcacttgctttgcagctactctggtatgcaagctcgacacagccccaagaaggctgcaccccaggaaggagcccaccatgctctgagagtcacaaagaaagaagcagacccttggcgggagagaaaggaaggcctgaggcaggttgtgtttgtgatgcagatgctcctgcgagccgtgcggctctctgaaagcgggtggagctgagaagcaacccagagaggctcctgcagccagggtcgggaggatttcaccttcctggatgggaattgattctccagacctagctttattaagtgtcagcgagttacatgcacacagatcactcagattccacagacacctccccaccagcccccagcaggaccacgggaggagactcgtgccgttaggcctctgtccctgcatgtgacatctgcagggaagggcaggcctagcaactgtcaggggactagcataaaccctttttgcttcaggggtctcttcccaggtaatggcctctgtcctctttgcaccctggccggctgcaggagcctcctaactgctcccttcaattgcgtcctcaccccgcacccgttctccagaaagatcctgttgtaaagtaatctgatcatggcccgggcttgcaggcttcaggcggctacccgtgaaatcccaggtccttaccacaatctgtgaggcccgctgtggcccggccccagcccctgcccatcctccctcttcagcgtcttctctgatggccacatggcctgtgccctcacgtccctcagatgccagggttccctcaccctccaggcctggcagcccttccctccctttgctcaacaaggcgcccaagagctgtctgttgatgactggtctccccagggcagctgtgatgtggttttggtttgcgccgtatccccagctgctaaagcaatgcctggcgggtagagggtttcgtgcgcgtccgtgtgaagagaccaccaaacgggctttgtgtgagcaacatggctgtttttttcacctgggtgcaggcgggctgagtcccaaaagagagtcagcaaagggtggtggattatcattagttcttatgggttttgggataggcggtgaagttaagagcaatgttttgcgggcaggagtggatctcacaaagtacatcctcaagagtggggagaatttcaaagaaccttcttaagggtgggggagattacaaagtacattgatcagtttgggtggggcagaagcaaatcacaatggtgggatgtcatcagttaaggccatttttacttttgcggatcttcagttacttcaggccatctggatgtatacgtgcaagtcacaggggatgcgatggcttggcttgggctcagaggcctgacattcctgccttcttatattaataagaaaaataaaatagtgttgaagtgttggggcggtgaaaatttttagggggtggtatggagagagaatggacgatgtttctcagggctgcttcaagcgggattaggggcggcgtgggaacctagagtgggagagattaagctgaagggaggtcttgtggtaaggggtgatattgtggggatgttagaagaaacatctgtcgtatagaatgattggtgatggcctggatacggttttggatgaattcagaaactaaatggaataagagaaggagaaaaacaggtataaaaggtctaagaattgggaggacctatgacatctgattagagagtgcctaaggagattcagcatagtcctgccagcaaagattatttatttacctcaagagtttagagtggcagtttggggatagcaccaggagatatcagctgtgatggcttggagaaacagtgtaaaccggcagtgtaaacaagagcagggcatgtatgagtagttgagaatggcgaataggaatatgactagacaggagatagtagggatgacaagttttggggggcacagtctaagttggtctggtgtctggaatgagactggggcctaataaaaaggagcgtctatacaggagcttacatgggctgtaccttgtagcattctgaggacaggcctgaattctgagaagggaaagtggtaaaagtattgtccagtcctttttaagttggaggctgagcttggtgaggtgtgtttttaaaagacctttagtccattctacctttcctgaagattgaggatggtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggtattttagttacctgactcggggcatgttgagtgaagctaatttgccagtcctgggtgggggcaaatcctcaagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaggtccaggccaggaacaatggtaattgtgggacttaacaaagagtgagtacagctgaaggagccggggagcagaaagtatatgcatcaggtatgaggaagaaagtagattttggaagttacgagaaatgtagagagtgagttgagcatagtttgtgatttttagggcctctaaaagtattaaagcagcggcagccgctgcacgcagacatgagggctaggctaaaacagtaaggtcaagttgtttggacagaaaggctacagggtgcggtcctggctgttgtgtaagaattctgaccgcactaaccatgcctaggaaggaaaggagttgttgttttgtaagtgattgaggtttgggagattaatcagacacgatcagcagggagagcacgtgtgtttttatgagaattatgccgagataggtaacagatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagtcactgaggcggggagggtgtttggctcttttgaggcatgtgagagttggttgtgccttagggtttttgtttgaaaatttttctttagagtctcgctctgttgcccaggctgaagtacagtggtctgttcttggctcactgcaatctccgcctcccaggttcaagtgattctcctgccaagcagctgggattacaggtgcgcaccaccacacccagctaggttgtgcctttgttaggttctctgtgacttttacccactgtgccattcctgaaagaaatcttttttttttttttttaattagaagaattactggaactagcttggcactgttggacacagtctttgtctcagctactcgagaggctgaggcaggaggttcgctcgagcccagcctgggcaacatagcaagaccctatgtccgaaggaaaaaaaaggcaaaatcagaattaccagaactgatttcacatgtgtaggtagcagatggtggccatgcaattcaggtctgtctgaaggcccccaggcctggtacaaaactgtgtaaggccagtacaaggccctgacaggttcccaagtggctggactggaagagatgccaagttcatggcctcctaacctgactccacccagcactccctgggcccagcgacgttccctcctgaagcctgaaattcacctccacctgaggaggccatctgcctggggataggttcttgcaaaaatgaaaacactcatttccagaggcaattaattcttttaaaggatgtcagatttttggtacaaaatcatggtttccacgttggcttcatgctcggtgctttatgagaaaaatcccttttttctacggttgtgttcattgtattgtaaagcaatcgtagattattttaaggttttgagttagagtgattatccaattttatgagggaaataaaggaattccatgagaaaaacgggggctttcctgcagggctcggggttgcgggagcggcagataacctgattcattaacatgagcccagtgggattggtgggggtgatggggacacagattggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctctgagcaagcttccatcatgaccccattttggagatggggagttggcgcagccacactgctgctcagtggtagaaccagcatctgacccaggccacctgttccagagaccctgcttttagccagcagctcagtccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaaaaaaaaaaaaaactgatggctgtgagaatactgtcactcgctgatgccttctgtgtagaaaaataagccttagacagatcttcgcaagaacatcgtgatggctctcataggcataattacgtgttccaagccaaattgcagttcaagagaaggttataaatctcttcttaataacaattgtactcacgttcctctcctggaaactaagaggaaggtagctgaagaaactctccctgcccagttaaatcttgttttttgggtacttttggactccagggtcacatcagcaatggcccgggacagacgagggggagccttcatctgtacttcgtgtctttccagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgtttctcattccgatttctttttcctcctatgttcccagattctggaatggaaccccagcccttccaggtctgagagccactctttctttgctctggatttctgtcacatcgggggcccctccctctgcggagttgcatgttgctgttcctgatgcacagactcctcccccgctgcttttctgcccactgggtcaggatnnnnnnnnnnnnnnnnnnnntctttacaagtttccttaacgtattgcgtcaaagcgagacaaccgagtcttactcaaacttgttttaaccggagatggagggttgctgctgtgtcaccgcctgcacagggctgccctcaggtgagtaccccgagtctgccaggctgggtgctgatgcgtggaggtttgggccgtccctgccccagttcccacagtggctgcttgagaccctccccaggcccctcgagcccctcctgcactgtctgctgcctcccttctgcagtcagaattgacactccccttccaccttctttgtcatcacattgcatcccaggccagcttcctggggcttactccaagggcatcggcttgccccgcactgtggtgggatgtaaagtgataacagctaaacgacgcatgcacaacatgtcctggtgccttctgcgtgaccccagagcagcaggttctgcacgtggcaggtaagagcacagctgccaagaccccaagcctagttctgctgctacaagctgctgcgtgacttaaggtgagttcatcttcgcctcagtttcctcctctgtcaaatgggatagtccttaccgtgtatggaatttaaagcactttgaacagtgagtgtgagccattactaactcaagtaataccccttcccaacccagaaccctataaggcagggacagtcagtccctctctctgctttagggggttgcaggataaagacaccgtcacaagaaatttaaacacagtaggtaaattttgagccacagcaaagcacagaggttgcatccaggccagcttagcactgttgaaagtcaccatccccagcactgcagaagctgaccctgaactcaaggtcacccagggcttaagcctcagagaaaaggcctgggttgaacctgagcagtgggtgagtgcagggcaggcctctggctccctggagggagaggctagccaggaagttgagcttgaacctgatcccgagggagaggtgtggggcatgctcatgatctgtccgggaaggtctctccagctactggaaggggagtgcccacaggggccaggagaaggcagttgggcagatgttgccgtagtccggacacatccaggcatacgtggttttgaatcacttcctctccaagggctgctgcttcctctccacccctcccaagtgttctggctctgggccccagctggccacctcagcccgggcaggctcctccaacctgaacgacaggcaacctccacgctgcctgccacggcaccccaaagtcaagacgtagaactcattccacctccttcacccgaggctgctttcccaaacgtcttcccagtcccaccttcagttttgttttttgttgttgttgttgctattgtttttgagacaagtcactgttgttgcccagcctggagtgcaatggcacgatctcagctcgctgcaacctccgcctccccggttcaagcaattctactgcctcagcctcccgagtagctgagattacaggcccccgccaccatgcccaggtaatttttgtctttttagtagagacggggtttcaccatgttggccaggctggccttgaactcctg

SEQ ID NO: 17102 - DNA, 44439 bp, Human
ggcaaaattattatggaacacgtaacattggtatcatcatgtattgagccaagctctatgctaggcacttttgcatatattattttgtttaatcttcaccacactctgtgacagagatattaacctcatttgacgtataagaaaccaagcacgcagggaccaaggatcttgcccaaagtcaaaatgctataatagtggggaacccaggatttgaactcagtccaaagcccatacatcccttttccattacagcctgctgcctctccaggataaagagggaagacagggaaagtagggaagtatggacttcacaaattcatacatgctaaaattataacagctactgtttcttgagcacctattatgtggcaaatactatatgaggtactttacataaatgatttttagaattctcgtaaaactcttcatggcagtagttattattctctctctctctctttttcttttttcttgagacaggatatttctctgttgcccaggctggagtgcagtggcacagtcttggctcactgcagcctggacctcctgggctcaagccatcctcccacctcagcctcccaagtagctggggctacaggcacatggccaccaggcccagataatttttcatttttgtagagactgagtctcaccatgttacccaggtttattattctcattttttagatgaagagactgaggtccagagaagctcaatgacttgcctagttttacaaatctcctgccatcacatacccctcagcgtccttaataagagggaggccaccaactatgtgctgggcactgtggtggatgctggagctatagggttgagtatataagaaatggtgttgctggagcaactgttgcttgcttacctgacctatctgagaattaattagcaggggaacatatttttgttttcagattcaatataagaacttgtgtgggcaaaaataaagatcagtagtaataacagtagttcccatttgctgactgtactgtcctaagtgcatatatatatacatacacacacgcatacctatactcctctaatactcaaaatgatcctgtttatgtattgttaatatgctcattttatttttaaatttttatttatttttatttttatttatttttgagacggagtctcattctgtcgcggaggctgaagtgcagtggtgcgatctcagctcagtgcgacctccgcctcccgggttcaagtgattctcctgcctcagcctccggactagctgggattacaggcgcccgcctccacgcccagctaatttttgtatttttagtagagatggggtttcgccatgttggccaggctggtctcgtactcctgaccttgagtgatccacctgcctcggcctcccaaagtgctgggattacaggcatgagccaccgcgccgggctaatatgctcattttagtgaggcaaaaatagaggctcagagtctgatttgtacaaaactacagagcagttaagtgtcctctcagatgtgtaccctgatctgggtgactctaggactctaggtctcaactgttacaaccagttaagggtttggggaagcactgggccaagagtcaggaaaatggaagccacaggtagtgcaaggtcttgggaatgggacgtctggtccaaggattcacgcgatgactggaacccgaagagccggggcccggtttacggccgccatgaagcaacgcgcgccggtaggtttgggaatcagggagccctctgaataggagactgagttgggagggaaaggggcttcgctgggggagcctcggcttcttctgggagaaaattcccacggctacctagtgagcctgcaaactggtaggcgccggcgtaggcgcgcgggcggggccgggggcggggcctgcggggcgtggcggggcgggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaaagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctctttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactatattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatacttcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactccttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaattaacctagtttagttttctgttggttccattttccttgtttgttaagttttagtagctagtttaattgtaatctcaatgattatgtggtagaatgggttggcggagctacaaaaattcctagctacttcagagacattaaatttcagacacatggtacactttatattacattttactatgctaaaataacacggctttcttttggaattctgttcagtttttcagattgtaatctcagctacatctcaacagattgttctcagatatgtcctattaccttctttgtgtagatagtgctttattgactaagaacaatgacaacaacaccttttgttttctgggaataggagaaaagttttaagccaaaactcttaattgcttatctgctccacgtgaggtatgaactatcaaacttaggagccatctagcttacacgtgttccttaaaaagtttgctgtaggccgggcacagtggctcgtacctgtagtcccagcacttttgggagcccagggtgggggatcacttgagctcaggagttcaagaccagcctgggcaacatggcaaaacgccatctctacaaaaatacaaaaaaaaaaaaaaacgctgggtgtggtggcgcacaactgtagtcccagctacttgggaggctgaggtgggaggattgcttgagcttgggaggtgaaggctgcagtgagccttgacagtgccactacactccagcctggatgacagagtgagaccctgtctcaaaaaaaagagtttgctgtaattcccagcaacaaagtaggagactcaaactaaataattttctatagtcctagaacttcttagtttacaaaacatttttacttctgttatctcatttgatcttcatacccatgtaaggttgaggtagatgttaccacatgtgagtgcaatatccagaactcctgaatccccttcttcccctaaaatgtcagcccgctgaggtccacttggctaccctcttgaatactgcatccagcttcccactgctgaacctctttactctttttttttcagttgcacttaccaccttctagtaagttgaaccatatgaaattaccatttttgcaggtaaaaaatggccggtgataggcagtttggcgtcgtataacccaataacatgttatataatttacccacaagtggtgggttgctatgtcctggaggagtcagcttcagactctagctaaatgattgtataaccttgcagctctcccctaagtgaggaggcaatgttgaaagtcccatgtcttatcagaaccagggaggcagatgagaaactgccttatggcagctcccacaacatagggaggtgggtgacaaatggccttgggacagcttcttcccaagactggttatgttacagtgttcctgggaggatcacatggcattcctccaagatgggtcagactgctgttggccttgtctgtgtggcgtatgtgaagacattcatggcagagctgttcccttagaagcatctactaaattgatcttttcctttcttacttactgtctgtctcccttagtaggctgtcagctccgtgagtgcaggaccttgccagtcctggtcactgctatatccccagcacctacaagagtgcctggaaaattgtagtgctcaataaatatttgttggataaatgatagaatgataggaagttaaaaagcaattaaaatacttgaaaagaagcaaaacatttttcatgttaagcaaaaaaaaaaaaaaaacttattaaggatagctaacatgtattgaattctatatgcaatggaatgatacttagcgcctttgaatccttatgataaccctataaggtaggttgtttgggtttttttaattgtcccaactttacagatgaagaagtgcaggtccagagaggtcacat

SEQ ID NO: 17103 - DNA, 96690 bp, Human
ggttcttttttgcattcacctgtatttttcaaactattctattcttgccttctagtttctattcctttttaaaacctctttcggccaggcatggtggctcacgcctgtaatcccagcactttgggaggctgaggcgggtggatcacccgaggtcaggagttcaagaccagcctggccaacatgatgaaatcctatctctactaaaaaatacaaaaattagctgggcatgatggcaggcacctgtaatcccagctactcaggaggctgaggcagaagaatcgcttgaacccaggaggcggaggttgcagtgagctgagatcgcaccattgcactccagcctgggtgatagagcaatactctgtctcaaaaaaaaaaaaaaatctttgaacattttcagcatacttattttaaaatcccttttagattttcttattagctgtggttcttaaggtatgaattcttccattggttgcactggtcttatggtggtttatttcctcacggacttagtaagttctagctatgcattcatcctgagtcatagatacaaacacagattcatgtgctatataccacctgggtttgaattctggctctgccacttagtacctgtgtgaccttaggtaagttatttaatctctctgttcttcagtttcagtatctggaaatcagggctgttctacaaatgagttattaggttggtggaaaatgattgcagtttttgccactaatttcaacggcaaaaaccgcaattacttttgcatcaacctaaataatataagccaagcacttaggacagcatctggcacataattaagcacttggctagtgtaattactgttatttggcaggaattgttttaccttggagtcttatgtactttgggttatgtgactgcctactctcagctcaaagtggccagtacacttctgaactgtgttttttcccccatccccacttatgggccagcacttaccactactgactttccataggagctcagattccactcccgttcccaccctgccattcaaacccttcgcccaggatatgtgaccacctttggttcttctgtgggctgtgtagttgctgctgtggctttgagctccctcttcatttctggcactagaatatgtttatttttgcttttgctctctacaacatatttaaatttttgaaaaaacaatgtgttttgagcaggggaggagcttcctgcaacagctcaggcaaccatactgaccagtaatccctaaaaattctttcttttttttttaaattttaagttccggggtacatgtgcaggatgtgcaggtttgttatgtaagtaaacatgtgccatggtggtttgctgcatcgatcaacccatcacctacatattaagcccagcatgcatcagctatttttcctgatgctttccacccgccacagccccccaagaggccacagtgtgtgttttcccctccctgggtccatgtgttctcattctccctgagcattcttcctgaagaggcttacctctcatttggcagtgggctccttgagagaactggggacaaaggctggattcctggtgggaagggacatatattatttgtttttgtattccctatgcctgatatgtgtttactgagtaaagacacgaaagactgccttggcaacagcaagcactacaagtggccagctcactgcttgatttctctaagaattaccaccaccatgttgtaaccctcctccccgcccttcttcctgtgaatgagttctgtcaaggtgacatggcttctaacacatgacagtaggtatcattcaatcactgatgatctcaagggtgagtagctttcttttactctgtaaacaaaatgccaaactgggaaatgctgcagaggccacatattattctgactttcagagtgttgtttcgaaagcaccagagtaaaatgttaagcaggtagctgatgcaatctggcaaagtcagtatatagctctatttatataaagacacacacatatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcaggtaagtcaagtctgtctctgttgccacattctctcgagattttatgactgtgcacatggcctgtgtgaaagcttcgcttaggtcaccttatgccttggcagccagcatggtgtatgacgattcaggaagaccctggtgtttcccagatggggccagatctggccatgcaattattgccctccagctgggaaatgtgacatgggggtgatgaagtggctgctgagaaggaggcagttagactctgaatttggtctgttctttatttaaatctaaagattgaacacacacacacatagatctaaaatcaatatcatacattcacacacacacacactcacacatgcaccactccccaactgcacagggtattttttagggattcatgtgggattcccctacacatatttcccagtctaactgcctattctttcccctgtttacttgccatctcatcattctctcttcctttactctcctacttatctttatcattgcttttagctgtgtgttcctattaacccagatgatcagtttcagactctttgagaaagagacagggaccctaaatccattgtgagctgctttgtctcattctctcccatgaccacagagaggcatgtctctggaccttgattctgagaggaaacagattcacagaaactacaccaccactggtagcacaatgttactctcagggtggacattctcatttataaaaagagtagtagaataaattgcattctaatcccagcagctctaataacttgtccttctttctatcaatatactgatcactgttactacagaggcagcagggaacaaatatgggctctgtatttaaacaaacttgggttcaagttccagcttcagcagttaatagctgagtgacactgggcaagttgcttatcctctctgatcttctgtttctttatctgcttaattggcatcaaatagaatatacagacagtccccaacttgcaatggtttggcttgcaattttttgacattatgacgggcttattagggtactgaatgcatttttgatttatgatatttttgatttgtgatggttttatcgggacatagccccatcataagtcaaggagcatccgtatgttcaaggtgctggatacataattggtgctctataaataggtggaattactatgattatttggatgatggtcgcaacccttggtccttcctgtctcactggagttagagacaatcagagttaaaggaggactctaaagatgaacaaagcatcttctcacggtcaagtgacagctcggagctgctggatgctcagcatagcactagctctctaacaggctctaggagaaacaatgggtagatctactcctgctctcaaggggccctggccatccaaatgagcagataagatgaaaatgtctacaaatgttaaaaaagaaaaaaaaaaggctgggcatggtggttcatttctgtaatcccaacacttcgggaagctgaggcaggaggattacttaagcccaggagttcaagaccagcctgagcaatgtagggagacaccgtctctacaaaaactaaaaataaaatatccaggcttggtggggcacacctgtggtcctagctactcaggaggctgagatgggaggatcacttgagcccaggagatcgaagctgcagtgagccatcatcactccactgcactccagcctgggggacagagcacaaccgcatctcaaaaaagaaaagaaaaaaagaggaaaatgtaaatatgagtgggcaataagactagtatctgctaaattcttccctatagaccacaagtgctatggaaattcagagagggggtgctgctgtgaataagaagtcctcctggaggaggcaaggcttcagctgagacttaaagaaaggatgaggcttggagtgacccctagaaaaggtgggagctctgtgggcaaatgctggtcaaacttgagaggtaggcacaactgttatttccaatttacagataagaaaatggaaggccagataagcctagtgacttctctaaggccactcagcaagtaatggcagcactaggatttaggtagagatcggtctctgtctggtgttgaaggctacattcaaagctggctctgactgaagaaagatgagaaataggaaatagccattgatggttttccagataggagtgacgtagaaaaggcagtgtgttttctatattcacagtgcagcaggtgttcaggggacgattctggcactagaggggtcaattaggaggcagttgcaatactttagggctgaggtattgaaggcctgatccagggtaggggcatggtgggactagagaaggcattaagccattaggcatgtcaaagggcaaattcacagacttgggaactggctgaataaggagaaagaaggacagcgggatgattaaagaatctgatatgggaaccagaagactgggcaatgctgctactaggcatattgggatagcatactcattttaaggttgctgtttatataaaacagagcctggtttcttttattattattgctattaaatctttttatttttttaaaaacacacataccataagaaaacagacaaattcagaatatgagatattctacaagacaactagcctgaactcttcaaaaattcagtgtcacacacaaaaattaggagcatgcactgttctagattaaacgacactaaagggacataagtagatgcaatacacaaaccttggttttggattctggattttacaaagctatgaaagacatttggggaatattggggcaatttgaatatggattggaaattagattatattaggaattattgtttattttcttagctgtgataatatattgtggttaggagggagaatcttcttattctttaaagagtcattctgaagaatttagtgggaatgtgttatgatgcctgtgaccttcaaatatatatgtgtgtgtgtgtgtgtgtgtgtgtgtgtgtaaatagattgactgatagaaacagaactacacagcaactatgttgaaatgttaattgtggaatcttggtggttatatgtatgttcattgttctacttctttgatctatttgtacgtttgaattttttcaaaataaaattcaggaaaaaataatgcatgaacattgtaaaaaacaacaacaacaacagtaaaaaagggtatggggggaacctttctgccccagacacccaatactccttcccagaagtaaccactggtcacatttcttgaaatgttatctgcattttacaagcctatgtatgtgtttgtaaattctgttaataaatagataggttcatgctatgcatctttttgttagctacaagtagactctcttatctattcaactgggagagtagttagttaattaaaaatcagtaaaagtggaagtgcttggacccactagggagtggtgaccaagtgcatccagaatactgtgggtatcaatcagtgcattttacacaggaaatggagagcatcctttaattgtgagagttggccccacagacgtcagctaagcgagcttccactgtaatggcagcagcctgcttttttgtttcacttcaggagccttcttggaggtgttaagaaggcctaggtctgccaacatggcctctgagccactggtagaaccttcaggaatgagagaggtgagccattgggcttggggagaggtgaagtcagcaagtgcatgaggggcctgggctaggactcttctcatctgaaccccacaggcacaccctgactgttccatataaccacgtgtagatctgtctcattctttcagtacagttatgtctcattctttcagtacagtttttaggatgaattgcttttaggatgagtatggttttaatcatattgtgctttgggagatggtggaacatctgggtagaaaaaacattgcctaggcttcctgaacttgcctgatcgtaagaatcatttgggtatttgtctaacaagctttccagctagggcagtgctgccatacgcagttggagaaccaggtctagggctccagcgacaggactgcactgacagatggaagctccactaatggtgctagttaaaggcctgagaatagacagagcaggcaagatgcctgagaaatgctgaagtccaaggatggagcccactaattcccatacaagcttcctcccccaacccctcccctccagagatgattgcctcctcttgcaatcgttggggtcacatttccaaagcatgtgcagctttgaatatgaaaaccctccctaactggcagcacctgggcaaattcaaatcacatacttggacataagactcctccttgcaaatgggaaggatgattggaaaaatgtgattccagaaaccagatctggactgaactgaaattgcctgaaaaatgaaagcactggcacaattaacaaaaagggactggattcctttatttattttatttatttgcagctaaatcctacacagcttgcagaccttgggagacagccatccttttatcattcctgatatggacttgaatttctaagaaatgacttttttaatggtctgtggaattgaactcctactagaagcggccctaggactcccagtcacaatgttttaagaacaatcctgagacaagagcaggagctctgaggggccttgtgtgcccacagacccatgaagccatatgctgacctcatattggtctcttcaggtgtcctagaaaacccagctctgcatctaactcaccctctgcattgggacaaggtagagcaaggcccaatgtcattttagggacccacaatggcagaggactgcattggcttgtcacactgcctgaaatgttcacatttcagtgtgaagcactgacgtcccctgtcttctctaaatcaaagtgtctcagaggtaaagacaggatctctaatttttttaagacaagcagcttttcacttaaggttaaaaaccaaatggagaagggtgggtagtgatgtgtctggtttttgttgtaagcctggagggtgagcaggtggttaggagagggaagggtgtcaagaagacccaggcctgccaacatggcccctgagccactggtagaaccttcaggaatgagagagatgagccatcaggcctgaggagagggcctggggagagtgtatgaggggcctgggccaggactcttctcatatatggccccacaggcacacctggactgtaatgattgtggaatcgggaagccatcaccacagtttccaattccttaccactattattaccatgactgtgctgagtgcatgtgctttgaattttcagtgagcctgctagcccagggacacttccacctgcgctgttatgcagtgacacagactgatggaccacagtagcagagagcagccgcggacctcacatctgggggatcaggcctcaaggattttgcatgacagtttattccagctctgccatgtctcttaagaaatccacagttttgattttctgtaactgcccccacccccgcccatgcttttaaaaacacatattatgtgccagatgctagagtaagcatattggatatatcatttatttaatcctcaccacagcactgtgaggtagatgttattgttaaccaattttacagatgtggaaactgaggcacagagagattaagtaacttggccagcactgctctgctccagcagaatttctggaagtcagctggccagctagactctttcagattacttttcctcacccaagcccacttctgaattttctctccctattgattcaacccctgtggtgacaggtttatcttcaaatgaggtttcctaggatagccctgctatggagtcaacctgaccaagggccagctgcaccactcacctgggagcagttgcctgtagaaccagagaacagaaataacaaacttcactagggttggccgcaaaccacaagatcctctagaaggaccccaaaatgtccgtgaagaccaatagtcagattactgaccatgccgccagagaagaaaagggcagcctaccaactatccatcctatttgagccacgtgacttgccaacgtgggtgttttctgaggaaaaccttcagttcacccagcaattccagcctaagctcttttccgagtctgcctgaactaactagatatttgcctctgggtcactgtaacccaaaaaggcttaattaaaatcaggaaataggctcaagttcctctgctgcaatactataaactttagataggccaaagtaggctgcaaggacacacagggataaaaggtactttggatacagcacagtcgtctgggatactcatacacacacccacatgataccctcctccccccgtagaaattaagaaatgagaaaaggaaagtatttggctctaggtgagcttcctttgtaaaggctggagacaatgcatttgtctactgaacacattttgtctgggtatgggggaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtggccttctccttgctgagtgctggcttaggaagaagcccaagtctcacagtttgggatagatagcttttgaaatgtattcacactccactgctttctgaaactaaacatcctgagtcttttttctggaaacagtggtaaaagaggcaaggagtttgcttgtgaatattggtttcattctttaaatagatatttgtttattcagggccttctgtgcactaagcactgtgttgggtgctgtggacacgacagacctggagccttcttatggaacttgttctgcctataatttggcccattttgagggggtcagagaatgaacacttccacttcctaaactgtgctgggctgtgatgcagtgaggtctttgagggtctcgggaataagtcgggttgtttacccttgtaataaaaggctccagattgtggtgccgagacttcccagtgtcagctgtctctccgtgctgctgtcaccgtgttgtttctgtaggagcagaaagatgtgatctctttcctaacccatcataagggtcatggccgacactcctataacaaaagacagttaacaagagaaaagcatttaacaaatttatttaatcaaagttttacatgacatgggaaatttcagaaatgaagacccaaagacccagggaaaattgagtatttttatgcttagattctataaagaatgtttagaaatgtgattggataaagggtatgatctaatggtaatagactgaaggcagagggtacccagtaaggcctgtctgtttagattcttcttggcttttctgtgtagcattccttcctccagggtatagggcaggaactctctggcatgagggtctacaaggaagaagtgacctttctagattgtatgggttgccttgggggagagaggttctagtttctgtgattccccccggggcgggagacaggagggtaggagaaggtcagagagagactttgcttctgaggtggcttctgagaccttccagtctcctttagttcaaagtactcagcatgccaaagcgccatcgtttgggttaccattttctgaggcccagcacttcttatctgccatgttatttaacacatgtttgcctaggctagggccttacagtggcttttctctcccacggagtataaagtggatgtgttttgtgataatggttggccatttggatgtatttcctcttcattccacatggttgaggttgctggaagtatagcttccaaggaagtggtgacttacattatagtatagtcagtggcgtgctggcctccctcagttgagcagggaggggaatgctggtttatagtgtttgctgatttccatggtgtaaatgctcccaccatggccaatttcaagctcccgacatgacatcactgaacaaggagtccggaatacatgtgcaacagcaaggcatcatagcgtatttccaccatacagatacaatagatgtaaataacctcaaaagcataggtaacagtaagtgtagtaaaataattaggaagtgatgagttttgagtattcattagctttgtcttttttttttttttttttgagatggagtctcccactgtcacctgggctggagtgcagtggcgctatctctgctcactgcaacctccacccaggttcaagtgattctcctgcctcaacctcctgagtagctgggattacaggcacccgccaccacgccctgctaattttttgtatttttagtagagatggggcttcactatgttggccaggctggtctcaaactcctgacctcatgatccacctaccttggcctcccaaagttctgggattacagacgtgagccactgcgcccggcctgctttgtctttaatataacctaattgtaagtttagatcatttcacttttaacaatggctatatttaacaaactggcccacaaaattcatgttgaaccatcgattctcactatctgggtgagtgtggtcctgcctcacttttctcttagcttaagcagtagagagtctgagtaaactgggtcccaaggctcttgcccccactttaaccagagcagccccacttgtattcatttcgtacataatggggttctgtgtttgaggagagggttccaatgttttttattttttaaccttttttttttagatggagtctcgctctgtcacccgggctggagtgccatggcacaatctcggctcactgcaacctctgcctcctgggttcaagcgattctcatgcctcagcctcctgagtagctgggactacagacatgtgccaccatgctaggctgatttttgtatttttagtagagacggggtttcgccatgttggccaggctggtcttgaactcctgacctcaagtgatccacccacctcggcctccccaagtgctgagattacaggtgtgagcacccagcctccacgttttttaaatgtttttttaaaaggcattggtatagatggtctatgaggttccttccgtttatggtatcttaagttagccatgtcttccattttccctttcattcccttgtcccctcttgtcactcaggcatcctattcctgctattcccagagatcattttgtcccatcccaggctctccatcttcactgaagagatagctgttatcagctgatagggttttaggtgatattcctcccaggcgtattttactcttcaacacatgactccagaagacacataaggtctttcaaataaaaggaatgaatttttaaaagctgaaattccaggcagggtgctgggggtgaggggtggggtgctatctgtactcagtgcccttaaaatcataacactgaacagtcagacctgattctactttgcagtatccttcaaaaatctcttgatttcgatgggttgctaggttacccccaaaaaactgcccaagggtgtatctctatttttctttacacaacacagttttcctgcagtgaaaactgaaaccttattctagcagatgtttggttcgtcttcccctgaatgcaaagttttcatccatggaaatgatagagaggctgcaaaggttatggatatgacacaatcctttctgaaggcaaattcaccctctttagcatgccagaaaaattatttttccaggaaaactaaacactaagcacatgcttggatgttcctttcaagcaagagaggagccctttctatcccattaaggtcaggcaattgcccaaatgatttgcttcactgcctatcataacggggagtgtgggatggaaccagcaggggtttactctcatctctctccatccagcaggctagccaagcaaagttcataggcacaggcaccctctgaagcctggagtcagagaggctgaggctgggggacactcgggacccctccaacacacacacacacacacacacacacacacacacacacacagatgcatgcatgcccacacatagaagaccacaacattccctcagttcaacacagcagctcatgagagtcagtattatggaagcaaaagtagagcagagcagtggaataagatgcatggaacctggtggcccagaaggccacgggatggggcacaataatgagcttctcggccagctgcccagtctgctgggtgcatactgttcaaatgtagataggatagccagtggcccaggagctgtgggggacaagagggctgctatttcctgcctacacggctaccttcggaggcctggggtactttccatagctttgcttctcaggttctgtccccacttctgacaccagcagcaacctccctttggccccattttgctgaggacatggctcactatctgaaagcttcaactgtaaggaggtacgtatgcatgcccaacacacaaaacagacccaaagccaaactctgtccagttgaggccagcttaggcaataaatcttgctcaattccctggtcagaatacctctggctacctctgcaagcccggtctagtcttgatccagggccgtttggccaaggtccctgcacagtcggcactctttcctcttccctgtccaagctgagctcactctcccctggctttccccaaagtccttcactttcagaattggaatcttttgaaccaaaactttctttcttacaaaaatatcttctctaactctcacctctagccttccattctagatttctaggttctcttgtgtcttctaacacttgaattctgagggaatttggtctctccaggggaagcagagaggcactccttatttatccaataacattcagtggctaattatcatttatagaccatcgtggaagtcatcaatctcagagtgtgcttttcccgtatcacttgctcctgatgttggagagagattcgaaatctaaatgtaagtcaccagcaaaatactgtcttttcaatgcaccaaaaggagggaaagttagcttatcttgtagaatccttcaaagtactgtgaactagctgagtaagggtaattagaaaacggaaaagggaagtcaaggacaaactcccatgtagttggagaagtctcacaataaagtaaaatttcccaagaattgccggaaagcaagtcttacaaccactgggaaatgatgagtccaagaatttcagaagagcctccacccttcacctggccttgaaatcaccaaagagctcctactgctccactccaggctcaagaagcaagctgcttttcattgctactcttcaaaatgtgctcatatccattatctcatttgattctcaccatgaccctgtgaggtaggtaggacagatattagttttccccggctcacttctggaagattcccaggagtcagattttgcacaattgtaagttgacaggtttggctctatttgcacatgctaacaaaatctggcctggtccaaccgtatgtaaagggaagatttgtcatgcaacattgacctaagctatgcagagagaagcctgatcatcggggaaggggactaggggaaatttcttgggaaatgtaataattctactcctcctttcccttcctgggcctaaaaactcacgcttgaatgggaaggcttgcattatcctcaagctactcaaaaagtttcttgaagactggataccaaggccaaattcctatatatttagctatatttgatcaaccttaccaattaatcaactgtacatcgtgggcccagctcttgcagggaggaagagacagagaagtaggagatcagagtcaatggatcctgacctccaaaagcttacagttttgctgggagctaaacttgtacacactacacaacaatgcgtagcagccaaacaaaaggaagagaaggtcagagagggttgaggcagccaggggagacatcccagaaagtcagaacagaggggtggttaggagcatgacctctgaggttgggcagtaaacatggctttgaattccagatctaccattatcagcaatgtgaaccttgagcaaatcactatacgtgatccataaaatggggtgaaaatgaataagtactttaaaagttgctgagaagattaaatgagcacagtatggtatccattatctcacttgagaaaataaaatttggtgctgtttaagctaaccattaaaaatggggaagatttggagacactcagggggagagacaggacaatacgaggcgctgaattaaacaaaggtactgaattaaaaaggaaaggaggtggatgaggatattgagaatactggtattgctaaagcagagagtacatacatataaagggagtaggagacaataaactgtgttagattgggtgcagcaagatggcaaaaggctaccaactggaggagtttagactggatatgataggaagggagaagccaccagagatttttaagcaagagagtgacttgacgatagtagtcttcgaataggattggcctatggagcacttgatgacttggagagggactggaggatatccattgtttgaggcatgagttgacatgcgcctggactagagacatgagagtgagaatagaaaacatttgaaaagtattttgtaggaaaaactaaccagatagagtaggtaattggatatgggagatgaacaagaaggaagagtccaagagtcttccaaagtttttagtctaggtgacttcaaaagtggtggtgccattgttcttgcttataagtgggacctgaacaatgaaaacacatggacacacggagaggaacaacgtacactggggcctgtctcgggggcagggggaggagagcatcaggataaacagctaatgcatgcagggcttaatacctaggtgataggttaataggtgcagcaaaccaccatggcacacgtttacctatgtaacaaacctgcacatcctgcacatgtatcccagaactttaaattaaattttaaaaaagaaagtcgtggtaccattgacagaaaaatggaagtcaagaagagcagtagacatggaaggaagatgatggactcaatgttcaatttatagaaatgtctagaaaaaaagttgatactggaataccctagagagaagaatttccttcttttacttcttttctgacagacacagacctcattttttgttagatgattatattatctgcaaatattgacaattttgtttcttcctttctgatgctattaattctattttttattctatggcattggcttggagctctagtaaaatgttgaatagcagagtagcagtagaaatagacatttctatcttgttcttgactttaagggtgaaaacatctaatatttccaaatttgttaacaaacacttgtgtattgcttctgtgtgtgaaacgttattatgaacactttacaaatattaggctatttaatcctcctacaatgttatgaaataaatattattattattattattattattattattattcctcttttacagataagaaaactgaggcatagaaaagctaagtaacttgcccaaggtcacacagccaacaagtgttcaaagctccactgcttagctttggagactgtgttcttaactaccctgctacacttgctgcctctttttaagtatgaagttttctgtacctttctggaaagtactttttatcaagttaaagtttccttgtatttctaattttcttagagctttctaagagcaaatgagtactcaactcagttttatcaaacatttttgctgcatctattgaaatgatcatattatcttttcctttattatgcaaatataatgaattacattggtatattttctaatggtgaaccagccttgaatttctgagataaaccctacttggttatggtatagtcttctttttccaaagtgcgagatttgatttggtaataatttatttaggggttttgtatagagttagttttcggtcctcatataatttggcattggtgttatgatagctttggaaaataagttggaagtttctcatcttttttaatgctctgaaattgtttgtttggtaaagggattatctgttccttaaagctgttgtacactttacctttaaagactacttgtgtgtgttaagggggctgaggtgtacacatctttgattctatttccatttcttctctagttttgttgatacagtcagattttcatcttgctctcaagccaattttggtaaagtatcccagaaaattgtctatttcatctacgttccaaatttactggtataaatattaatacaaaataccaattatttataattttatacctgtaccaggacttacacaattactaagaataatattctcttatactttttaatatagtcttttttatttttattttttgtttagtcccacccttcatatctgatttttaatatattctaaatacagttctgtcctctctctctctttttcttcttcttctccctctccctatccttcttcctctccctttctctgcctctttttactcttgagtggttgttgatgtgttttgtttgtttgttttgtttcgtttttagcaaacttgctaatctttgcctattttcatggtcttcccaaagagctggcttttgcttgtattgatcaacatttcatttttgatgattgtgtattttgtaagtttttgctttaatctttcttagcaaaccttactcctgcaaagctcatctgtctagaatatcctttcccccttccctttcacttggctgactcctactcattcttcagtttatgcatcatgtctttcaggaagccttccctgacacttcagagtgatttaaatgctcatcctctgtcctcccccaacaacttccagacctcatcattccatgttataattagctgtctgctttatctctcttccctattagactgcaaattccttgagggcagggaccgtgtctggttcataattgtacccccaagctcctaacatagtattaatatttgccatccccaataggagttcaaatggaaattttattggaggtagcaacccacccataagctggtaggtagatctcacaaaggagctcctagtacagtctgttgcctgaagtttggggtctttttttaaaaaggaaaaaaatacccttggtagctttagtttcttgatttttaacataatcaaatcccttcaaatgtgtcattccatggtctgtctaccctttggggacgtgttctgcgcattctacctctgcactccagcatggatctagaggtttcaaccccaaagggcacaaggccaagagttggccctaaaggagctgagactgactagagttagagtctgcaggctgccccagggcttctttatttcaaagcagcttcctgcatgaaagccttttccttctctgtagttaaggttggggtacctcacccccacttccactcctcttgtttccaatctcatctgaaacacctttccctctatgttcatctttcctctcaattccctccccttatttgccattgactctgtagttttttattacttgtgtccaggaggtgtttcgagaatgtgaactgaagtagtagtttatgaaattggcaacatctgtgctctgctgccctcagttttcttctggaaacttatgtggttagcactcaggtccaaggaaagcagaacacagaacgaactgaaagagaggcatacccaaatcatggaacaccatcagcatcagggctggctcctgcccacgtctcagctcccacctccaccctaagctacaggctgatagaagactatttctagagacaaacatcaagctggtgactgagggttttcctgctcactgtgaatttacttcctgggaaagatggtctcacttcctcacatcatctgggttcctctttgaggaaggcatcatgaaactgaaatataaaaacacttctgaaagaaaactcattctgaaattgtagggaggtcagagaatacaggacccaaaggatacccactctgtgctacctgcctaagacagaactaaggaaagagagatggctacagggaaccatgcaggctcatggtggtgctaggaaaaggtaatggactgatgctgccaggcagcctatctcagtcttttctttcttctttcttcttcttctttttttttgtagagatgggatctcactatgttgcccaggctggagtacagtggtgtgatcatagctcactggagcctcgaactcctgagttcagtgatcttcccacctcaaccttctgagtatctgggattacaggcatgtgccaccatgtccagctaattaggtttttatttttttattttggagagatggggtctcactatgttgcccaggctaggcaaactcttggcctcaatcaatcctctcgcctcagtttccagagtagctaggactacaggcacatgccaccatcgacagctaattttgtacttctttgtagagacagggtctcactacgttgcccaagctggtctgaaactcctgggctcaagtgatcctcccacctcagcgtcccaaacctttgggattacaagtgcgagccactgcacctggccccattactcagacctttctaaggttgttttgttgacagcaaatgtgctccaggcactgtgctgggctctagggatatagcaaagaacaggacacagttactgccttgaggagcttatagtctggtatctgtgtgggacacagtgtccacatttggaactttcctggctactatgctatctggcaccttgacttgaatatgtaccatctcttcagcattttcagtggccccagagacagaaactgcatctcatttatctgtacccccaacatctagcacactacttaaaatatggtaggtacccaataaacatttgttagatgaataaaggaaggaaagaaaggagaagggaaggacggaaggaaaaagggctagatgaggtgtcccagaaatgtttcatattgactggagatgatgttgagtaactttcataggagccaatctcagggaaatgcttgagtccctgatgatcattgattggaccccccagaaacaaccctcccagtcaagatgtctctgaagcaactagaatcctgaagcagttcccaaagtcatgggacaaaagctcaggcatacctaggtcagcttcacagatgctagtgactttgaattggtcacttttattgtagtgtttattcatccttgaaggtattaaaataatagggtagaaaaatagtttgatggttcctcaaaaagttaaacatggaattaccatatgaccccacaattccacttctaggtatatactccccaaaaatcgaaaacagggactcaaatgagtacaagcacatgtgtgttcacaacagcactactcacaatagccaaaaggtgaaaacaacccaagcatccatcacatggtgaatagataaacaaaaaaatattgtatatctatacagtggaatattattcggctataaaaaggaatgaacttactgatatggattacaatgtggatgaaccttgaaaacattatgctaaaggacagaagccagacactgaggcctcatattgtatgattttatttacatgaaatatccaggataggtaaatttgtagagttggggcactgatgatttccagagtctgggagaaatgagaagaatctgcttaatgggtaagaggttttactttggaatgatggaaatgttttggaactagatagaggtgatggttatgcaacatgtgaatatactaaatgccacttaattattcagtttaaaatgtttaattttatgtgaatttcacctcagttaattattttactttggaaaaagtcaaagtagaacagcctcaattctgtggacaaactgggtagttgtgggaagggtagactagctgggtgtagagtgggaactatttccttccctacccaccaccccaccactccccaatgcttgttcctttcttcagctaagtcaagtgtttattcctatctccattcctgttcatatccaagaatcatctggaattattcttaagaatattctacttctctaaggactgttcatcagaaaaaggcagttgtaatttattgggagtccttctaagaaaccccaaatatcaaagattttaggaatatggaaaccatcatgtagacctatgtcagcttaagaagatggccttttgaggagagtcgtcagaaaatgttgatgtagccaaggtgatgggtgcatacaaaatgctgggtacctgggggatgctaggaaatgcttgttgattgactgattccttgattgagtaaaaaaagacatttgcattatcctaagtgaactaacacaggcacaggaaaccaaatactgcatgttctcactgataagtaggagctaaactttgagtacacatggacataaagaagggaacagcagacactggggcctaactgagggtggagggtgggaggagtgtgaggatcaaaaaagtacatattgggtactgtgcttattacctgggtggtgaaataatctgtacaccaaactcccgtgacacaaagtttacttatataacaaacctacacatgtactcctgaacctaaaataaaaggttttgtttgtttgctttttttttttttaaaaaagccagcaatggcaatagccaggaaggcacacccagcagagggaatggcaagagtaagagcaggaccaaagaattataccacccggaattatgctgcagatgttgacacagcagagagcttcaggagaaatagaggatgggaatctttctttacctaactctgctactgagatcctttggaaaagtagtgatgaaatgaaaaatacaaatatcaaggcaacaaaatctgaaaaaaatagaattagtgctgaaatataattaactgattttctatttgaatcatcgtatgacattcatagaatacttgcatcatggaactatttataagatttttctgctaatagtcaacacctcaacaactgtcaactcactttttgctcattcacaaaaaaatatcttagaaaacttaaggagaacaactctttagtctaaatggcaagtcttgttttataaaataatatctcaacatagctgcatgtgaaaaatggtcatttttaagcagtctttgtaaaagtaacaatgaattttgaagtagaagctgatgctttgtgtcttctgctatttgtgtggtcaatgacacggctactgctcccagagtaaacgatacgtgccagtgaatattttgtgcaagttaaatgttcatcatcctctttctgagaaataaaaatgcattactttaaaaacaaccaaaaaaggacatttaaacaaaggattcccctccagtagactctcgtttatgggcttcagaccacattttgtgtaagagctttcagtcatccattttttctttcattccacaaaaatttattgagcacctgctgtgttccaggaaatacagtaatagggatgcgccatcataggcatggataaaggaaattcacatacaatccccccaatttttttttcttttgagatggagtgtcactctgttgcccaggctggagtgcggtggtatgatctcagctcactgcaacctctgcctcccgggttcaagcgattctcctgcctcaacctcccaactagctgggattacaggcatgtgtcaccatgcccggctaatttttgtatttttagtagaaacagggttagaccatgttggccaggctggtcttgaactcatgacttcaagtgatccagctgccttggcttcccaaagtgctgggattacaggtatgagccactgtgcccagcctacaatcccccaaattctttgtaagcataatttcaaccctttactatctctaaactttgagcttgagtaagctgatgggcaagaacagggcaagttatggtgacgatagtggtgtgtccacaaactggaatatgtgatccaataagtatggttaatggacaacagagaagaatacttgcaaatagggctattgaaggaaatggccctttgacaagggaggtggaacagttgggggaaagcctggtcaatgtcttcttccttctgtcctgtccccttccccatgcctggaccacctggaaactatggattaaagcagtattctcttgcacccctatggctacacacacccctgggtgcagcggctgctttcccctatctccagcatagctcatgagggactccatgtgagcgctgggttgcctgaaattgagggaaagcaatctggtcagaactaagtagggcctgcttcttgttgcctatgctacagttaatccattgccatctgtctttattttgctgactcactgctttcatttgggttggcagttcttttgctgttggctgcagtctttaactgtttacggaggactgagatggatggagaattaggggctttgcattcattcgctgaatgaaatcctacccaggtactgtgggcctcttgtcgaggggctgaggccaaggcccctggattttgatggatggtggagattaagtgtagggtaacacatcatttagtctgattgcaaggccaggtttctcccaagcattgccaaatgagctgggaggtcatgcgaattgtctgcccaagcacaagggagcgtgatatcttttaattagagtaaggatgaaggatattagggaccttggtctgtcagagaacttggaacacccaaatgctatacttcattcaagtttctctttaagtttcaccttatccatggaagcttttctgcataaacttccatccccacactgcatcccatccctcctccgaaatgcacttccctgcgctttgaatctcatcagcatttggcttcaactgtatacaatcttggctcccacagccattttgaagctgcccttcagcagatttgagacccattctttatcctgtgagatagaaccttatcaagatgtgaaactctgtagcctttatagctcattttgttatatggcaattggatcctgggaaaaggtgacttggaggaagccatcattggcctttgagacctataggaattcagtagaaacactttcaggatgctttgtcaaatgacttgtgttaagatgccaagggtttgtcgtgggctcatgtaagttttaacccttttcaaggctactttctgtaagcattgtatcatttctggggtagagggagttgagggttttttggtatatctgcctactcagccttggtgtcaaccagtacttcctgggatttggggtaggaacaatagaagttaaaaaggaactttgtgttttaggtagggggaacgtaggtactggtttgctcaggatagtcctgtgttacacctgctgtcctagtgtcattatcgaaggcacatttgtgcccttcacccacaaaagtgttccagtttgtacaataaacttagctttaggcagcaccttagctttaggcagcaaatatgtaatgtacaggatcacacccagagctagaaagactacagagttttgcagttgatgagcttctatctcactgggataaagaacgggctttcaaatctgctgaaggacagcttcagaatggctgtgggagccaggattgcacacagtggaaacaaaatcctgatgagattcaaagtgcagggaagtgcatttcagaggaggggtgaggtgcagtgaggggatggaagtttttgcagaaaagcttccacggataaggtgaagtttggagagaaacttggctgggtgaggtggctcatgcctgtaatccctacactttgggaggccgaggcaggggaattgcttgggtccaggagttcaagaccagcctgggcaacatagtgagaccctgtctgtatgatttttttaaattagctagccaggtgtagtggatcacaactgtggtcccaactactcgggcggctgaggtgggaggtttgcttgaccccaggagactgaggctgcagtgagtcatgatcataccactacactccagtctgggcaacagagtgagaccctgtctccagagagagaaagagagagaaatgtgaatgaaatatagcatttgggtgttccaagttctctgacagaccaaggttctgaatatccttcatccttattctaattaaaaaacaccacactcccttttgcttgggcagataattcacatgacctcccagcttgtttggcagcaatatgttttataattatatattttataagcaagtgtaaaaaatacttgcttataaaagttgttcccttaacaacttaagattgcatggtcagactatcccagggaaagggcttctccaagccaccaaccctagaaagtatcctctaccaatcggacaggatcaaaacgtcacctccaggaattggagctctcagacactgctggcaggactgtaaaatggtgcagacactttgcaaaactgtttggaaattctcaaacaattcaacatagagttaccatatgactcagcagttccactcctacacatatacccgagagaagtgaaaacatatgtctacacaatagcttgtacatgaatgttcatggcggtattattcataatagccaagaagaggaaacaactcaaacgtctatcaactgatgaatggataaacaaaatgtagtatatccatataagggaatattatttaaccatgaaaaggagtagagaactgatatatgccacaacacggatgaactttgcaaacataatgctaagtgaaagatgccatcacaaaagactgcatcatattattccatttctaggaaatgtcaaaacaggcaaatccatacaaatagaaattagattactggttccctaggactgagcagggtggggattcagggatggaagagtgacagcttaatggtacagagtttcttttgggggtgattaaaatgttctaaaattgattgtggtgatggttgcagaactccacgaacatactaaaaaccactgaattgtgccatttaaatgggtgaattgtatggaatgtaatttagatctcaataaagccattaaacgtgtggcctccaggcataactcagactcagtaccagctacccagttaggcttgcactcctttagcaaggacatgggcactctcttccagagagctcttctcaggcttcaaaatgggcaagcatgaacttgggcaaatgcctcataagtgcaaaccagtgggaagaagccttgttaatacccataagcctttggggtttttttccccctttatagaaacatccaacccagagccacagagtccaataataattgacagacaagaaccttagagcttgcctactccaatccctctgtgtagatgctcagaaagaggaagtgacttgctcaagtcacacagctagtcagtggcaggacatggaccagaacctgatgctcctaactcccactccagtgctctttctcctgtcctggcttctccactacttccctttcccctgccttgcccaaatcagcccctttggcccttcttgctaaaatctaggagtcaagtctgagaatccaagcacaaaatcagggtgaatttacaattttggaaatatggtacaattttcctaagtagtagatcagaagatctgtattataggtcttccaacatcaggatgtggatggagtacaggatttgacccctggtacaactaaatttgtggaataatcacatgcttctttttatactgtatttggcagtattagaagagaaaaataatattcatcttaggaaaaccttggtaactgcaaatttgctggcaaccttatttcctcttgctttcttggaagaaatcaaacgaaaaagcagctgtacaaattagccctgaccaacaggctcaggaccaaaacaaaacaaaacaaaaaataataaagccaaaaacaaattaagcttaatatttaaatcagaatggaaaatatatccaactatacgcctactggaacccttgaaactgctaatctctacttgattattcacaacctgacctttgcaggaggtcaggacaaagctggggacagtctgaccgaaatgtatcagcaattttccaaactccttcatctgcattcacagattttcctgataaccctaagagcagcaaaaccattgatcatgcttgttggagtcctattagtaccacagtgaaaagaaaatgtgcttagtaggccatcagtcaacagaccctgtgtgccaggtacaatgccagtgctagggggagacaagacggggaagaaatgatgcctaccaacaggagccatacacccccaaaatagggtgaaccaggcatggtgtagggcaagagcatggggcaagagcaaagctgaagggctaggagagtagatgtatgttgaataacattgaggggactagtctttctggaatagagatttcttttgagggagttaatgggatgtttgattgaaaaagaaggttggagacagattgtggaggcaaaatggagcattttgaagaggtgagtggccagatgaaaaccacatcaggggagccttctcttcagcctcccctcaacactggttttggtattctctgggctcccacaaccccctgggccttatcctagcactttacacattttcctgtaattcactgcttccttgtacttcttccctcaaactgatttccttgtgggaacagcttacatctggttgatgcatatatccctaatgcctaacaaagggtttaacacgtggtcagcactcaggaaatgtgtgttgatgggatgggacaggacgggatgggacttgatagaaggttagatctgtggaggagccatctggaagagaaggcaggaagaggagatcagttagaaggatgttgccctgggagatgaggaaatatggccctgacccaaagcagtagcgatggtgacagagaagaagggaggatgtctgatgtattttgaaagaagaatagacaggacttgggaaccttagttaacactgacctgaggaaacaatgcaaaaggactgtggaaccaaagtaggttccccatgaggcagtgtggtaggtcctacagaccccaataggattaaccagcctccatttgcactttgtggacaattggttatgagcacagctgtacttttcatgtctagaggtgaaagggactagaccattgctgaggggactttgcccagctgtctctgtgccggctgtgctaagtccccagggagctcatgctgaccaataaggcaaagctcaggagtgatgaaccaccgtttggctgtcttaatcctaaggcctcaactcagctctgaccacctggaggtgtcacacaaagaagtccaaaataaagaagagtgtcagcccaagaaacaagagtctccttttcctagccatgcctatttcgttccaccttcagtctttctgcagctcaggaagggaggggtgagagaaaaccacggaacttttcaaaatcccattttccaaaagctaaatcagattcattctgtgtctcctgcgcagactgcattagtctgggtaatgtaaacactgtgaggccacagctgtctgccagctgcaacgttaaagcccgttttggggggcatgaaaaaacctgtctgtaactatcacagatgagaagtgttagttaatgaatggtccctgctgagtccagagcccagctgagttatttcagtcttgagccttagcagagatttttattgggtaacaaatttcaaatgctccagttacccctagaccccagattggagctcgttgctcaatccaacccccacgccccagccaaaactaattcactccagggacattcctgattgcagctcaagaatcttggtgtttggagtgttgggtgattgctcaaggaggatttggtaagggcttaataataacatcagcctccttgtgctccctgcagaagtgtggagagtgacctttttcaagagtagggccatccgtggcttccaccagggctggtcagcttggagcagcctaaggaatggtggctttgagttggacaccactgtttctgctgggccttggcttaaagctctgggttttgctggcacctttccactcctactattctttctcctcctacatgggctcaggtcaggggcaaggccaagagggccaacaaaccaccagctgcattgagacaggggctagggcccaggcctttacgtgcataattcagtggcatttcgtacgttcacaatattataccatcatgacctttgtttagttctggaacatttttatcatcgccaaagaagatccccatacctgttaagcactcatttcccatcccctcccctccctgtaccggctcccggaaaccactaatttgctacctgtctctgtggatttgcctattctggacgtttcatacaaacggaatcatacagtatgtggtctttgttgtcaagccagtattctttgagtacccactgtaatagacatgaggattcctcctcaggtgcagcagctactgctttttagaatacttagcttaatcaaggcacatgctgggtgattgatttgcaccattctgtttaatcttcacaacaactctctaaagtagataataataatgttcccatttcaaagatgagtagtccaagactaagagaaattgagtagcttggccaagatcgcactagtagttaagattccaactcaagtccttccattatttatcatgtattcagccctacttagagccagtctacttacttagaagcaacatactctcttcgtggtatgtgctgcctgccccatcttgcccgcccttaaatccccactgtgacagaccccataggcaagggaataatctcatgagccccttgtgaaaatacccatgtgttggcagggctagtagcctggtatgagtgcccctagtattcatatgcccttgggcacacccagagttttctttagttcccagagagctgaatataaccccacctccttctctcccactcatgaaagcatatgggtatgttagtgagagttatttatagagaaatctttgaatctgctcaaatttatttttaagtaaatcatatgcaagctttggtatttgattattagaaataaataataagtgaggccaggcgtggtggctcacgcctgtaatcccagcactttgggaggccgaggggggcagatcacccgaggtcgggagtttgagaccagcctgaccaacatggagaaaccgcgtctctactaaaaatacaaaattagccaggtatggtggcgcatgcccgtaatcccagctactcaggagtctgaggcaggagaatggcttgaacctgggaggcggaggttgcagtgagcttagatcgcaccattgcactccagcctgggcaacaagagcgaaactctgtctcaaaaaaaaaaaaaaaaaaaagggaagaagaggaagaaagaaagaaataataactgattatcaaacaccaacgtgtcctgacatcaaaggtgagaatttttggtccaaacacatctagaggctgcaaagagctacacctcagctcagttacctccagtttgcaggtgaattcccagatcagtgaagttctccctgaagactgaagatcggattgtgtcaaaggtctggggtggccttcatgaagcagcctcaaaggctgtgcacctcatgtctggacttttgagcagtgactctggctgcatctgacagggactctcatgtcccaaccacatgtacaagaaatcacaagggcttgacccaagttctgcaataaaactcaagaaaaaggaaaaggaaaatgtgagttgttccactgttttaaagacttcaggatatatgttttaaaaattcacaaatgggagcggcactcaggaaagttcaatggaactgaaagagacaaatattgatactcaacagtcagcttcaataataataataataataatgggaccgcctgaattcaaataaatggaacagatgttcctcatgtgttctgagttgaaaatcattccttcatgtgggatcagttaaaaatcaagcttgggacttactgtatgtttaatataaaaactctcaataaaaatactttggaggcaaaatccaagtgagggcatgctgcaatcatcagtgcaaataatcaaccagtcagcatttgcctgtaagagaccaagggatgtacatgtgtgaggatgagaattactgagatagaggtggtgatagaaagttatttgccatcacatctaaccggagctcagcatgcaggggttttctcaatgtaagtgggacttggaaattgaagctgtggtgagccatggaaaaatggaaaaatcaattattttgatatttagtggacattagaggaattttcaaaagatgggctcttagaaataaatgaaactgtcccacagaatagctaatttcaacttgaaccagcccagccccagtatgggggtggatataacgagaggactttagtactttagtctgccatcagtactccatccacacctaacatcagagctggaagacatactagaaactatgatccaacattctcacttcactgataaggaaacaggcacaggagtctcttacacatgcccagggtcatagaggaaattcatctccaggcagaattcagggaacccactaaaagaaagaggcagaatcaaaatggaatatagaaaacattgttgccctttcacaatacaggcataacattaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagatgaaggcatagaagggatgtcatataatcaaagtatatagagaaactcctgaaggtcgtggatccaggggagttagacacattcatcagattctggagtacaagagagatgcacagcctttgcagtgattatcaggaaaaacagactgaaaaaagcagctttactatacacagtggatatgggatgcccagtaaatgtgaaggaagtgtgcaaaccttattctgaaggtgttgtgaagttaaaaagcattttaatgcttccagtaaaccaattcttggtttaataataacattaataatagctaccatttattgagcacttacgatgtgccaggcaccatgctgagctctttacatggttttcttatttcctccttttacctttatttcatccttttttatttcatcctacagttgtgatgtaggcactacctccatttttcagatgaggaaaccaaggctcagagaggttaactcatcttccctaagtcagacagctagtcagtggtggaacctcccctcaaatccaggtctcccttaattccagagcacagaaacactcccccatcctgcctctgtaattgggacagcttggttgcttgagactctccctctgacaaaagtggtattttagaatgttcattctggctggtggaaaaagtgaactggaaagataggccccaggaccaaggaaccagttaggaggcagaaccaatgaaagggaatgaaaataaagaattctgtgaaatagaactggaaggagaaactgacagactccaaagacgaataggatcttactgtgccaggatctgcttttgccatttaggatatcgtggagatcttcctatgataagacatataaatctgccttgtaccttttgtgactgcttaggcattcaatctgtgggagtactactacgacaaacactgttctagtgagcatgctggatatacgtatatctttgtatactggtatgtatataagatcaattccaatcagtggaatttctggcctgaaagaaacatattttaaattttgatagactttttcgggaagattttcatagttgagtgattattattttaaattaggggtgtgggagggaaccttccttggtagatatactatagcagaaataaattagttggtcatcattcaaaagtgtaatcaaaaagcacaaggcctttcataccattcctaccaaacaacatcaatgttgtcgaagctaattacaggaagaaagggaacagaagacacagtaacccttttgggaaccattttcaaatggagaactgggaactcatctctcttcattacttaattttgagggaaggggaactatgctgaagtgttgagcagctggatagctgtggctgtcatttttttttttaagggaaagggtctcactctgtcacccaagctggagtgcagtggtgtgatcatatctcactgtagcctccaattcctgtgctcaagtgatcctcctgtgtggctgtcatttaatagacagcctattgagaggcttctaggaggaagattggcaaactgaatacagggcaattttcagatataataataacaacttgattttgtttgtagttgagaaggttggctattgtttttagttaggggatttaaataacttctttaaaacagctcccaaagggaagggaaggtaaactcaagtgttattatgaagtataatggtctgtccctccaagtgataagtttgattcactgctagcagagccagttctgcttggcacctccccagtactaactgcctctggccaaaaagctaccaggccctggtgccagatcctgggtgtcatgagccaagtaagaagaagggagtagatggggagagaagatagctgaggcaagctgtctctcccagagagatgggttacaacagaatccaatgcaagcttttattggagagacctatgtgtggagacaataggcctactttttaaatttccacaaaatgaactaggtacagaataccactattttattcattcacttgacaaatatttactgagcatctactatgtgccaggtactttgataaacactgggagtaaactgttgaacaaaacagaagtgtcccctgccctcagggagcttactgtttcataggcaaggtgagtgaaaagcaagtaaacacacaaatatagaattacagatggcaaaagaaaaaatacaggtggggcatggactaagggtcaggatggtgtcgccatggtggcctggcatttagagtgagttctgaataaagagaagggagccacctttcaggctgaagggaacgtgtgtgaaagcacttttgggattcaggctcttgaagtcgctggtcaggcaggaggctccctgaaatctgctccactttttgctcctcactgtgcaaaccaaagtgctctaggctttgtggttgctcagggcacagaggaccagatgggttccagagaccagcctgaaagttccccagtgaggatgcatggtgatagcctgcgagtttcagccagttggatgaggtgagcttccaaaatattcttaaaccctacagcctccgagacccatttcccagtgatttccattcctggtcatcactttctttctgcaggggacacttgcctgtggaaaagcagtgcctcgccttggttagggttaaagattgaggcagtgctggccttcaggaaaagtgcaagcagcaatggagagagagcaaaaactgaagccaaggaagcagcccctgccaacaacttccgttctttccctttccttcggcatggctgcccaaggagcccccagtgactgttcatggtgatctgtttgtttcacaattgacaaagaaggagggagccctttctgacatttttgcccagaggacccagatttctcagtttgaaactgccaaatacgcaactttgggtggatatttggctgaatcactttgaagggcttgtcagtgcctaaaatggaaattgttagaaagcagaggagggtggttgccagcaaccatgaaatggtaatgaccaaatcatttatttttgcaatgaaatgtcatcccctaacactacaaaggcaggttttttctagcttagaagtactgactacctataaaaatcttcaaaagtgattctgtgtgccatgcacatgtacacatataccccatttctctcaccctctgccttccctcctaaaccaagcttcttccatgttcctggagcccagctgcaacctgggatgaattaagatattggctgattatgaaaggtaatcaggcttcagctatcatataaaatgaaggggagttcatttggttatttgtaagatggtatgtggctgactttctatgtgggaaagtcagtaggctgtaatagatcatgccccaaaatacgatgtggatcttttaaagatctgtttgagtctagctgtagttgcacctaggagacatgatacttaataaggtttctcctatctatctatctatctatctatctatctatctatctatctatcatttatctgtcatctatctatctgcttcattagcaggcaaattaggcaagatctcccattgtgtactttgtatttttaaatgctgacaccttttttctgagtttaggaggaagatactggaaaatacattgtgggttgacactggggaatgcaagaggatctttctttgaaaacagccattaagatactattcccctgggccaattcctgggcagttttaaccacatacaaagccccaggttcttcttctagcttttctatattgactcctgtgttaagatcagtgaaaatttatactatcatataatttattttaaagtaatactttacaagcctttggcttgaaaatatttcagtaacatctgcacattcaatactgaaaagtaagatggctccattctgctctcattatagtaggctttgagaggtatcttttctttgtatcacagtcattagtccagtggttgatcagcttctttttcaacagaagtggctttttccaaagtcctttgtgattgttgatgtgggatctattctgaaagcaggtttgctgttaaggaaggttataggaacattaccgtttagccatggaccttgatcatctgaatgtggtagctgggtgttatctcagtgcatttgaagctcatgcttatggaatccctgttatgcaaggggttggggaagcccactggaaaaagtggctccagtgtggatgaatccgtccttcagattcctttgtagggttggcttaaagggcaattataaattagtctgtgtcatttctgtccatttcccaaccttttaagagctctcctggccctcgatctgcatgtatctaataccactttctcagcctcagtttcctaatatgtaacacgaaggacttggactagacaagctacaagttctccccaaactctgacacttgataaatctaatgcacttatcagcagagaggaatgtggctattttccaactctttctttagtttggggaaactaattttatataatgttctttccctgtgtttcccttttaaaaggaaaacatgacccatttccggtgttgtaaagtcaacactttgcagctctgcacgaggaagcttctttctatgtagaaggggcacagaatgccacgggaaccagggcaggaaccaacacctgacaagagatgcaggcacatgcggcatgtggggcgggctgtccctcacaggagccagaatcatcagtactagcctcagtcctcccatgcagctggccccactcagaagcataatggtgtggagcagagatccctgagctagcattcctggattagagtgcttactagctgtttacctccagtgagttaattaacctttctgtgcctcaggttcctaatctgtaaaatacgaataataatcacactactgcagagtacagttgcaaggattagataagatcacgtgggcatgtaaagtgcttagaacaacgtgtagcacacacatattaagtgctcggcaaatgttaactatttgtccattgggctcaaatgtccaagtatggatccaggagttgaaaggttggattccacagggccatcctccctcttgtgtccaagactctttgtggtctaggacaacttttgtgagaacaacttgtatctgctctggaatagatgactttcccttttctatagagctactgtccaactagcccagccttagtgtccctgggttcacaagtcagtgataatgaccaaaaatatgaaaaactatctgacgagagggaaagtgtgctcattgagaccccagcaataagcaattgtctgccattgcagaggatttaacagagctcagacgtgaaggctcttgtagttgacaaaggatctttagaaaagaatgttccctgagggtgctccatgtctacagaggcccaaacaagagaaaacagattgtggttagacccagggaagacatttttaccacacacagataaaatgctgggccacattcccaaaacaggttatgtagtgtcttcccctggtaaattgggaaaagagtggctggccatctgtcctagattgtttcatagaccaccagagcaggaagaacccttagaggtcatcatatccaaacctctattttaaggattgagaatgctaatacacagagggaggagataattgccctatagtcatatagcaaattattagcaggaccaggatttaaatcttaggccaacacagcttgccactgcaccttagttatctcttaaggcactcaaagtgctgtcccttctagttctggaatgctccatggtatcaatgtactaaaaaagtaactgaggcccacccagaaggactcgaaggtgttgagcagtatccaaattgcaattcctctagtttacccatccgattttggagctccagctgtcaaagtgtttcagccaagcctcctcattcaactaactggtcttaacttaccatttgaaagcagctgtggttaaagcagagcttgctgactcagcccatgtagtaaggatgactaaacacaagaatttcctgtggaggggggaggagggggatggaaaatatctttcaaatgcatttgtttcagggaacccttctgatcagtcaggaggtagcccaccgtgggcccatgaggaaaagcagcaggctgtccccgctcagcaccaaggcaggatttgcagatgtttcctttcttttttctaaacaacattgtggctgtctcggcaccattttggtctggccagcatttgcacagagcttcatctgccaactgatacagcccaaagccaagcggagcagatgccttccctgactggaggggcctttcacattcctctgctcagagcccaggggtgaattggggctgatctgctttatctcaagacagtttcaattctgagcccaccttgaactcaaaagagaggatcacttatgctgaccgatcagaaaatattgtgggctggcttccatctccaggatgcaccttggggagtttgcaatctggagtaacgttatcattttcaggtctgagtaccacacggccattggacaacttcaggaaacaaacattgaccttcagttgggttgctcaccagcttaaagcagtaatccagtgaacccaaaatttgggtaaatattttaagactgttggctggaaaagagtctgccttgctcaattagaaagtggaagacacctggtgcatttgggggtgacagattttatttacaacttgcaaaatagaaaagggcagcagggaaaaagagagagtgaacatactcagccatattctgaaagccatatacaactcaaacagttcagtcattgaggattcaagtccaagaggcctgcctcaccctcatgctcacaaggagaaaacaggactaactgcctccgaggtctcaaacaagaccgaggattttcttttcttttttttttttttttttttttttttttgagacagagcctgctctgttgcccgggctggagtgcagtggcacgatctcggctcgcggcaacctccacctcccgggttcaagcgattctcctgcctcagcctctcaagtagctgggatcacagttgcgcaccaccacacctggctaatttttgtagttttagtagagatgggatttcaccatgttggccaggctggtcttgaactccagaccttaagtgatccgccagactcagcctcccaaagtgctgggattacaggcatgagccactgcgcctggccaaggatctatttttcataagcaagtaaaaatttcttcatctaatgggggaaatgttctggaacaggcaatgtggagtaatggaaaacaaactggtctggcaagaggagaggggagaaggaaggagggagtgtcccagttcccttgggtgtgaagggtgacccaagaagtgtaagctttgaagtgttatcttacttttctaagcctgtttctgattcagtaaatactttagctacacatagtgcctagtaataatgttttctgaataagtgagagtgagagagaaaaagaaagcaatgaatatatgaatgaatatgtcaagaaagtgaattaatatatgacagaatggtaaggatttgcgtagttcatggagttggtttgaagcttaaatgaaataatggttatgagttctcattttctaacactacgcttaatacattatctgtatactcactatcttatttgaatctttcgaggctcctgtgagataggcagggtaaggactgtcacctgtctgatagagggaattgagtatcggagaggtggagaggcaatagatgatggaactaggggctccgcatgcagtgctccttctaacgtaccacacaacctcttactttcagatgaaaaaggtttttaaagaagaaagttctataggaccaccacataggatctatgacttacaactaagcaccttttatatgagggcttaaacactggaagtgggcttagaagaagaaatatcaggctaggactaacaatgctattgaagattatggtaagaacttgtcaactcaaaatacaagaggccagggggaaatggtgttggaatgacttgggtttggattatctaatatttttgtaaaagaacaatgggacctctagttggcaaggaactaacagttgctatttgaaataacatgggccactataagaaggttgactgtagactcaagtaagtcagccagtatctacttagtttgtcccatcaggtgtctggcctttcatgaagccataagctgtttagcaggaacagacttgtggtctgagtcttctccaggtttacatgggtcttagaacctttgactcatgatactgaatggtgctgtttaataaagtcatatagtctagtccccatccagtaaagctattcctatctgatgagtcactgtccaccctccagtgacaaaacaaatgaacaaacaaacaaacaaaaaacttactgcctactgtacctatagtttccagctttctgttctggacagttatgatggtcgtctgtgccatcatcatttctaattgcatggggcactagggaaatagagatatgttcattgtaagtgtacctcatgcaggcaattagacattgaaaacaaaattttcataaagcaaatccttatttttgtgccctagatcggcttgttatttaaagaaatcattgatctctagtttatcattttctaaaacacagaattaggttttctttttcttttcttttttcttttttttttttttgagatggagtcttgctttgtcacccaggctcaagtgcagtggcgcaatctcagctcactgcaacctccgcctcccaggttcaaacgcttctcctgcctcagcctcccaagtagctgggattacaggcgcatgccaccatgcctggctaatttttgtattttcagtggagatggggtttcaccatgttggccaggctggtcttgaactcctgacctcgtgatctgctcacctcgccctcccaaagtgctgggattacaggcatgagccaccgcgtccagccagaattaggttttcttaatgcaggagttttaaacatggggtctgttgctcttggactagctatgggaagctgggtgaatttttctgaaactatgtgcagaattgtgtttttgcttttacatacttttctgagaggatctacagctttcctcaaattctcaaaagggttaacacccaaaaaggtgaagaaaaactgggtgaaaaaaatggtggaactataattgtgtttgtgagtcctaaagtatgcagcttcaactgcaattttttaagaaggtggctttgtctctgtcaattgcatggtctggttctcttccttctgctgcctctgaaggataggtacccatgggacatagtgccaagctttgactttttctctgtcgtatttgcagggtattaaccatgctaataggagttgaatggcaattgttgtagactaaaataaggtattatttgataacatttctaattccttgtcctcagttgtcaaccccagagtacagcctataaggcagacatctttgttgcatgacttcagctttagaatcagagagctctgtgaccttgggaaagtcacttaatctctctgagcctcagttttcatctggcagatgggaataataacagggttgttgtgaggattataagtgagatgatgaggctgggcatggtggctcacgcctgtaatcacagccctttgggaggctgaggtgggcagatcgctggagcccaggaattcaagaccagcctaggcaacataacgaaaacacgtctctactaaaataaaaataaaaataaaagattagccaggcatggtggtgcacacctgtagtcccagcaactgaggaagctaaggtgggaggattgcttgagcctgggaggttgaggctacagtgagccatgatcgcaccactgcactccatcctgggcaacagagtgagaacctgtctcaaaaaaaaaagtgagatgatgtatataatgtgctggaaacatagtaagtgcttaataaatagcaatgccaatggtacctgtgctgataagcaagttcttaagaagatccaaagctctttcctgaggatatggatagctctgtctgggagctaccttgctgcccggggccatgctcagtggtccatccatgggcatgggaacaaaaccagtcggacctttgtcactttattcaaaacatagggtttggcctgttcaacacttgtactctgctagaaactgttgaggagccctgaaaccatgtttgactattaaacccagaagttctatgtagggaaaagggaggaacaattggtgcagtcacatcagctcaaaagttccagtcggtgctttgacccagcagcaataatagtgtccaaagggccttcccatccctgttctcattttatcctcaaaacagccatatgaggtaagcagagcaggtgctggagaagccacttattgcagcaatgatacaagcaggtccagaagttttaaggactttgtgaaaatgcagtggtttgtaaataagtaaaattcgtgtgttagcaggaaatgtttattgggtattcgtttttgaatattgagtttattgagtataactgaatatagcacagagctgggcacatggaaaggcttatatagtcagattggtgtggcaagaattccatgacaatgcatcaaaaagattatatatcatgaccaagtgggatttatccctgggatgcaaggtgagtttaacatacacacatcagtcaatgtgatacacctcattaacaaaatgaggctaaaaaccacctgatcatcttaatagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctgggattacaggcgtgagccactgcgcccagctaaggtgaagcaatcttgagagggaaaaagagagaaagttgggggcactttctgatttcaaattatattacaggcaggtggtccagtggctcatgcctgtaactccagcgctttgggaagccaaggtgggaggatagcttgagtccagaagtttgaaaccagcctcagaaacacagcaagatcctgtctctacaaaataatttttttaattagctgggcatggtggtgcatgcctgtagttctagctaccagggaagctgaggtaggaggattacttgagcccaggagttcaaggttacactgtgctatgattttgccactgctctctagcctgagtgatgagcaagaccctgtctcttaaaaaaaattatattaaaaatctatagtaatcaaaacagtataactctggcattaaaaaaacacatagaccaatagaatagaatagagagcccataaataaacccaagcatacacagtcaactaatttttaacaagggtgccaagaagacaccatggggaaagggcatctcttcaacaaatggtgttgggaaaactggatatccacattcaaaagaatgagattagacttttataccatacatacaaatcaactcaaaattggttaaaggcctacatataagacctgaaaccataaagctagaagaaaacctagcagaaaagcgccttgacattagctttggcaatgatatttcagatatcacaccaaaagctcagattacaaaagcaaaaataaagaagtgagactacatcgagctaaaagcttctgtacagcaaggaaaataatcaacaaaatgaaaaggcagcctacagattgggggaaaatatttgcaaataatatatctaataaggggctaatatccaaaatatgtaaggaacacacacaactcaatggcaaaataaatcaataaataacctgatttaaaaatgggcaaaggatctgaatagacatttatctaaagaaaacatacaaatagccaacaagtatatgaaaaggtgcacaatatcactaatcattaaggagatgcaaatcaaaatcacaatgagatatcccctacatctgttaggttggctattgtcaacaagtcaaaagataacaagtgttggcaaagatgtggagaaaaagggacccacctgtacactgctggtgggaatgtaaatgagtaaagccattgtggaaaacaggatagaggttcctgaaaaaattaaaagtggaattaccatatggcctatcaattccccttctggatatatacccaaaggaaatgaaatcaacaccttgtagagatatctgtcctcccatgttcattgcagcattaatcacaatagccaagattcagaaacaatttgtgtccatggatggatgcatggataaagaaattgtggtggccgggcacagtggtacacgcctgtaatcccaatgctttgggaggccgaggcaggaggatagtttgaagccaggagttcgagaccagcctgtgcaatatagtgacaccctatctttacaaaagtaaaaaaaaagaaaaagaaaaaaaattagctgggcatgataatgcacatctgtagtgccagctactcaggaggtggaggtaggaggatagcttgagcccaagagtttgaagctacaatgagctatgatggcaccactgcactccagcctgggcaacaaagtgagactctatctctatataaaaaatgaaattgtggtatgtatgtatattgtgtgtgtgtgtgtgtgtgtatcatatatacagaatactattcagcctagaagagagggtgatcctgccatttgtgacaacatggctgaacctggaagacattaggctaagtgaaataaaccaggcacagaaagaaaatactgaatgatctcacttatatgtagaatttttaaaaagagctgatgatgtacagcataaggactatagttaatgacattatatgtaatttcctaaaagagtggagtttagatgctcttaccacacaaaaaagtacttatgtgaagtgatggatatattaatttgcttgattgtattattttactgtatatatatatacacatcatgttatacacctcaaatatatatgcaataaacattttaaaagaatatgtgaaagtaaaatcataagaaagtataactagacactgggtggtctggtacagctaagagctgtgagactgtagcaaagggaagatgtaggtcggttgcaggatccagggaaggcttcctggaggaggtgggccctgggctgctagggaggtggagggaagcagtgtggcaggcagataagcaggagcatagaggctgggatgagcaggctgggggaatggaggggctcacacagtggtcagccggggggtcgctttgggaaatagtggtaattttgattaaagaggttatggaaggcattgattgctcaaacaagggaaggggactggacttgatttcgtaggcggtgaggggctgtgaggtatggcaacagagcggcaagaaaaggcagtggagttgggagagtccagctgggagccaggagtaagaatctagccatcaatgatcagagtctgggctaggacgaagccatagaaacagagaaaggggaaggatgaaagcgctcactggtctctagagcctttgcttggagtaacacaaagacctttctctctgtaaggagcaagtccatttttggtctttatatttctacagcatgagaaatgcctctttcatccaggagcacgtgccctgcttgaagaaaaccaggcaagacagcttgcaaaggagagagcctgggagatgacttttcatgttgcacaatggttcttcaccaaaggagtcacagagggtcttttgacatagacactgccctaacttatgtgcaagttactgccctgcatcctagggaggctttggggtgtgggatgacaaagtacctccacagtccccttcctccgcctctgcccatagttctacttgatgtaacaggtcttgtgagtcttttcaggtgggaaaatgctctctcagccttcacaggtcagtcatgaacctgatcccacatggacacaattctgttgacattttagcatgaaaggtacaaaagggaaatctgcaaaggggtctcaggattcagttccctggatcgtcctgtgcatttctttctcagatttgaggtttttccttttattttggagatggggcctcactatgttgttcaggctgatctggaactcccaggctcaagtgatcctcccaactcagcctcccgagttgctggggttaccagtgttagccacccaacccatctcagatttgagcatttctttcagaaatatgagtgaggtggtttcatgtggagacccctctgaggctctgaagcatcatttctacctgctatgtgtgcctgagaaacccatgcctggcccaatccccatataccctcaagtacaaatgggataataggaccccctgggggtccatgcacttgaccaaggttgctcttagaggctggattcagcacagattcagctactccggctcaggggcagggcaaagcaaaggtaccaatacattcatctggctggaaaaggaggattttgtttttacgaactttaaaggaatataaaaatgactttgttgtgattgaattgccttgctggatgaagtgccctgtggctccagggcttagagaggcttgtatggagactgtgtatttccttatgtatgtttctatatagatatatttccttatatacaaacatctgcacaattgtgtttgggagccccaggctaaaactaagaccctgacatgtttgaaactttgctggatagaaactaggggtggagaaatcctgtttaattgctgcaagtagtttttagcttataagagatgaaacatttgatattcatttaggacaaactcttcctgttttaatgatagcatctcctatgtattgagagcttcctatgtgtccggcactgtgctaaacgctttacatacataatctcatttaatcttcacagtgtccttaaaagtgaggtactattgttgtcctccattttacagagaaggaaagtgatgggaagagaggttgagggacttgattaaggcaaggtggctaataggtggaaagctggggtttgaactgtagtcttaatgactgtgcaaaacatccttgtgagaactacttaagtttcttctccctgcaaatttaaagcaaatactttctaatgaaatcaggtgtggtacaagaagcaaaaatggctttgcaaggaggaagatatacaaagtcatctaccagggaggcagagtagcatttctgcaaactagtttgctattggagcaattacatctcggctgaagagagaacaagtacggtgaggtgatggagtggagtttgactttgagtcccttgagtgcaagaaggccaagagccagaggctgacaggcctgagaaaccatagcacccatggagctgcttctaagcccaggggttcaagtgtgacctagagttgggcagagcagacaaccagctcgttgcactaaacctacacctgccttgtgtctcgtgcctttttatcatggtagtttttaactcgttatttctggcacactggaaagttttcatttttgggttgtccactgtgcatctaactaccgcattgaactcttattcattcttttgcgaaattttaattcagttacacctcttgggtttctagatatgcaagcatatcattgcaaatatatatgcatatatatatacatatgtatatatgcatatatatacatatgtgtatatgcatatatacatatgtatatgtatatgtatgtgtgtgtgtgtatatatatatctatatatataatctatatatctatatccactttacagataaagaaactaaggcactcagagaggtttagaaattactctaggtcagacagctaataagtgatagtgcacagatttaaaaataggcctaccttcagatcctgagctgtaaagtactatacaatatctctcatacataaattacatttttataaaaatgagatgacactgtatacattctttgtaatgtcctttcacttaataactttcttatatgcctagatgtattcaataacataattttaaggatgtataaaatacctttatcataaaagtataggccaagcgtggtggctgatgcctgtaatcccagcactttgggaggtcaaggtgggcaaatcacttgagcccaggagttcgagaccaccctgggcaacatggcaaaaccccatctctacaaaaaaacacaaaaattagccagccatggtggtgcatacctataatcctataagctactcagaaggctgaggtaggaggatgcacacctataagcctataagctactcagaaggctggggtaggaggaacacttgagccttggaggtggaggtttgcatgagccttgatcataccactgcactctagccggggcaacagagtgagaccctgcctcaacaaaagtaaaataattaacatttattgagtgcttaagatggatgagacatcttaacatggattatttcaaataaatttgtttacatgaggcaggattactggttgttgtagtcatatcagttcagaaactccagcttgtcactctcctacttgctggcaccccagcctgtcaccctcgaccagctttggagctgtgggatctgcatggattgttatgctatccaatgcaaaatgcccttgttttattcatatgggtaaggagcaagcagcaagtatctggactgagcacagggcatggcaaaggcagccagagtgaccctccacgttgacaaggattcctgggaggatttaacattactagtctaaattagggaccaaggaaaactgttctcatctagtttcctggaagctttgcaatgatactggaaccctaggaaaaccatggccgagaagagattttaggaggtacaggagccaaaggtgaagagacaccattggtgggttgagggggaccaggtatagtgaaagcatcaacactaacatcttgcccacaaataagatcccttccagccaggtgcggtggctcacgcctgtaatcccagcactttgggaggccaaggcaggtagatcatgaggtcaggagttcaagaccagcctggccaacatggtgaaaccccgtctctactaaaaatataaaaattatccgggtgtggtggcgcacgcctgtaatcccagctactcaggaggctgaggcatgaggatcgcttgaacctgggaggcagaggttgcagtgagctgagattgcgccattgcactccagcctgggtgacagagcgagactgtctcaaaaaaaaaaaatttcttccactgatgcacaatgtctatttaatgctgctatgcttatactatgaactgaactttgtctcctcaaaattcacatactgaaactctaacccgaaatgtgatggcatttggaggtggggcttcagggaggtacttagatttagatgaggtcatgaaggtgggttccccgtgttgggatttgtgccctttatagaagaggaaaagaccagagcttggaactccctcactttctcttcacccagatgcaccaaggaaaggccacatgaggcaggaagagggccttcaccaggaactgaattggacaacaccttgatcttggactttccagcttccaaaactgggagaaatcaatgtctgttgtatatatttttgctatggtggcctgagcagactaagacactggccatttacttcaactgattgcctacattttgaaagtgttagagaagaatggtttatgcttctcagatggctctcagaattacgttagaaaatatattttattcattctttaagaaaaatccgcaaacaattaccgagtacctgctatgtgccaggcactcttctaagcagtgaccaaggcagacatgatccctgccttcgtgtagcttacaatctaatggaaaaggcagatattgaacaaataatcttataaatagtgatgttatttccagttgttatgtggtgctaatgaagaagtgaaggagctatgaacagatataagaggggcccatgacctgaagagggaggatgagatggcttccctgtatgtgtgcatgcgctttccagggcatggtgtgagatgacaatgacattactagcagaaagaatggcaccacaggccaggtgtggtggctcatgcctataatcctaacactttgagaggctgaggaaggaggatcatttgagcccaggaggtcaaggctacagtgagccatgattgcaccactgcactccagcctgggtgggagagtgagaccactgtctctaaaaaaagaaaaagaggccgggcacggtggctcactcctgtaatcccagcattttaagaggccgaggtgggtgaatcatgaggtcaggaggtacagaccatcctgaccaacatggtgaaaccccgtctctactaaaatataaaaaattagccggacatggtggcgggtgcctgtagtcccagctactcgggaggctgaggcaggggaatcacttgaacctgggaggcggagattgcagtgagcggagatggcgccactgcactccagcctggcgacagagcaagactccatctcaaaaaaaaaaaagaaaaaagaaaaaaagaaaaagaagagtgatacaatttgatggaataaagcacatttacagtgttctccaaccaccaccactatttccagaacattttcatcatcccaaaggaaatcctatgcccctttaagtactcactccctgttgttccctcctccttgccctacataaccactgatctattttctgtatctgtggatgtgaacattctggatatttcatgtaactgggatcatatagcagtctttttgtgtctggctgctttcacttagcataatgttctcaaggtttatccaaattgtagcatgtatcagcacttcattcctttttatggctgaataatattccattgtactgatagactacattttgcttgtccgttcatcagctgatgaacatttggattgtttcaacctcttggctattatcaatagtgctgctaaacatttgggatacaagtttttgtttgaacacctatttccaattctattggatatgtatctaggaatagacttgctgggtcatatggtaattctgtgtttaacttactgaggaacaagaaaatagcactacttttattgttgtaaagaaaaactcaacaaccaaaacataatcatatggagatatatatttgtatttttcttttgcagcttgaaggaatacacatttgttgtctccatttttatggttcagtccaggcacagcttagctgggtcctctgctcagtgtgtcatgagcctgcagtccaggtgttgtctaggatgcattctcatctggagatctggagcttggggtccgcatccaaggttgttcaggttgttgacagaattgagttccttgctgctctagtgccgaggctctcacctcccggaggctgcccctctctccacaaccttgtttgcttcttcatgtccagcaggaaatgctgtctctcttcagggagggctaatagctttcacttgattacatcagccccacccaagataatgttttttatgttttgttacagtccagaggccttttttttttttttacatatatacctattatgccatgaattcatgcggagtaggttccagcagctccggctccttcccactggttcttgcacagtgtgcttctctgggtggagcgggctggtgcttcagttgaacccaggtacctttctctttggcttcctttttctctgaacagtttccttcatgcaattcaggatgctattttttggctcttaataaagtgcttaatatgctcaatatgcacattaattctcttggcaagaatcttaaccttgtgtttttaaaataatgccaacagcacactgggtaacaatgtaggctcttccagttttgccatgaaaacatttgtggggtattcctttctgaacagtgcccattcccttgatgtctacaatatcacctttcttgtagattcacaggtatgtggccaaaggaatgaacccacgttctctaaaaggcctagagaacacgtattgggtgcctcttctctttccctttgtgttcattattttggcaaaatactagaagatggtggttctggccaaaagtgatcatctgtcttttttattaactcaaaatcagctgatatgtgactttaattacatcttgaagctatattttaaaatattttgtacagatgtagagggtacaagtgcagacttcctacatgcatatattgtaccatggtggagtttgggcttttgatgtactcatcactcgaatagtgaacattgtacacaataggcaattttctgcaaaacacatgatttcattcttttttatggctgggtagtgttccatgatgtatagctaccatattttctttatccaatccaccactgatggacgcttaggttggttccattatctttgctattgtgaatagtgcagtgataaacatgagtgcaagtatctttgtcatataatgatttatttccctgtaggtagatacccagtagtgggactcctggatcgaatgatatttctaattttagttctttgagaatggatcaaatgacatttctattttttgttctttcagaactatccctactgttttccttaagttgtgctaatttacattctaaccaacagtacataagcattcccttttctccacatcctcaccaacatctatttttctttttaattatagccattctgactggtgtaagatggtatctcattgtggttttaatttgtgtttctctgattagtgatgttgagtgtttttttcacatgtttattggccacttgtatgtttaaagctatatttttaagcattatgataagcaatctagccagattagtgacaaaatgaaccctactctcaaggaggagaatccaagtgagtaattcagcacacgcacatcactacagttagaaaaactacacaaatacaacttttttttttttttgagatggagtctcactctgtcacccgggctggagtgcagtggtgcgattttggctcactgcagcctccgcctcccaggatcaagcgattctcctgcctcagcctcctgagtagctgggactacaggtgcatgccaccacacccagctaatttttttgtatctctagtagagacagggtttcaccatattggccaggatggtcttgatctcttgacctcgtgatccacccgcctcggcttcccaaagtgctgggattacaagcgtgagccaccatgcccggccacaaataccactttctattggccaacccaggaagaaacatgaacttccttcctcaagtttgaggctggagtctttgtcttagccttcagtcactagagtaagactggtgttctcctcatccaaccatgaacacattgaggacaagggcacatctgagtcatctctgtcatcccagtgcatggcacagtcaacatttgttggtggaaggaaggcaggaatgccacccatcccccccggggagatggtcttgggcacagtctctctttgcattgctcctgcagggtactgagccacctctaccctcacagcaacctcctctccatcatccatcacttcaggtcactcaatgatgagcaagccagctgatagcactttttagctacacaaatggataaatcacagaaaccaacatttgtcagactcagctatcctgattcttcttgtgaacaaaatgatcattaattcctttagacgagtcccccagtctccagccatttgtctcctttccccatgggcaaataaaaatgggaatcttattagtggtctctagtcatctcatagcattgcggggagagctgaagctggatgaatggacatccctgagcttgtggagttctcaccaagtgggcagtgactgggtatgatcccctttggagcctgtcactgctgttgacattgaaaataccggtgtggaaacaaatgctgtctttgtcacaggctcaactacaggggcctctccttccctaagctggcagctgagactaagtacttgagatccctgggccagctgttgtgaagtaaacgccaggcagtaggtaaggcaagattcagaactgggcagaaagccaggctggagagggagcactgataggaggggagcacaaaagttggcaaacaaatgctttccaagtaggttttaaaaaacacaatctggcctctaaagtagacaaagcaccaatggggggtgcaggggtgggggtgctgcctgaaaatgcctgctctgactatcagctcaagaagattctagaactggaaaggcactgtgagcaatgtttcccgaggaggcttcccttggagcacagaaagatagccacaccctttgaagttagctgggagcttacaaagggcagtgttgtttccactaaggaagaatgatagccctgcataatggtgtccttattctgtaaaccccagaccttgtgcgatgaggggcaagtgagcctgcaggccccagcaaagggggaggaaatggttggcaaaacacatacttttagcttgcttactggtcaacatggaaggtcttccctaggaagatggtgtggtcaaagtcaggggtctgtttcaactctcttccaaggatgattgctaaatcatatcaagatacctttttaatttgatgatggctgatgtaagtttccaaatgcttgcatcttctgtcatgtttgatgtatttcagtgaatcatgccacaagctgagaggccctagagatgaaaggctgatgagaaaaaacggatgagcccattgttttacatcagaatgtgaatggtgatatttctgagtagtgggattcctgtcacacaaaaggggaagtcagtaggctggcagtagctgccaagggcagcttattggacaattattagggaatggaatcctaaaattggaattttaacatagccttgatcaactttggaatgcctatggtattgcatcatacatgcttatgtcagggaccacttccaaaattctgactcatctcccaggccaatgaaaccatttcagcatgtgaattacacccctggtgttgtccaagggaatttttgtcagccctggtgcccaggactgattccattaggcctaggagaagctgtgtggtgcaacagaaagagccatgaggagccctgagctctagtcctagctctgttgccaattaactgtcattccaagtgaatcttttagtgaatctgtgtcttggtttcttcagcagttgaaaagagacagttgaatttgatgagttagtctcttacggctttaaaaataaaaatgcatgtttcatagcttggcatttaacaaagaattgtggatatgtaagtaatctaattttataattttctttaggtatgaaagggaccttaaacatcgtatagtccaacccctttatcatacagatgtagaaaccaaggtccagaaaggggaagggatttgatcaattagtgcagaattagggttagagatcaggtttctggattcccagtccagtgcattttccactacatttatttttaaatcaagtaatacatgagcatggtttaaaaatatcaaataggcagctgggtgcggttgctcacacctgtaatcccagcactttgggaggctgaggcgggtggatcacgaggtcaggggatcgagaccatcctggctaacacggtgaaaccccatctctactaaaaatacaaaatacccaggcgtggtggcgggcacctgtagtcccagctactcgggaggctgaggcaggagaatggcgtgaacctgggaggtggagcttgcagtgagtggagatcatgccactgcactccagcctgggtgacagagcaagactctgtctcaaaaaagaaaaaaaaaaaaaaaaaaaaaaaaaaaaaaaaaatatatatatatatatatatatatatatatatatatatatatatatataaaatacagagagctgataataaaaaacaacagttctctgccccactcctccccatccccagtcccactcctcagaggcaaccattttttaacagattctgttggcaattcatctgatagttacttctgaatctctaaatattactctgttcccattcttgatttatccattttggacattatctattaactcctgttataaaaatggaagatttagctcacttaacattactcccaactgcctctctttcttctgcctccccatggttgatagcaatattttatgagatttttaaaaattcactttttaaaatagcatgctattttaaaaatttacttttttggtgtacagctctatgagtttaggcaaatacataaagtcatgtaactgccaccacaatcatgatatagaacagttccattaccccccaaatcccctcatgctgccctttgtaattggcttctccctttaccccctacactgatctgttttgttgctacaattttgtcttttccagaatgcccagaaattgaatcatatactatataaccctttgatactgacttctttcactcagtataactattttgagattcatgtatgtgttgttcattcttttgtattgctgaatagtactccactgcatggatgtaccacagcttatccattcaccagttgcagaccatttcagttgtttccagtttgatagcattatttttagttattctattggttactttttaactgaaaatcatatactgaaacctctacttcttgcaccatcatccactatatagtaagtaggtcttctttttcagaatagtaaatgctttggactgattgaaaaacataatactttcatttctttagtcacagttttagacggatttaatttgagggtgtgatttttcatggggttgggaaggtttgctcaaatgctgtccagcagccctattcaaggctacagccattctaaatgcctcctgtcacatagggggccttctctagtaccagatatgcttgttgctgggaagatacgcatgtactttctgttctgaccgttgctaactcaggcagtagtttttgggaaaaagacctttcttcatgtggatttcagcttttgtctgtcatgctttttctgttccagctgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgccatttgaattgaaatgatccaaaagagtgtcatgtatatatgatggtaaaatattctgtgttaatgcagtgagtcaggcattctcaaacactaataggaatgcaaattggtacaactctcccacagggcaacttggcaaaatgctcgaaagccttaacaatgttcttatcctttcacccagtaattctccttctaaggatttatcctaaaaggaaatagagatgcacaaaaaaatacaaatacatggaaattcattgtggcaatatttaaaatagagaaaaagtggaaaaaacttaagttgtccatactatgaaatcctatgcagtaacatttatactatgaaatgcaatgtaattatttaaaatcatgtttagaagaatatttaatgacatgagtaaatgctcatggtctaacttaagtgggggaaaggaggatacacaaacatacagtgaaatcccaagtgtgtttgtgtgtgtgtgtgtgtgtgtgtgtgtgtgtgtgaagaaaaaaaatgactagaaagaaataatagaaatattaacaatgattagccagccatggtggcacatgcctgtggtcctacctactcagcaggctgagatgtgaggatcctttgaagtttgaggctgcagtgagctgtgattgcaccaccgtgctccagcctgggtgaccatgtccctaaacaacaaaccacaaagctataattatccctacgttgtgggattatgagtcattttcattttcttatttttgtaatgagcttatcttactttaaaatccaaatttttttaatttgaaagaagtaactactacttatgctagagggctgacattcataaaatcctagtaatgagatgtagaaccatttctccaactagtgtcaaatcttcatccttaaaaaaaaaaaaaatgagatcgggtctcactctgttgcccatgctagagtgcggtgggctgatcatagctcactgtagcctcaaactcttgaactcagtgtcaactcttcagatgacatgtggatggttacggcagtggtcagtttttagaaaaattaaataaagcccagaagccatttcagatttaaatgctctgaggggtggggtacagtggctcatgcctgtaatcccaccactttgggaggccaaggtgggtggctcacttaagcctaggtgttcaagaccagcctgggcaacgtggcaaaacctcattatacaaaaaatttaaaaaattagccaggtctggtgacatgcacatgtagtcccagctactctggaggctgaggtgggaggattgcttgaggtcagaagttccagaccagcctgggcaacataggaagaccccatttcaacaaagaaaaaaatgtgaaaaataagtcagacatggtggtatatgcctgtagtccgagctactcaggaggctgaggcaggaagatcgcttgagcccaggagttcaaggctgcagtgagctgtgatcatgccactgcactccagcctattattatttcaataataataataataataatgctctgagccttagtttgatattgaaaggaaaatatgtttatccttttctctaggcctagttaattttcatccttttctctccatccccacccctttttaaactttccagatctgtggaacaaatgttgagcaaactggaaataaataaaatccaatggctttaagataccacaaatccctcccttcctgtgtactaatggctacctgcccattctactccccagagtgaagggctagagtcagccaaaatggaggcttttctgattcaaacatgaaaaatgcaaatgctcaaaagatagaaaaacttaggaagtctgaaaagattgagacataacatgtacaactctccctcccctagattcttagcttcacgtgatataaactgttgggctctgctgggggaaaaacccaatcatagaaggcagatatattagtctgttctcatgctgctctgcagaaatacccaagcctgggtaatttataaaggaaaaaggtttaattgactcacagttccacatggctggggaggcctcaggaaacttacactcatggcggaaggggaagcaaacatgtctttcttcatgtggtggcaggagagagaagtgctgagtaaaagagagaaaagcctcttataaaaccatcagatcctgtaagaactcactcactatcacgagaacagcatgagtgtaggcacccccatgattcaattacctcccaccaggtccctcccacgacacttggagattatgagaactacaattcaacatgagatttcggtggtgacacagccaaaccatatcagcagatgtattaaggacagttcatatttcaaagaaatcacacaatcctagacctttagatctggaaggaaaatattccagcaagtatagggctccttccaaataccagatactatgctaatccaaatgttatctcataaaaaaccacctaccatcgcacctcattttatacatgaggaaactaaagcccagagaggggttattaactatcttagctcacatcatttgttggctgctaagttgtgatagttcccatatcttctggaaactctcaagtgaaaagatgggtttttctagtataatctttccttcagctccaaatattccaaatacttactgtgtacttgtgcttggatgttttgctaacagctcgagctaatcaggtacaaagtcaaactcatggtgtttccctcatctccctgtcacccaggatctgaaccaaagtctgttttgctttttactgaatttcatcccccacaaacagtctgttaacaagtcctgtcaattttttccttcaaaaactaccgccaggtcctaacatattgtcaaggaaactcaacctctacctccttaaaaaaacaacccttctcgaccacttcagccatactgctgcctctcttctggcttcatacagcacttttaatctgcatcacacagtttagtttagcacttgtcattcaggggcaattagcatgtgctcagcagcattcactcatgcaacaagcatgtattgagtgtctactatattctacaccctgaaatggagaattcacttttcttgttttcccatatagacattaaataccctgagagtcgaggccacatctttcttcatagtttcttaaacacccagtgcagttctgggcacatactgaagatctgttagttaaagagcagtacagactcaaggaatctgtcaccagttcagcagctgacgagctcagctcaggggacactttagtctatagttctgcttcaacatctcacaagctacacgagtatgatccactcattcaacaaagacaacgtattaaaatgtgagtttttaacaccataccttcagagataagtaatgagatctaataactaatcagagacgtgggatcctaaaagtcaacttctgcttttagaaagatggagtagatgtacttttccctattcctttcactaagtacaactataaaccctagttattatatatacaacaaacataagacaaccaagaaaggtggagagaagatagactgactaaggaccttgagactcaaagagtgacatgagttcgtgagttccctgagctttctttttgcctcaaatatcccagactggctgctagagaagctagcaattcagaaacaccagtgggaacagatttttctaaagtcccaacaaaagcctactctctctagccaaaggaccagaaaaggggcatcctagaaagacagaaaacttttagaccattactgctctactatagccaaacaccacaggaaaaactgcaaccctcacctccaactgtccatgcaaaggctgagtggtgagcctgaacttctaccccaatttggcagtaacaaggcaacccttccagttttttctactagagcaatgtcagaaaaaaaccactaaaacctaaggtttaaataagatccagagtctcatgacataatatccaaaatgaacagtattcagttgaaaatcattcatcataccaagaaccaggaagatttcaaactgagtgaaaaagacagtcaattcatgccaatactaagatgatgagatagaattatctgacaaagattttgaaacagctatcataaaaatgcttcaatgagcaattacaaacatgcttggaacaaataaaaacggaaagtctcagtaagcaaataagaatacataaagaaccaaatgtagactttagaactgaaaaacacaataaccaaaatgaaaatctcagtgaatagggtgaacaacagaatggaggggacaaaggaaaaaaatcggtgaacttgagtatataacaacagaaattatgcagagagcaaatagactggaaaaaaataacagtctcagggacctgtagaattattacaaaagatataacattcatgtcattggagtcctgggatgagaggaggagactaggactgaaaagtatttcaaggaataatggctgaaaattttccaaatttggcaaaagacatacagattcaaaaagcttagagaatctcaaacatgctaaacccaaagaaatccacactaagacatatcatagtcaaacttctgaaaactaaagacaaagaaaacaatcttgaaagcagacagaggaaaaacaatgatttggccaagcagagtggctcgtgcctataatcccagcagttttgggggccaaggcgggtggattgcttgagcccaggagtttgagaccagcctggacaacatggtgaaaccccatctctgcaaaaagtacaaaaattagccaggtgtggtggtgcacacctgtagtcccagctactcgagaggctcaagtaggaggatcactgagcccagggaggtagaggctgcagtgagccatgatcatgccacactgaacttcagcctgagtcacagagtgaggctctgtctcaaaaaagaaaagaaaaacaataatttgacagagaaactgataaacaattatttaaatggcagttgatttctcatcagaaaccatgtgaccagaaggaattggcacatttttcaaatgctgaaagaaaagaactaaatcctatatcccacaaaaatatccttcaggaatgaagtgggaatcaagacattctcagatgaaggaaaattaagagaacctgtctccatcagagctactctaaaataatagctaaaggaagttatctaaacagaacagcaatgataaaataaatcttggaacatcaagaagcaagaaataatacaataagcaaaaatatgatgaacacaatagactttccttcctctttgagtcttcaaaattttgtttgatggttgaagcaaaaataataatactgtctgatatagttctaattgcatgtagaggaaatatttaagttggttatatcataaactagggagataaagagacattaacagaagtaaggtttttatacttcactcatactggcaaaataacattaccagcagactgtgataagttatgtatatacaatgtaatacctagagccactcagaatctatacaaagatatacactcaaaaccactacagataaatcaaaatgttacaatattccccaaaatattcaaatactcataggaaggcaggaaaaagaaaacaaaattaaaaataaaatggcagacttagatcctaacatatcaccaattacatttaatgtatataaggtctaaatacaccaattagaagacagagactggcagagtggataagaaaaaatgacccgacagtatgtactctacaagaaactcaccttaaatataatgatataagacaactgaaagtaaaaggaaggaaacatatttatcatacaagcattagtcaaaacaaagcatgagtgtctatattaatatcagatagacttcagagaaagaaattatcagatatatatatatatatacacacattatatatatattatatatataaatggctcaacccaccaaaaagatgtagccatcctaaatgttcatgcaccaaacaacagagctgtttgtgaagcaaaatatgtgaagcaaaaactgatagaactgaaagaagaaaatccacaaagccacaatagttggaaatttcaacactcctctcttacaattgatagaacaactagacagaaaattagcaaagatatagaactcaacaataccaacaataacaggatctaatcaacatgtatagaatactccatccaacacaagcagaatacacattctgtagaacatagaacaagatagaccatattctgagccataaaagaaaccacaacaaatttagaagaattgcaattgtacatagtgtgttctctgacaataatggaatcaaattagaaattaataacagacagataacaggaaaacatccaaacacttggaaaataaacaacattcttctaaataatctataggtcaaagaggaagtctcaggagaaatgtttaaaatacattgaactggattgaaaataaaactataatatttcaaaatttgtgggacacagtaaaagccacgttgaaagggaaatttgtatcactaaattatacattagaaaagaggaaaggtctcaagtcagtaatctaagcttccacctcaagaacctagaaaaagaacaaataaacataaggcaagcagaaggaaggaaataataaagataagagttgaaattgaaaaaaaggaaaacaatagagaaaattaatgaaacaaaaacctgttcctttgcaaaaaataaaaaatttaatgaaattgacagacctctagcaagactgatcaaaaaaagagagagagagagaagaaacaaattaccagcatcagaaacagaacaggggatactactacaaaccctgcagacatcaaaaggttaacaactttatacacacaaatataacaatgaaccaattccttgaaaaacacaaactaccacaattcacccaatataaatacaggtagtagctccataactattaaggaaattaaattcataatttaaaaactccccaaacagagatctctaggctcagatggtttcactggagaataaacatttaaagaaaaagtaatgccaattgtacataatgtcttccagaaaatagaagtagaggaaatatttcccaattcattttattaagctcatattaccctgatactaaaatcaggcaaaaacagtaaaagaaaactgcagaccaatatcactcatgaatgtaaatgcaaaaattaataacaaaatattagcaaacagacttcagcaatatgaaggaattatacaccatgaccaagagaggtttattccgtgtatgcaagtctggttcaatatttaaaaatcaatcagtgtgaaccaccatattaacagctaaagaagaaaaatcacatgattatatcatttgatgccaaaaaaatgacaaaattcagcatccattcatgataaaatctctcagcaaacagggaatagagaggaatttcctcaacttgataaacagcatctgcaaaaaaacccctacaactaacattttacttaatggtgaaaaactgattgttttcacccttagatcaggaaaaaggcaaggatgtgcactttcactactcttattcatcatagtgctggacattctagctagtacagaaagtccagaaaaggaaataaaaggcatacagattagaaaggaagaaagaacattttcttattttcagatgacatgatggtctgtatagagaatagcaagaaaactattttttttaaactcctaaaacaaataaatgagttcagcaaggtcaggagatacatgcataaacaaaagataagcatacaattgtatttctatatattaataatgaatacataaacaccaaagttaaaaatacaacaccatttataattgctcaaaaaagacttaggtgtatatctaacaaaacatgaataagacttgtatgttgaaaactacaaaatgctgaggaaagaaatcaaatatctaactcaatggagaagcataccatgtactttaaatgctttaaatccattttaaagattaagcataaaggtgtcaattatttccaaattgatatacatgtttgacataattcccatcaaaacagcaacaagatttttgtacaattttatgtcaaatttatacagaaaagtcaaaggaacacaaatagctaaagcaagtttgaaaaagaagaataaagtgggaggaatcagttgaccctatcatatatctacagtaatcaagactgtgtggtattggtagaaggacagacacataaatcaacagaacagaacagaacccagaaatagtcccatataaatatggccaactgactttttaaaagatacacacacaattcaatggaggaaagatagccttttaaacaaatgatgatggagaaattgcacatccatggcagagaaaaaagaaccttgtagtagtcacggttctccagagaaacagaaccaataggatgtgtgtgtgttggggggcctgtttagagagagaaaaagagacacagcgctgggcgcggtggctcacgcctgtaatcccagcattttgggaggctgaggcgggcggatcacaaggtcaggagatcgagaccatcctggctaacacagtgaaacccccgtctctactaaaaaatacaaaaaattagccgggcgtggtggcgggcacctgtagtcccagctactctggaggctgagacaggagaatggcatgaacctgggaggtgtggagcttgcagtgagccgagatcgcgtcactgcactccagcctgggcgacagagcgagactctgtctcaaaaaaaaaaaaaaaaaaaagagacacagagagagagattgattgattgattgattgattaaggaattggctcatggaactgtggatgttggcaagtccaaaatttgcagggcaggccagcaggctggagactcagggaagagttaatgttgcaacttgagttcaaaggcagtcagctgacagaattccctcttcctcaggggaggtcagtcttttccttaaggccttcaactgattggataaggcccacccccattatggaaggtaatctactttactcaaagtctactgatttacatgttaatctcctctaaaaaacaaaataccctcacagcaacattcagaggtgtttcaccaaatatctgggtactgtggcctagccaagttgacacataaaattaaccatcacaaagctcagtctaagactcatactttatacaaaaagtatctgaaaatggatgatggagttaaacataaaaactattttaaaatgtttaaataaacagtagaaaatgtttgggatctagagcttaggcaaaaaggtcttagacttgatcaaaagcacaatccatgaaaggaaaaatcaataaattggacctgaccaaaatataaaacatttgctctgtgaaagaagatgaaaagacaagttatataacataatgggagaaaatattttcaaaccacacatctgacaactgacacatatctagaatacgttaagaactttaaaaaactcaacagtaaaacaaaatccaattagaaaatgggcaaaggacataaagatacatttaaccaaagaggaaacatggattgtaaagacatgacaagatgttcaccatcattaatcattagggaaatgcaaattaatacttcaatgagatgtcactacatacctattagaacagctgaaataaaaaaacagtgacaataccaaatgttggtgagaatgtagagaaactggatctctcagacattgctagtgggaatgtgaaatgctacagccactctggaaaactctttggcagtttcatataaaactaaacatgcaattaccataggacccagcaatcacactcctgggcatttatcccagagaaatgaaaacttatgtccacacaaattctcatacatgaatgtttataacagcgttatttgttaacagcaaaaaactagcaacaaccaaaatgtccttcaataagtgagtagttaaacaaaccgtgctacaataaaaaagaatggacaataacttggatggaccttaagggtattaccttgagtgccaaaattgtttgcacaaagatctccactcctcactcctctgccattgcaaacatgctagcttcgattcattgggattcaaaagacaaattggcaaaagaagcacccaggtgatttcaattttgtagcagtgtatgagaagtggcaatctctgaggcaatgtttcttaaatattattatcccatacctgcaagacacacatattcacacatgtgtatgtgtacacacacacacacacatttccaagatgacagattttcatgcaatgagatttttgcctgtattgattcattttcaaagatgaaagatagagacctacctgagctgtgctcgaatgaggggaaagggtgatggttggtagtggcataaggaaaatagcagggaagaaaggaagataacacagagttgcatgaagaggattgtgctgacctgggctccagctctgtagtgctggtcttggccattctctcgacatgtgctgtcttccccatctgcagccccaactctgtatctgacaactgatgttaaaatgtctcttctggccaggtgtggtggctcatgcctgtaatcccagcactgtgaaaagctaaggggtggggtggggggggagggtggatcacttgaggtcaggagttcgagaccagcctggccaacatggtgaaacccggtctctactaaaaatacaaaaaattagctgggcgtcctggcttgagcctgtagtcccagctacccaggaggctggtgggaaaatcgcttcaacctgggaggcagaggttgctgtgagccaagatcacactccagcctgggtgacagagtgggactctgtctcaaaaaaacaaaaaagtctcttcttcagggaggccttgccagatcccgagaataggttagatccctctgttatgcattctttattataacacttgcatataacccttgtatcatttatcgcaaatgtaattacacatttttgagatcaactatctaatactaagtaatgatgtgtgaatttatctatttacttcgtgtctcccatttgggactgtaaactccattaatgtagaaaccctgtgttagtttcctttttgatattcccagcacctaacacaatactggtccaaagaaggtgctcagtacgtatatgttggatgaatgaagccaggtaataagaccctgattgacttaaacacagttactcaaaatcatgttaaggaaaaataaactttcatttttaatttatttatttattatttatttatttatttatttatttttgagatggagtctcactctgttgcccaggctggagtgcagtggcgcgatcttggctcattgcaacttctgcctcccaggttgaagcaattctcctgcctcagcctcccaagtagctgggactacaggcacgtaccaccacgcccggctaattttttgtatttttagtacagatgggttttcaccatgttagccaggatggtcttgatctcctgaccttgtgatccgcccaccttggcctcccaaagtgctgggattacaggcgtgagccaccgtgcccggcccatttgtatttattttctctcttacaaaagaggaaaaacatccctatcccacattggataagactgaatagctacagggatgccctggaataaaaagtactgtttgactacatggactaatgataggaaagcaatggtttcctaccctttgagtctgggggtccactgtattttttttttttttttgagacagagtcttgctctgtcacccaggctggagtgcagtggtgtgatctcggctcactgaaacctctgcctccccggttcaagcaattctcctgcctcagcctcccaagtatctgggagtagaggcatgccccaccacgcccggctaatttttgtatttttagtaaagatggggtttcaccatgttggccaggctggtctcgaactcgtgacctcaagtgatccactcccaaagtgctgggattacaggcatgagccactgcacctggccccattgtatgttctttgaggtacagaatcccaagccctgaatcttctgcacatgaaaatgcagacatcagtactcatgtatccatcactggaggggtttctttccacccacaaaatatcccttgaaatcatccagtagagcccaggggttgatggaaccatttgctactcaagctaaaaattacgatttccatcccccatacttattttccccaagggaacaagcgaattaggcaagcacaaaggatttgagaggaggctgcactttagactttgactttaggaccccaatattcttcctcaggcttctccaggtttccagttccctgtcactcacattggagccctccctgccagccagttaggaaatagagattccaccagtgggagaaactggaggggttgggggaacatgctcaaagtcggaacacttcagggacaagtccaacctgtttagcctctcacacataagcttgccttttcttctcaacataccatgatttagtgccaggccacctaggttccccgcatctcctccacccagtcccttcagggaaacagggtcctttctggctgagttccatgttcagtatccagtgctctcctcatggccacctgacaccggagctgttgctcaacccctcccttgatcggatgccctgtattgcttgaactcatttttctccctgggcccctaaatcagtcaaatttttccccagctgctcttctgctctctgctactcttgattgaattcatcccttctctcaaatgtctccttctcacttcctccagcttgtgttttctccatccttcagtattctccaggctcctctctctcctggccaatggtgctctggtgagatcattttcttcacagcaccctcaccccacatccatcctgggcctgctccccagctgtagatgcggtcatttattcaccagcattttgcaatcaccaaacaaccacaggttcctgtgggttccctacacaaggagggtctaactccagcacacacataacagaaaagagggttctacgggaggcagaggttgcagtgagccaagatcgtgccactgcactccagcctgggcaacagagcaagactctgtctcacaataaataaataaataaataaataaataaataaataaataaataaaataaataaaataaagagttctagaaaaaaagggtgcaagattcagatattactgagtttgaagatgagagtatttttcagcaaaacagctagaaaatcgctagctttccccctaaagagggggtaagctaatcaaatcatagttaaaatctattcaagggtgtttttatatcactttcctatatgcatcctctttgtatataaaccttcttcaaaatgctctcagaaagaatacaacaagtaccagaaccttataaattgggcttttctagggtcaatcacatttttaagtgggggtaaaactgtaccagttcatagaaataagaaatatcttgacagttgttttattctgcatgaaacgtgccctttttcttacagtttggaggttatgaagggaggtaacagaacaacatcgattttaatccctgtccccttcccgcactgcctgcctcattgaaagctagtgggtcttatgaacaaccttaagatgcctgcgagccacggcagaggccaccatgaatagcacttgaatgaagtgagagaaaaaggaaaattgggaagcatcttactggtgccatctcccctacttaccattttctgtgatgtacctgggccctctcttcatgaaattgttctggagaactgagggatttaaagggctacgcctccctagagcagtctgcatcttaacaggatccacaagtggaggcttttttttttgaaacagggtctcactctgtcacccaggctggagtgcagtggcacaatcatagctcactgcagcctcgaaatcccaggctcaagcgatcctcccagctcagcctcccaagtagctgggattataggtgccaacaaccatgaccggctattttttaaatttatttatttatttatttatttatttatttttgtaaagacaggggtctcattttgttgcccaagctggtctcaaactcctggcctctagtggtccatctttcttcctcggcttcacaaagtgctggcattataggccccagccaccgcacccagcccataaagggaggcttaaggaaatgtctgacttctgtggggagagaaccagctgtggagtgagctcagcctggccttgactcctggtcacttactaggatgtgacctgcatgagcaagtcatccaaagtctctaggcctcagtttcctcctctctcacatgggaataataacagtccctacctcagaacactgtgaagcctacatgaagcaaggctcacaaagccctaagtgcagtgcctggcatgttgttagtactccataaatgttaatgtgggctgggcgcggtgtctcatgcctgtaatcccagcactttgggaggcttaaggcgggcaggtcacttgaggtcaggagttcgaggccagcctggctaacatggtgaaaccccatctctaccaaacacacacacacacacacacacacacacacacacacacacacacacaaattagctgggcgtggtagtgcacacctgtagtcccagctactcgggaggctgaggcaggagaatcacctgaacatgggaagcagaggctgcagtgagccaagatcatgccattgcactccagcctgggtgacagagtgaggctccatctcaaaaaaaaaaaaaaaaaagaaaagaaaaagaaaaaaaaatgttagcgaggagaaggaagaggaggagagggagaaggcggcaagatgaccttggagtcccctggaaagaaggggcctagctgccctctgcgtccttcccctaccactcttcctttcacggcctaatccaaaggtggcttcacggcccctcgggtttaacagctgagactttgtttccagactcacaggtgtgctgtagtgagcacctgggtggaatgttgctctctgtttcctgcaattactaaatcgctttaaggggaatgctgtacatttttttttcaaatgaagtctgtgcttgtatttgctcacagggaattttaaaattgaggagatgatgagcttgtttactaaataaatatgtgtgtttggaccatttgccttctcctccctccagatgccctctcctcctcccctcgctgtgggcttcaaaagcagggcaggcggtggggcaggaaaatgccagttgttggtcttcttggacccaacaattatttacagagcacaggatttacagtcaggaagaattttttttttcacagaaatgggcaaatcctagatgctctctatgtatacaaacttcctttccaacagttatgaaaggacattttacattttaaatgagagccctgttggcggtacattctcaaatgctaagttccatcaaaacagcatgttgaggggaagaagggcacatggcaatgggcacctttgggtcccaacttctccccagcaatgctgtgactcaggaagtcagcaggggtccttcttttcacccctagttccctcccccaactccttgtacatctgatgtcaaagcataagctggtaacctataccgagagggagaattcaacccaggggcagctcaacttgaacagttctatccagaagtccaactttaaattctaccccccatagaaatagtcccattcctgcagctgctctctaccagctgcctaaccagctgccattgggccaaaattacccccacctcagggtccccacctcaggacatcataaacacactccctggggctcattcattaacccatgagctggagttgcccactttggaagtcagctgtggtcttcactattttttttaacttaaacaataaagagcaactcacagatatccctcactctcagcacatgtggaatgagataaaaacaaaagcttgctaagtcagaccccagaaccaactcaaggcagagatgatgtgaatgtggaactaatcaagaagttacacgtgttagaaagatctggcttaatggttctctttttaaaaaaaaaaagttttttgagacagagtctcactctgtcacccaggctggagtgcagtggcacaatctcagctcactgcaacctccacctcctggggttcaagcgattctcctgcctcagcctcccgagtagctggggctacaggcgcgtgccaccatgcccggcttttttttttttttttttttttttttgtacttttagtggagacagggtttcaccatgttagccaggatggtctcgatctcctgacctcgtgatccgcccgcttcagcctcccaaagtgctgggattacaggcgtgagccaccgcgcccggcctaaaatactttttaaattttaagtggcatcatgaaaggtggaatccttgccccgtttttctgattccttgttgtttttatttatttagggagaaagacgttctgcctgtgtttatgtgtcagttgcagaatttgtgggtaacaggaaatcaggtatgaaattgaggctaggagctcacagggagcaagagataaataatccaggattcaagattaaaatcgctgttgcttctgtggtgagagcttgtcacacaggcaattcattgtggattaattttccagtgatgtagtaacaaaatcagcacatcaaataaaatatttaacacccaggaaaagccaaatgcatattctgcatgtgtgtccttaagtggtacttttatggaaggaaatcttatttgaaacaaatgttggaacagaagttgagcttatgaagggcaccgagaaaccctcacacataaggttttaaaatgttgcccagaaaaagcataatcttcagtgtcagtcccttggatggtcagcgtgcacgttcaatgctcgtgtttatccacctgtgtgcacaggtgtccactcacttgcaaatccttcacgtcaaaatctgatagtcatattgcttacctgtgttaaatggaaaatggaagtcgactggtgggtcctgttgtctagcaccctactacttggtctcaggacaagaagggaatctcagaatgatgaatggggttatatctggataccccttgctgggctgcctgcgatcagcatttctgcccacagctaagcaattcaagtgctctgaccccaaagtggtgagcccccaagcttctatctggatctcttgaaggaagtgtgtagggtgttgcatgtgatctgtgcaaaaggaaggagcaaattggagttattgagtgaaccgatagccaggggaggcccctgtatagacagatgtcgtggaggcatagtcaggaaaagtttgccatgactcggatttctttctctgcctgcccagatgcctgcctgcaacctcttttttttttttttcattcacttgtacatacattcctcaagtatttaccaaacacctatttcaggcatgggcctgggctagccagggcagtagtatacagaagtcgtttgttttctcctctccctctcaatgggtcttctctccttctctctctccccataattcagtggtaacaggggtggatgaaggaatatccaaaactcgtctctgtaggagacatctgcgccaggaatttccagcaacccctgaggagagtggcagattgatgggactctagttgggactaaccagggggtggagggaggtgggggcggaaagagccctgcagccaggctgtctgcctgagcctattctatagctcccattgattggacacttgctctgtgccaggccctgtacgtgcagtttttcagacctcattcactcctccaatcccattgaggttgctattataactgtccctattttatatgaggaaactgaggccaggagagggaagggacttacccaaggtcacacagctaggaagtgacagagcctcaattcaaacttaggtctgtatatctccaattctctgggcatttaaaaaaaaaaaaacaactcagatgtggtttagacgtaagccaaaaaaaaaaaaaaaaaaagccaggcatagtggctcacgcctgtgatcctatcctttgggaggcggaggagaagcatcgcttgaggccaggagtttgagtctagcatgggcaacatatcaagaccctgtctctacaaaaaaattaaaacaaaacaaaacaaaacaagaaaaccctccttatcattatatcaaaagtccagacattttaaaaagagagagcttaggagcttctaaaaggtgctatgaactctgtttccatgtgtggtttagtctaatttctatattcaacaataataattttaataataactaacacttattgagcacttgcatgacaggagctacactaaacagttttacactcatggtgtcatttaataatcataacgacccgatgcagtgttatcgttattattattatcctcattaacaaatgatgaaaacaatgcttagaaagtaattcccaaagttagttagcgccgtcttattccaagtctctcttggtacatcaaagccactcaactactagactatcctgcctcaaaccctccaggacctcattgcttccaaacttctttccctagactttcttctcacctttttttctgtccttataagtctgtccaaatacattgcactcatttctgtcctatgagtgagctaagtcattgtcttctccataaccttgccttttctcctcacccaaatcacttcttatctccaatatccaattagacagatctggaagttccaaggatgtgtccatatagggaaatcagaacaagaatactactaacaccaagttttcagtcacccttctaggttcacagaatcttaagaagtcagcaaaaccataagcccttgtacttaaaaataatcaatactacttaaaacttggtatttattttattttatcttattttatttacaaacactatggtgactttaaaacttagtttaaaaaaatactccccgaggtctgtaatctcccacatacaaaatctctaaaggagaggcttaaaagagaagtactcctccctgaaaatcagactattttataaataatgataaggtggcccttttgaaagtattgcttatttagaggctggggatttaaacttagatcactagtgagggtgtgttccaattaccatatccctagataaacatgaccttctttaatcagctctttgctccctagtttcttagcagaactgccaatgagccagggcagctgccattttgtgccagagtttctttttccattttccaaggaagcaaagaataaggaatgcctcacttccctccccattccctgtttggagtcatgccctctgagaacttattctatttcagcttctacctctatgcagtcagaaaaatgattccgaacaacccatagaatgagcacctgcttcagttattgtcccaatgtgaaaatgctaatccctgggtttaggcgaggtttgctttccacacaaaatggtcaggcccctctaataggccagcacttctggttttaataccccagtcttgatttctaacaggtgggtgccacagttgttcagctcttattatgagctggttcatagctcgaacaatataggattcttcataaagagtctgagaaactgggccgggctcggtggctcacgcctgtaatcccagcactttgggaggccgaggcgggtggatcacttgaggtcaggagtttgagaccagcctggccaacatggtgaaactccgtctttagtaaaaatacaaaaattagccaggcatggtggcgggtgcctgtaatcccagctactcggggggctgaggcaggagaatcacttgaacccaggaggtggaggttgcagtgagccaagatcccactactgtactccagcctgggtgacagagtgagactccaactcaaaaaaaaaaaaaaaaaaaaagagtctgagaaaccaccagatggtattattggggggaaataaactcagttcctttcttcagcaacccaagctagtggttttaatcaggaatgaagggcgctttcaccctgctgctttcttcaaactcagtaagtgccccccaccctttttccagtttttacaaattaaaatgtttgtaaaaacccaacttatgccagggaactagggctgcctagctctggttgtttccaacatggcactaatgagacattgcccattgattcagtcatttgactgtctgtactctttccctccctcccatccaagccctgacatccaggtctggagtgtcacaaacattcaggcttggcaagagaagcccattctttttaaagatatgatgaaatcagaaagacacacaatccctgtcctcagagtggaatcaggaatatgtgattctccacttccataacaaatgcaagagttggagaatgtgtggtaccctttttccattcaggaagatttattgggtgagtctacaggccattcttcttagtttggggttgccgtatctggtggctttgtacagaagccatacacatttccctcgtcaaaacagattgagaaggcctgaatatacagtgtgtctcgaggttcattgtgttctgggtatgcatgcaacccacggaataaatgtgttacattgaaataaggaatgactgtgtgctgacaagaagtccaaaatatagagagtgataaaatagaaacagtggtccagaattatctactctaaatgcccttgaatttctgtctcccatttattgcctctatttttctcaatttcccctgcttgaaaagctattaacttccccacctctccaccaccctagactctgatacccataaacaaccgttgccactcttttatgtcctctgttatgaacaccttcactgtgtttactttcttggcactggcatagactagacagagaactatagaagcttctcgttctggctttgccacttatgacctttgtgtctttaatgaatttcctaacctttctgatcctcaattcttcttccataaaaggaagctaataataataccacacagagttgctatgagggttaagtgagatactgcacgtacagccctaaacacagtaatacagtgtctcaatatatatccatttccctccttcctgttttccttcctttcttctttctgcgggaatctcagtcgctacgtttaagcaactgcctatgatgaaaggttttgtctagtgggtggacccagtttctgtctttgttctcatcacttaggtgtaaaaagaaagctttaaaaagtaggattatttttgagggcatatagaaaagttgttgctctttgtataagacaaaatatccaagtttcaaaaatcccagtggcctgcctaccttgaacctctttctgttcttctactcccaagggtgctccaattggcggaaggtagccacgtgggaaattaaacggcccatctatatctatttatacccagcgtaaatgcagagcgatcaattttagaactggtggcttggcctgagaaatagctatgtttggtggaagcagggcaggttcataaagaagtgcacagagctcttggaatacaggaattatctgctcttcttggatgtgggtgtcctcctagggatgagcatctgccctcactgtcctaagttctagaggcctcagctttccgggaaagcacaaaccaccgctcagctggagtctatctgggtctcccctctccaacttgtgacacaagtcttgtgtgaaagcctgagaacactccattcttcctcttgttgttttcaggaaagatttgtccctgtctctcactgccacataccatcttagagcttctctcagcttccccgagtcatgcatgggaaattgctcccacagcccctctatgctttggtttgctcagttttaaagttgattctgtcccctctcctaaaaactcagccatcagacactgaagcagaatcacccaagtgttttagagccatagtccggaagccaagccacctcaggactttccttttctttcatggtgattaaatttattgtaatgtctggccatttttctctgagttgtaaggcagagaagcaaggtgggctggtggaaaggcctgaggccccgattgacttatctaaccttgatcttggccaaggctctctgcccttctgggacccccgtttccacagttttaacatgtgatgcctgtctttggggcccttacaggagagctgcaaggatcaagagggataacaggagggagtgcattctattggggtagggctggggaatctctagacaaaagatatccaaattaaagcaaaagtgctgtattttgagatttgttgccatatgtaatccatacacgtttaaacaagctttttagaacccctggtttctgtaatcacttaagacattgcaaagaagcataaatatatatttttaaagtcatcactactactactttctaggtgaaatagaaagtatttctactttgaacatttgccctataactgtgacagggcctccatagactgcagttccaaggatcagagccccaaccttttaaattcggtgcaagaaatttgctttaatttggatatcttttgtctagagatttccccagccccaccccagtagataactccctcctgttatctctcttgatcagctctcctgtaaattccccaaagacaggcatcacatgaacccccagttcaggctttcagagaccatgctgcttagaaagaccatttcctcaaaaaaaaagtagccaggcgatcccagctactcaggaggctgaggcaggaggatcacttgagcccaggagatgaggctgcaattaactgtgattgaacgaataaactccagcctgggcaaagagcaaaaccccttttttaaaaaaaaaaaaaaaaaaaaaaggaagaaagaaagaccatttccattgccccccccccagggtttagggctgggcagtaagctccattctgagttttttttttttttctttttttttttttttttgagacagagtcttgctctgtcactcaggctggagtgcagtggtgcgatctcggctcactgcaagttctgcctcccgggttcacgccattctcctgcctcagcctcccaagtagctgggactacaggcgcccgccaccacgcctggctaattttttgtatttttagtagagacggggtttcaccgtgttagccaggatggtctccatctcctgaccttgtgatccgcccacctgggcctcccaaagtgctgggattacaggcgtgagccactgcgcccagctggtttgttttcttaatgactaatacttagaatcattctgagtattttcctctatatcatgacctgccctcccttctcccctgccaccttccccttgtaattgccaccaatacacagtcacatccagtcacaacaaaaacctggctgagaggtcaagtccctgttagaaaatgttatataatcttccgtatctcaggattagaggcttcaggcatcaatgacattgtaagactttcaagagaagacctacataaataacctctgtatgtgtgcatgatgtatgtatgtgtgtgtgttcccatgcatgcatgtgttcataatacatgtgctaatctatccctccactacacacacacacacacacacacacacacacacacacacgcatgcatgcacacatgaggcattctgtgatagaaccttaaacaccatcttttttttttctttggtggagtctctctctctgttgcccaggctggagtgcagtggcgcgacctcagctcactgcaacctctgccccccagttcaagcgattctcctgcctcagcctccagagtagctgggactacaggcatgcgccaccacgcccagctaatttttgcatttttagtggagacggggcttcaccatgttggccaggctggtcttgagctcctgaccttaggtgatacgcccgccttggcctcccaaagtgctgagattacaggcgtgagccactgcacccggccaaggatcatctactctagcctctgacgtaggacaggatctccctctccagtgaccccaacaagtggacagccagcctctaactgaatgcctacagggaacaaagagatcttagtttcactctaggtttctccatccatttttggacaacttttatagttgggaacgtctccctgatattacactgcaattctagttcagtttctcctgtaggcatcaaatatcagcaccaataccacttttaactggcccctttctttctaagtttttgtctctattccttgttgcttcatcatatttctaattctaaatggaatttaagattgtaacaaaacacagagtcagaacattaataattgcaggctcctatctcagaaaggaggcatgtgtgtctgttccatttgttgggaagatataattgttagtttgctagggctgctgtacacaaactgggtggcttaaaacaacaaaaaatgtattgtcttacagctctgggggctggaagttcaaaatcaaggtgtcagcagggccatattgtgtgacggctctagagaagcctcttctagttctggtatttgctgacaattcttgacgttcctggggttgcaggcacatcattggagtgatgcacatggccgccttcttcctacatgtctcacattgtcttacctctgtgtgtgtctgtctctgtgtccacattttccccttttgtaaagacataagtcattggattggagcccaccataatgatttcattttatattgattacctctgtaaagagcatatttccaaataaagtcacattctgaacactaggggttaagacttcaatatatctttttgggaggacacaattttttttttttttttttgagacagagtctcactctgtcgcccaggctggagtgcagtggcacgatcttggctcactgcaacctccgcctcctgggttcaagcgattcttctgcctcagcctctgagtagctgggactacaggcatgtgccaccatgtctagctaatttttgtatttttagtagagacagggttttaccatattggccaggctggtctcgaactcctgaccttgtgatccacccacctcagcttcccaaaatgctgggattacaggcgtgagccaccacacccagctgggaggacataattttatacatatatatgtatatataattatctagctatatagaatatatagatatagaatagatatagatatataatgtatatatagaatattagatacatagatatagaatacatagataggtattcctaaacatttgtagtccagtgatgtaagttcaagtctcagtcctggagaaaaatttcagaaagaaagtccttcattctttgttaagggaagatagattaccagtggggggaaacttcctttttgttgttaataattatattaatatcatatatgtatatattattagatatgataagacttttatatttatttttaacattatatatggtgtattttaaaatattatgtattataatatgcaaatgatgaacacaagtttaaccaattgcttttttttaaacaagtaattaatttcaggaaaaaggcaccaaaccaacaccctgttctacttttttttttttttttttgagacggagtcttattctgtcgcccacgctggagtgcagtggcgccatctcagctcactgcaacctctgcctcctgggttcaagcaattctcctgcctcagcttcccaagtagctgggactacaggcacgtgccaccacgcctggctaattttttgtatttttaatagagacggggtttcactgtgttagccaggatggtctcaatctcctgacctcatgatctacccgccttggcctcctaaagtgctgggattacaggcgtgagccactgcgcccggctcaacaccctgttcttgctcttttttttttgtttgtttttttttggagacagggtctcactctgggctcaagcaatcctcctgccaagtagctgggacaacaggtgcgcaccaccacatccagctagtttttaaaaaattgttatgttttttgatattgctagtataaggagctatcacacccaaagtcaaatcttcgttatatagaaagtccagatcagagaagtgtatagtgatatttaccagtacaatactctatcatatgtggatatggggtcaactgcaaagcacttttgggaacattcaggctcggggacactcaaacagacgtgaagttagcctggatctctcttttagtccagagttggcagagtgaaaagcccagcccagagggagccaagggtcaagttggggtaggggagaattcacccatcttgcctctgatttcccaagaacctctagcattttctgatttctgtatctgtgtatggaactgggagtggatgtgtaggtctgctctcaggaggaacagatatccagcctgtggtttaggttcctttttctagctaagggaatccttggacaacctcagggctaagtccatttgcctgggtaaacttggggactctagcaagccccttcgaggcaccccaccattcttcagtacctcgtgaacctgaggcttctgcttctgattatgctgtctctcaattgcctggacttggtctagatacggcttgataatttcttctttcctcccatgtaaaggccagactaggggagagttccactttgtcttctttccagaggacgacttatcacagggatggaggaaaaggggtacaaagagtgctggctgcacttggagtcactgactaagagctaattgacaggacattgggtaccgttggatgggacagacatagagcccttggcatcaatgatcctagaagataagcaggtgtgcaagtggacaggccaggacgcttgttaggactctgtactctctaactattatagaaaggctctactgctaccccaggccttcaactggtagactagagaaggagtgggggaaggggttagccaataaccagattcaggcccttaggggctggacaaggaggcacaggggcaggtggtgatttctggtggtcattcattaatttcttccttctttcatttaaaaaatatttactaagtacttactgtgtaccagatactatagtagatcaagaccccatttttaaaggaatttatggtacaataattaaggaatggggagaaatagtagggatcagggcaatagtaagaaacagatttggggattttcttctcctcagtatgtgtgtgtgtgtctgtctctccatcactgtgtgtgtgtgtgtgtgtgtgtgagagagagagagagagagagacagagagagagagagaaaatttatcttcctacaatgtcctcatcacaaagcaatgcatctttacctactccgatatgcacgcatgcctcccaaattgtaggctcgctaacaatgaccaacagccttcctatcaaaggaaccttttctaaaaccttctctacgtctcaggagccaaatgatggtgaatggcctcagtcaggatgttatacacatgcaccaagtgaccacattctgggtggggcatgcacaaggtagctttgggttttggaaagatgcattctggtcaagtcagtgaaaaatcagccaagtagcctataaagtcaactgtggtttattttggacttaggccacacctaaggggccatatgcatgcacctcactttaagaaaacctgtactcaaaaatcccaattttgaaagggagacgggaatgtgcctgaccatttttggaagccatctagagccctcatttattgacacaggtgtatcaaagaggtggtgaagcccttgaaggaacatctgattcaatcctctgccttctgatgatttcagatcacctcaggcaaatgggcctttatctggttttggcagactcccagagactactaatgggttaaaaatgtggccgtggctgccgtggagttgagaggtctgcacagacacaaacctaccttgtcttttaaaatgagaagggactctggggctttgtggaaaagggtgtagttttctgaaaaaaatcaaactcaaataaattgttaagttaaaacataaactgaattaggggcatacatttgggatgtccctcacacttcatggaaattatgaaatacatctctttgttcaagtttaaaattcaaccaactcagcttctctgcacaaaaggggaggagttcccatgacctgatctttgcaatttcctctaaagtatggctttctgtatttatttaggaatatttatgttcagtcagggcatggtttacccttgttgtgtagccttattatggtttgatttcacattggactactcaccttttagtaaccaaatttgcgacccagcggaaatttctctcttacaaggagcttggattcttatttattttgcaacctttatttgtgtatgagatgaaccatgacatttaaactatgcttgatagcttaacagattataagaacaaaaccagatggcccaaacaaaaataatgctttgattgctttaaaattcaatgtcaaaaattaaaaacagctttcaaaaagccttgacttttttcccccgagataattttgaatcatatatgtggacatatactttccccccaaattagaaatatataaaaaatttaacaatggttatttgggggttgagaagggtgtttccttcttttttcttttcgacaccacccaatttttctgcagttagttttagaatcagaaataaatttttaatggctgctttttagtttaattttaatgaagcctttttaagggttcggtcaaggtgtttttctctgctgagaaaatggacattgttaagcattagcagttcataattcttcttccacacaaaatgatgaataatgtgcggttactttaacactgtgcttcatgaggttggaaaactaaaccggtctcagcgtctttaaaattaatgtaaattctacaaaagcagttatttaattttctaactcgctttaatgtactttcaacatcattagtattaatcacaattgtcactttctttgagagcagtgaaccaactaattccttaaaactgggctttaaaaagaacctccattttaaaaggctctcaaaccttgagatagtttgcaggtcacagtcagaatgtgactgcttgaatgtttaaactaaagcacccacaaagtgttaggattcctttttttccgttcttgtcttgtaaaagaatctttattctgactcagattcatttttctttaaatcagctgcaagagagtgaacaaactttgctgcaaatcaaagccctgacagttacatttccctgagataattgcatgctgctttggagtttccttttccctgctgtttccttttgttttgacaacaagtttctgggaaaacaatatacaaatgataactatgctgtcacgagtatactgaattttaaaaataaataactgtcgacccaaaaagcttccaggagcctatggagtgaattctttttccaaaccgttccaaaaccagatgtggaaatgtttagctaattccccttcccattcttcatgcaaagagttcatacgtgtctctaacgacatcagaggagatggggaggcaaaaaatcctgtctgctttcaaagcgatttctcttacacttctcaattctctctctaacgtcacaaaactaatttggacttcagcttttgtctctttttaaaaggatttttttggggtcctgagattaaaaatgctctgtgcttagaccaatattcaatctcttcattataaaacattaagaaatagagctcatggtaagaacacttaaaatctaccctcttagccattttgaaatatacaatatattattattggctgaactcaccatgctgtgcaatagatcactagaacttattcctcctgtctaactgcaactttttactttttgaccagtatctccccttaccccttccactccaccccaataaccaccattctactctctacttcttaaagtaaggcaatggtcatgttaaccagcttgatctaaaataatcattccacaatgtaaacatagatcattgttacatgtatacatagaacactgtatcccataaatatatacaatttttatttgtcaatttaaaaacaaaacaactgctgaactttataagcagcattttcagcataaaaaatttaacgatgggggagttaagtggcagctcttcttcctctttcctttttttgttttggccaatccattctcttcctgtctataagaagaaaagggctgtcttggtttcacaagtactacgagatctcagtctggctttgctaatcagattgtatcactgtcagtgactgatatagatagctcttaaacataaacactggcatttttctgaacttaattaaaagagcatatgtgtttatgagggaagaaaggaaatacagtttatattcccaaaatgaaatgttttatgattttttaatgtagaaaatttattaaggcttattagggagttcttgaaaaaaagggaaagaggaaaactctgttaaaggagctagtgggaaatgtatatgcataaactccatttacaaaaaaacagaaagctacttgtactctgtagcttcaaggaaagcaaacattttgcatccaggtgttattagaagctctgggtttgcctgacctctctatagctcagttcaggacgctgtgtaccaacagctgagccctacttggctatacaaatgcatctaggctcattgcttcgggcatgttgcaaggctaatttgcaatcgagtcaaaatggggctacagtgatacagaccctgagactgctttttttctcagcacagaggcctccccaagaagctggacagtagtcccaaaatgagtgctcccttctttgcatttatttcttccccagtccccaactccacgtcagctctaaagagttctaaagactttaaatagaattctgcccacagctcctgggatactgtgcatggcccgcatgatggctaaaaataccttcagctgggcacccccacacagccctctcttctggcatctccttcccatctctaacccctcagccttcttttccctctgcccccaataactagagcccactttctccctcccttgttcgggatcccattcttccagcacatctcagcaaggtgttagaaaagtcagctgatgaattcacactgtgttgtgaatgacttataaccatcccccctgccggacgtggtggctcacgcctgtaatcctgtaatccgagcactttgggaggccaaggcaggcggatcacctgaggtcaggagttcgagagcagcctggccaacatggtgaaaccctatctctactaaaaatacaaaaattagcagggcatggtggcgggtgcctgcctgtagtcccagctacttgggaggctgaggcagaagaatcgcttgaacccaggaggcggaggttgcagtgagccaaggtcgtgccactgcactccagcctggacaacagagcaagactccgtctcaaataataacaataataataataaccgtcccccaacacacacacacacacacacaaacacacacacacacacacacacacacacacacacacacacacacacactactctacccttccctaggaattgcaggtagcaggagaagggaggctgccctgctttgaggatctgttctcagcaagaaggagtaagtctcaaagtgtgccaatgagctgggcattcgcaagctcattagaaagtacattctgctttccccctaatctcctttctctccccttagagatgagcaaccttaaacctgggtctcagtgacctcttctttaagctttatctgagctgaagggtgtgctgtcacatgcctagtcatcttcgtttatttctcctatcacatggtgagctgttcttggctttatgaaagtcagaggaaagagattctgccgtgttcaaatttggagagttgtactaaatgaacccctaaactcaatgacattattgagccccttcctttgagactgactcagtgcaacataatacaagaagtgaacgtgtgggggtgggaagtgaggtagtctaaaatgattgcttgagggacaacagtctcatttctcagaaattctagacattttataattatatttggattatctttggggaaggaggagaaggagtacaggaaagatgcttgagggagggggaggaaatggatggcttagctctctggaaaagagtagccttaaacttgggtgttaattttggggtttgaacaaaaacagttgtttccttggcctagtccagaactacttaaggaggaggttttcattcagggcaattaggcccaggttgtgggatgatgttaaagaaagaaggaaagaaggagagagagaaaaagagagaggcaggaagggaaagaaaacccacctaaagcacatttaagacaaggtggtcttctatagatcaagacaatagtgcagtagtgatggggtgattatctcagcttccaaaaggcacctcagcaaatgttatgcagtattccagagcaggtggtttctttacttaactgttgagtcatccaggaccagctcacatcagaatttacttatttgtgttgttattattgtttcctttttgtttgttttggggatttttggtgcgggggagagaaagggagtaggtttttgtttgttgctgctgcttctacttttgctttgtgaaaaaaacccaaaaaagttgtcccagaagagacatttcagaaggaacaaagaggaaggagcctggcagacctgtggggcttctcttttacacccacaacacccctgagagaatgaggaatcattaacggcagagtgaaagacagtgagaccaatccgtaccaatcagaaacaaaacatttcatccaggccagtgcgtttttctagcgggctcctgtgccatggtttccattaaacaatgcagcaaattcgtcactatcaagggaagagaaagagctgtatttttgcaactggggaaaaagagaagagagaaatgtcttgggacgttttttggcccattgccgtgcacatagtaggcattcaacaaatattagtcaaagaatgaatttgtgcaggggttacttatctcagcagggaacaaaagtgaatccctatatgcatgtacatttccttccaaactttaggtactttactatgtgatttatgtcattttcacttgtaaaatgaaagttgagttggaaaacattggatgatgttgctcttgctttcttctttcttcatctgttacctccttctgatagcatgttttagatacttattcctagcactgctttttctcctcactggtctgcctgtcactctttgagagctagaagcaataggactaggaagtggccacagagcttcctatggaaaaagaaaacaataaaaagctagagaaaataaaagacgtaatgcaaagattttaggagatatcttgtcaatcaatgtgtaaagtacaaactcaatcctccctctctccctccctccctccctccctccctctctctctctctttctttcctttcttttctttcttccctttttttttttttgagacagagtctctctctctctgttgcccaggctggagtgcagtggcacactcttggctcactatagcctcaacctccaaggctcaagcgatcctcccacctcagcctcccgagtagctcatactacaggcgtgcaccaccacactcagctagttttttgtattgttttatagagacaggctctcactatattgcccgggctgctcttgaacttctgggctcaagcagtccttccaccctggcttcctagaatgctgggattatgggcataagccgcccctttctttaatataagacttttacggtagttttcatgtgtaatatgcattgaaaaatgtaaaattaaaaaccagcatgtttttatgtttccacaattttagtattttacaaggtgtcctaaagaatttatcagggactctattggtcataatgacttatgatgctgctgccagagtttatgaagcattcgtttgatcattttaagtaagccactcggcaaaatttcaatatctggttgttaagaataaaccacaattccttcataggtttttatttgatcaaatctgttgtaacaacaacaaaaaagcgatagggaagggttcattagtatggcctatgagaggacatggaggcccctaaagagggaagtattgccatcttgaattaaactctatctcctatctctttattcaacgtttgacacaaaaactgttctgttttgggttcatcttgaggttaaacacaaaaggatgccactcctgatcagtgtaaactgttgttctacatattagggatatgtgttttatgctagaacagcatgggaaagtcactttaaaaagccattgtaatcgtccataaacacgtgagttccaacaatgaaattaaagttcagttctctctcaaatgagtgttttcctcttcttaatgctttaggaacagccctttgcttaaaaaatatatcatgtttgaactttcaatagaaaataagatgacttgcctcttgtgtttttttgtgctctagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaatatgttgggcatttttatttaatagacacatacctcatttttagtatgggccagacattgttctaagtggtttgcaaacattggtgcctggtcccttctctctaggatgacttccctctctgtcaagttcctctaagaaagccttctgcaattgaccctctgtctatatccccatttcccttacactctgcaccactaacttagtactcagccacatcgtttcttagttcaatctacaactgtgtcactttttatccacaaaaagcataggttgcactggtgatttataaaccatcaatggttctaagaagcactcacgtcactacccaccagctagacagcaaattcctgatgccgagagccagagcttatgctttagccacagactgatagtgctttgaaaggagtttttctcccccaacatctatgatcagaaaatgtttgctaaagtttggctgtctattagctttctcaaaggggtaagagagaaagtggaggagtaagagagaaagggaggagtaagagtaagtgaattgttcaacagaaatttattattgaggccaggagtggtggctcatgcctgtaatcctagcactttgggaggccgaggcaggtggatcacctgaggtcaggagttcgtgacaagcctggctaacatggtgaaaccctgtctctactaaaaatatgaaaattagctgggtgtggtggtggtcgcctgtaatcccagctacttgggaggctgaggcaggagaattgcttgaacccgggagacggaggctgccgtgagacaagatcatgccattgcactccagcctgggcgacagaacaaaactccgtctaaaaaaaaaaaaaaaaagtccgggcatggtggctcacgtctgtaatcccagcactttgggaggccgaggtggacagatcacctgaggtcaggagttcgagaccagcctggccaatatggtaaaaccccatctgtactaaaaatataaaaattagccgggcatggtggtgggcacctatagccccagctactcgggaggctgaggcagaagaatcgcttgcacccaggaggtggaggttgcagtgagccaagaccacgccattgcacggcagcctgggtgacagagtgagactccatctcaagaaaaaaaaaagggactcagaaaaattgaggtcacacagaaaataaataaatattcagactgcaacaaatgctatggagaactaaaataaagtgatatgagataaactggagaagggaccagagtaggaaaggcctctgaagacttgtcatttcaactaagtcttgaatgtgaagaaggagccagtcctgggatgatctggagagaacacattccagatagtaaaagcatctcatttaatcttcactacaacctgtgagagaactactcttctcatatctattttataaataaggaaactgaagcacagagtgattaagatacttgcccaaggccacatacctattaagaagtagactatttcaaaacatcatattgtacaccatatatacatatatatataatttttatttgtcattaaaaataaattaatttggccaggcacagtggttcgcacctgtaatctcaacatattgtgagaccaaagccggaggattgattgagccaaggagtttgagcccagcctgaggaacatagtgagacctcatctctacaaaaaatttttaaaattagccgggcatggtgatgtgtgcctgaagtcccagctactcgggaggctgaggcaggaggatcacttaagcttgggaggtcaaggctgcagtgagccatgatcgtgccattgcactccagcctggatgacagaaaccctgtctggaagataaattaattaaaattacacaatgttgacacaatgtttgcacatttaatataggcaaagtgcttcagtaggtgagtagatttagaaattcagtcatggtagttgaagaaacagagcggttagatttaaaaatcccttg

SEQ ID NO: 17104 - DNA, 15566 bp, Human
catcagttcattggtggagacgctgtgcctaggcaggtgttctttcaaaagcatcttatctaaattgttgtgattccaaaacaggaatgtcttgcagggctatttcgaaaagtcccgagacagccaaccctttttaaaaatatagatggggtcttgctatatcactcaggctagtcttcaattcctggcctcaggggatcctccaaccttggcctcccaaagtgctgggattacaggggtgagccaccacacccagcttcctgagacagcttttatctcagccatgtaagcatgagcccttccctttcataccctcagggttttactttgggtcaacaaatagtgagtttattttggtatgtgcaactttcaaacacccatcgccataaaagaaaggaccagccttggccaggcacagtggctgatgcctgcaatcccagcactttgggaggccgaggtgggcggatcatgaggtcaggagatcaagaccatcctggctaacacggtgaaaccctgtctctattaaaaacaaaaaaattagccaggcatggtagcgggcacctgtagtcccagctacttgggaggctgaggcgagagaatggcatgaacccgggaggcggagcttgcagtgagccgagatcgcgccactgcactccagcctgggcaagagcgagactccgtctcaaaaaaaaaaaataaataaataaaggaccagcctcgactgacagtcggcactccgcaggcatcctccacaatcctctctcctctctgcctcttgccctacaacctggccatgccatgattcctccctacctgtcctcctctgtggacttcatgaccacgctctgtcctatgaggctggaccagggtcatgttcactcacttctctcccctccctgccatttgttccactccccaacttgttctccacgcatcgatctcaatggagcaacagcaatcagatgatgaaaataaataatggtggccagtcttcaaatggatccccttttcaatcccgcactatccatctgctgccttctcatcagccctctgctcccgtttctttcccttctcaaactggacaagcaccgtactccgtgaagatgtgtgcagcctgttcccatgccctgaacaccatcccttcaagctcctctggctgctccctgctcaggtctcagaaaaggagagctgggcaaccctcccagggagccgcccgcctgtgtaactttcagtaccagcctgtttgctttcttgagataattagctacaacggccactttaaaacaatggtcttcttattttgttttttgttttcaccctaaactttataaagtcagaaatcgtaagtccttgagcatccacagccactcaaggacgaacctttgctgaatgcctcaagcagagagggggaggctgagtctctgtttccagggtgaaaacacgacggtttttatcagccctgttttatgcgacaatcccaggtcgaatctggatcaatgcaatgacttcctttgtatggacctatgttttgttcgtgcattcatctgtgcagctgggaacccgcagctctgttcactggcatggggatgcctcggggaatggcagggcagagccacaaaaagccagcctcaccacgcggcctgttgctcttagccaccatgcccatcatagcctgtggcaggagatgttggggtcccccccccgacccctttcaggaaaacagagtttgtggaggcggagtacttcccaggcctgactgataaaacaattcaaaagactcaaagagattcctcgcctgtcccgtcccttgaagggccttgaacacggggtccttccgcttggctcctagcccgtccctctccccttaccaggaaaggatcctccccatctctgcagaagcctgaccatccccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacaggtctgtattggcgacaaaaggagcagccctgaatgtagggaaagcagggcggagtcctctgcaggctcgggggaggggaggggcgtgaatgcgtggatttctgtggagagtggaaacacggggagtcgaggggagcatgcgcgggcctcagaaagttctgggaaaccgactcctgggagcagggaggaacgcgcgctccagagagtaagttaattgaatcccggggggtggtctcttcagcccggggggttacagaagtaggtaaatccagagattacccagccaagggcaggggcatcttttctagacttgcggggcggggtggggcgagaacttgagctcaggggaccctggaaccggcccctgcaccccgcatcccactgaagaaaagggaggtcgccagaagcacagacccaggacagagtccagacttggacgtctccgtgatcccagaacaccccgtcccacactcccagtcagccccccgcctccccattcgcccaccgcaccccctttttccaccctgcccccaccctactgtctggtgggaaaggccgcagccatcacgtattcacccatccccacccctcaccccccaccttctgactttctttccacatccccaccccctcccccactctctgcctcttttccctccccctccccaaccctttgtttttcttacacatccccacccctcccccaacctctgtcttctctcatccccacccccaccctgtttcccttcccccattcccgccctggcccgccttctgtctcccttcccccatccccacccctcccccccttctgtctcccttcccccatccccacccctcccccgccttgtctaccttccgccatcctcacccctcccccaccctgtctcccttcccccaccccacccctcccccaccctctgtctccgttcctaatccccacgcctccaccactctttgtttcccttcccccatcccgaccccccaccccaccctgtgttccttcctccatccccccccactgtctttcttctcggttccccaccctgtctcccttcccgcatgcccacccctcccccaccctgtctcccttcccccatgcccacccctcccccaccctgtctccctttccccatgcccacccctcccccaccctgtcttccttcccccatgcccacccctcccccaccctgtcttccttcccccattcctaaccctcctcccgccccccttccccacccccatctcccctccttccccacccccatctgctccccacccccagcctcctctgctctccaacttcctctccccttttcccctcctcctgctcccttctcctctgctcctccccccactgcccctcccccactgcccctcctcctcccagtctttgaaaacaagcccctctcgactctctgggcgacctcactggatctcgtgagattttgccctggaaggactgagaaacggggattggtcagaccaggctgcccagccccccggcccccaccgccgccccccccgccccacgcagcggctagggcgcttagctgagccattgtctcgttctttccttccagcaacttcgcggtgtggtgaactctctgaggaaaaacgtaagttcgagccctgattcctccgcttccccgcagggtgaccttgggcttgtgcccccggcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgctgggggttggggacggcccaggcagtggcgtaggcgtcctaggaaggcgggagcagaggcagaaatgtcgctgcaagaccgtagtcagggtccttgaccacaggggtcacttgtgaccaaccacatggtctgttgttcctcctgccccctggttcagcccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtgggtaagaaggtcccctgagctgtctgaggtgctcagagaagccctgttcccctctgtccttgtcactcgagccagatgggagctgcatcctgaggtccctcacagtagacgaagaggcaggagccgcttttattgtttctggtcatttccacaaaagagcatttcacttcccgtgctgtctttgtatgagagtcaaccctagggtcgggcacggtggctcatgcctgtaatcccagcactttgggaggctgaggcgggcggatcaccaggtcaggagattgagaccattcctggctaacactgtgaaaccccgcgtctactaaaagtacagaaagttagctgggcgtggtggcatgcacctgtagtcccagctactcaagtggctgaggcaggagaatcgcttgaacccaggaggcgaaggttgcagtaagccaagatcatgccactgcactccagcctggcgacagagcgagactccgtctccaaaaataaaaattaaccctaggccaggcatggtggctcatgcatgtaatcccaatcccagtaccatgggaggccgaggtgggcagatcacctgaggtcaggagttcgagactagcctggccaaaatggtgaaatcctgtctttactaaaaatagaaaaaaaattagctgggcgtggtggcccacatctgtagtcccagctacttgggaggctgagacaggagcaggagaatcgcttgaacccaggaggtggaggttgcagtgagccaagatggtgccagtgcactctagcctgggcaacaagagtgaaactcctcctccaaaaaaaaaaaaaaatcttaatgcattgtggaccttattgccaaagccacgattacattcagaacctttccccggggtaatcagacgcaaaagcccacacttccagtggtgtcagagagtatgagctccaggaggctttgatctcactgccccatgggcttgggccattaggggtaagtgtcggtcctgggaagtgagcaacaagattgcactgcctcatccttgggtgccacctggggagatcagggagaacatgcaacctgggttgaagccgggagacttgtgctggaactaaaggctcaaggacggcacagtgcgttggactgtgggaccgtgctcgggtgctgttggtatccacaagcctgtaatcccagcactttgggaggctgaaatgggtggatcacttgagcccaggagttcaagaccagtctgggaaacatagtaagaccctgtctctaaaaaagaaaaagaggctgggcatggtggctcactcttgtaatctcaacactttgggaggcctagacaggcagatcacttgaggtcaggagtttgagaccagcctggccaacatggtgaaaccccatctctactaaaaatacaaaaatatagccgtgtgtgggggcgtgtgcttgtaatcctagctacttgggaggctgaggcaggagaatcgtttgaacccaggaggcagaggttgcagtgagccaagattgcgccactgcactccaaaaaaaacacctgaaggacctggtgcagatacttcgggggtccccactgggattctatgactagagaggagggtgcagaccacccacctgatgagctcagaggccactctggcctgtgcagcccacaaggaccataagaaccagtagacaggacatgcagaaatatctccccaattcatgtctggaccctaggagtcatgctgggccccagtcttttcacttctcccttatactgggaggaaggacagcacctttgtgcaaatgtgcccctggtgctgcttcctccagtgccactggacaaactggcagtgtgaagctggacagaggagtgtcactgcctcacagggagattgcacagctcagagattacacaactcacacttgatcgcggttcctcctcctcccttggatctcctggaagcggggatcccatggaagcttccttaactgttggacttactcagttttcctgtttttccatggtttatgtgaagcttatcagccctttctaacacttagattgtttgatagggagggaaatgaaactctttctaaactcctcacataagggctaccaattcctgcttgcttggagctgagcaggttcttccccagacagagtcagggacttacaagactaaaaatgaaaatgacagtgaactttagattctctgtgaaggctatttgaggtaatgaatgagagctgctgcggcctttgctgtgcccagtagctgcttgataattagggacattgacaatgacctttattactaatctcagtctcccgcagctgatgagtgaagatgattgcctgggaattaaaggaaatgtagaacaaattgtagtttaacccggttttcacaaaggccattaggtgttgagggtgaaaagtaggagaaagtctccagagagagaaccaaaatggaaaacatccttcaacgaattacagcctccttacgcaggccacagtaaacaaagtcaggccgcaagacattccagctggacacttgccagtagaatataagaattgtagggacttcacagtgcatgaggcagagaatggcctggagaattctttgggtggagaggttccaaaacttcaaaagcaccagtgggtgatcaggcccaggataggaatcatccctaagcagatccttaaatgccaaatataacttcaattttttgtgacggaaaatgtatttgtgcactgtgcctagcatggaaatagagaaaaactgagtctaattgataggcctgattgcatctcgctgaccagaatctctgtacctgagcagcttaggggcaagaaagaacagctgttttcttgaagtgtggaaacattagtaatacttaggaaggggctggccattggagattatgtttgtggtaaaggcctgacctgctgcttgtgaacagccccagtgtggaagaggacacctaaccataaagagaaggtcttctgacaacttctttaattgcagggatgtgtgctttcagcccttgtttatttctttcctggctccaagattcctaagaaaccacaaggtctttcagacttgaaaatgttgctgtcctaggtttggtcaccaatattactctctatcccacctctccagcccacattcctagatttaatcttgtcaaggctgtttgccaagaggatcctgactttctgggagaaaacaccctttccctctagggagggaggaagattgaactccctccctgcctcagtgattaccttggctttactggaactatctttcatcttccttagccattcccctttttaatttctctactccatccaggccaaagtctttcaattccgcccccaaaaaaacctatctgtctttgtggtaatccactcagtcccattacaaatgcccagccttacttctgactaactcctaattgtagtgtaattttgacccaccttccttcaggacagccttgactttcaaagtctggaagaccagccacccctctgttgttcctccctttttccttggataggcatgtgatttgctgtgttagggaacatggggtataagtgacaatttgatacttggggattgtttgggagtgggaaggggtgatgtcatgatgctcttcataaagctatcttaactggaatatttgggtaattttgatgtggccaaaaattcccctaacagttatactctctgggtggttttgttcactttttctttcctttttgtaaatagacatcccattcaatcagttgaacctgaagtaagtaaaaaaccccatcaggattcactggctggagatccaggaatgtaattagatttggctcttccgttggcagcgtggagttgaaaggggaggtatgcccagaaaggcctgtaatagcttcagaggggccagaggagggacccagaggccatggagtcaatgttgtggtcttcccagaggtctgggcagatggcttctgcaccacagctgggtctggtgagtcgggagcctcaggctatggccactgcctccttctactgtcacctcagggtctccacgggccatgagggccaatgctgcttagatggttttcctttttctttccttacaaaggaacaggctttgttcttgtctctaaatgtagttttgccttaatcccaaacatttttatttggttattggattgatttcttaattgatacacaataattgtacatatttatagggtacatgtgaaatttcagtttatgcatatatagtatgtaatgatcaaattatggtaattagtataaccattacctggaacatttattatttatattgaatcccaaacattttgatttctgccattttgtatatgttaaaaataatttcttaaacggctttttttttttttttggaaaataaaagacatctactttgaattttactttattacaatttaaatagtatgtggcaagcaattataatttgcatcatttatgattttttaaatcagtgatttactagttaggcttttttttaactacaaggttaaaaaatattccattttaactacaaggttaaaaaatattccattttaactaaaaggttaaaaaatattccatagatttttttctttttcttttcagatgctttggaattaaagacattttctttcttttttttcttttttttttttttaatagagatgaggtctccttgtgttgcccaggctggtcttgaactcctgggctcaaaccattctcccaccctggcctcccaaaatgctgggattacagacatgagccactgtgctggagggtggaggctttttcaagatatctagtatacaagatggtaactgtagttaataatgtattgtatacatgaaaattgctaagagtatatttcaagtgttctcaccacacatatgtgagatcatatgtatgttaattagcttaaggtacctattctacaatgtatacatatttcagagcatcatattgtacaccataaatatacacaatttttatttctccattttaaaactaatgttttgggagaaaagaaccaggctttgttttactgtgaagtgtttgctccgctgatttccatgtcaaagtagtaactcttaatatacgtaaaagagacgcacttaaaatacatgtctcagaatgttttttttttattgtacttccaattgctatgtaatactgttgtgctgcttctgtagtttctcatttaaaattttttagtgaaacataatggcatccattgtgcattgtgtgtgtgttcctcatctttcccatctggcttatttgttggagcagagaaggatgctgtcctgggctatgtgacactcccatttgaattgcctttgagtgatcatcagaaactttttcccaaaatgagcagggtcagccctcaggctccttagttctcacttcccagggggactagaattaaatagagtagtgggtagatacaagatggtgccagtggccgtcctgtcccctcctctacacttgatgagatgttcatcctggtgccagcagagctgtggctttgtggccaccgagtgcagagtggaatcggggtaaactgagaactcccctgctgttgctagcacagtgactttggccctaagttggtccctcagaagggtgaggaaaagatagagttgcttatgcttgggctgaaagggatgccttgttccctgtatgtttcctcagggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggtaagggtgacctagcagcttggtgtggggccctgggaacctgagcaggatgcagctggggtcagggagcatggagcgcctaaggctgggccagaggctctgatggttgccagcaaggaagttcagggaggccttggggctactgcaggggtcactcttggaatgggcttctggacatggggcactgattaaaatgcagaggtgtctgaaggaacatgcacctgcttcctcctggtggggtgggaattggggaccaggaaggatcccaggatcctagtgggaaagggagcagctgatgcctgaagtacgaagtaaaagtgcagatctaaggtggatgtctgtttggttcttacctacattatgagactcatggtcttattttgagttgatcttaaagcatcatctcagctaattacctgtttttccccacaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggtgagggatggtgagatttctctgcagaccagagcaagcccttccttattgcagtaaacaataaaggatatcttgtatgtgccagccaccaataatgcaagagtgagcaagtcactaccagttaacacgtcttgttcaccactgtccccaagcatggtatcacataactactactcataagggttagaggtatacattaggatagatgctattaacagtgactccttgttagaaaactctgtaatgggaggttggggcctggcaagggtggctttaggcattcttccttaggaagtgatgcctaagatgatcaaaagtaagcaaggagggcattgaagaagggaaagcccatcaaaggtgagatttgaaattgtaagctgtgcgctcaccagcttctcaacatgagctgctccctctaaacctgcctcaaatttcctgtctgtaaagggtgatttagaattccagttagggtaataggtgggaaatgcaggattctggagatgtgggagaaggaacaacagagaaattgcaaaaattgataggtggtttgctgatgatacagtgacctaaggtagccctgcagcctgggaaccccctttggatgttgctgaccttgccccagtttgtccactgtgaatactccctagtagcttcatcaggcacagagatagaggtgactggggcccaggcagtggcagaaggaagcccgagttgaaagaaagtattttcagttgtatcttcaaatactaaaattcactgatgcctttccttgcttgagacatcaaatcaggctctcaattcaattcatgctcacaccacctaagaggtctgtgttggaccctgcctcacagatcagccaagggagtgtttgagatctttgtttacttgacccacttacacagcaaatgatggagaaaggactaaacctgaacttgtactccttgaatgctcctttacagcatggcatcctggcggttaaccatcatcaggaagactttgggttttggtgaaatgggcctctctccagtctccccaccccactaccaccattccccagcactaactgctttgtctatttgcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcacctggtgtcttgtagtatatgaacctgctttcccagttaaacctcaggaaatctctagttgctgattaaataagacactgctcatccatggtacttacacctttaggctggacaaggtcccagcccccagatctcatgacaccattcatctctttggggcatctgttatctccttgcttatttctttggtgttcaaagggtcagagcatgcaaggtacatcctcagggcctggaacatactaaggaaggggccggtaatgaacaccactgagtgaagggttcttcacaggagccctcactactaaacccttgagaccctggactcagtcctccctgttttccagtggactcataagcctccatccctggcctgtggctgtgccagtattgggcttgactgcacaagtcagacctcccgtactggaaggggatgtccagtactgcacttgaagtggagcgtctgggcctcaccaacctgtcccaccaggtccaacccctttctgaatttgtgacccattaaaaacatcttaattccttttggcaaaacactaagatcatatttacttagtatttgtacccacattaaaaataggacgacatcttgggtcctatcagtgagaaaattacttctgtgacataagagtccccccatcaatgaggtggtaaactgaatctcagccagtgagatgccttggatttggggtcccaagagtgaacaaactcatggcaagtgctagggagcacttcaggggaagtagatgaatgaatgtcagatttgggagttgggggtaggtggaggccaccttatagaacaatctatccaaaaggatgagagatgtcatactgtgcaggtgaactctgcaatccctgggcagtcagcctacttagctgccaccgctcctatgctagtgtgtcctgcccttagtctgcctcatctccctcactgtacagcttcccaaagaagcacctgggaagaaggtcacacaccaaggcccaggggcgggctctatctgcacgtagccgtgagtgccagcacacccagtcctgcctgttctgaggcctctgtcctggtgataaccacccatgaggctgctggcattgcagactgtcagcaatttcctgtcttgcaacacacagcagctgggcccttcaaccttttttcttctgttcccatcttcaagcctcctaccgtaagctctataagaaatagaaattggctgggtgcagtggctcacgcctgtaatcccagcactttgggacgccgaggcaggcggatcacctgaggtcaggagttcgagaccagcctggccaatgtggtgaaaccctgtctctactaaaaatacaaaaattagccaggcatggtggcgggtgcctgtatttccagctactcaggagactgaggcaggggaatcgcttaagcccgggaagcagaagttgcagtgagccgagatcacaccactactccagcctgggtgacagagcaagactccgtctcaataaaaaaaaaaaaaagaaaaataggcccatcagctgtgggcacattttgccattttttaaaagctctccctctttctctctctctctctttttagagatagggtcccactctgtcacccaggctggagtgtagtagcatgatcatggctcactgcagcctcaacctcccaggctcaagtgatcctcctttctcagcctcccaagtagctgggaccacaggcacatgccaccatgcatggctatgtttttattttttctagagatgggggtcttcctatgttgcccaggctagtctcgaagtcctgggttcaagggatcttcccaactcaacctcccaaagtgctgggattacaggcatgagccattgtactccagccttggcaacaaagtgagaccccacctcaaaaaaaaaaaaaaaaaaaaaaagattaataatacgtaccgtgtaatgtcacagtgagggtcacttgggctaattttttatgtaaagcacatgttagaatgcgta

SEQ ID NO: 17105 - DNA, 29671 bp, Human; identical to SEQ ID NO: 12229

SEQ ID NO: 17106 - DNA, 9578 bp, Human
gcaggcctgggtggtggggcctccccggggcccctctgtgtggccctctggctgtcttctcctcttgtggtatttctggctcgtctccactgaccatccccccacccctttctttctcaatactgttgccaaacatttggaagaaaagtgaaaaacttgcccccccgccagtcccggatgttgtcagatttccagatgtgggtgttctgccctccagatgagaggcagaacgtgttccagtcaggagcgggctggccccagccctggactgctgtccctccctgtgaggcggagtgacaggatgagagggactgggcccagtaggaagacagcagggcgtgccaggtagaggccctgggccccacagcacctctcagcctcaggcttagccccttgccacaccagggaaatccctggctttgaagtttctatcaaaggctccaggcacttaaaagtaaccaggagcacctccttcccaccccccaggcacagatgctgggcaaggaacagagcccaatgtgtttacaagatgtccccactgttggcgtccccatgcgggaagagccttgtgccacctcagccctcccacctccccaagtggcagtcccgtcaggctgtactctgtcactgtcatctgctgaaggctgggcttgggatggaccctgggggccgggcactgcaggatgggcactgggggtgggcactgagtggtaggaacagggaatgagcatcactgcactggggcagaccctgcttggcagcttggggttcctcagagaggcagaccctctcagagcccctgccaaaagggtcggcagagggcaacatgtggcagtggaatagcattggagagagctttctggaagagggccagtagagccaagccttgaatatgtcaggcagagggggcgagggcactctgggcagagggtgcagtggggagccaggcctggggtgtgtagggaaatgtgcatccctggggcctgtagagaggggaagtaggaatctaggggtgaaagctgagaaactggtccctgggccagcaggggctgaagagggaggctgctgaactggcctggggcgactgccctagagggagcagcatcctttctcttgccctttgtgggggttcctggagacccttggacccatagccagggctacagctgcctgccatgaccagacactcacatacagacacatgtaaacacccagacataaacacacagaagcaacacccgcagacacactcacatagacacatagacacaccacgcacacataaagacccagacccacagagacaaatgcagacacccgggccatcccttacatagacacagatacggagcacacataggcacgcacagagccccccaccacggaggcacccagacaatacacacaggtgtacacagacccccctccacacaaacacagacacagagagacccacagacacatagacaccccgacacagacacagacaacacacacagacacatgctgacttccgccttcccccacatggacacggtcatagacacagacacagacacaggggactttggagagcttaagttcagaggtgcccttagatcatcccagtccttctggccccaacacaacacgtagcatgtacttggtccacccttcttcacctcttcaacttacggacctgcagagaggcagcagggccctgtgtgggtatgtgcgggtgtgcagatgagtgtgtgtgtatgtgtgtatgtgtgtgttaagcagtggcctttgtccccctctctccctcccccttcccaacaggtgattgggaggaatggagatccctcctccactacccattcctgagcctgaacaatgccctccccaggccccaaaatagcccctaagcctagccatatccttttatggccctgtccctattgtgcactgcaggggtggggctggggtcatgaggtatccgggcaggataaaggcctgggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaaggtgggtatggaagctgggtggtggcaataggagcagggcaagtgagtggatcccagagtggacctagcaagaggcaggtcaggctctggaggtgagcactgagctgacgctggaagcttctgtgcagaggtcagacaagccctgactgcttcaggcatcagaagggctgcagcaggagggatggtggtcagacgttctgcaggactcctctggtgctgctgagaactaaggtggagtctagactggggtttgagtctggactgtctttttagtggttttggaaatggactctcccttgcccttcttcctggacttctcatccttggggaatcctggagtcagctggagccaggcagggattttccttgttcagctgaggggtcccaagtccatacacgctcccagcgtggatgagatagggagtaagaagaagcagggcccctgtccaggctgggtctcgttcaaatcaccgagcccagagctggtagagcacttccaggcctcagcttttaggtagggaacttgaagcatcagctggctggggacattctgaaagctgtgcaggaagctggtcatggagctatgaccagtggccccaggagcccttccccaactgcaaagtctttctcagagtctaaacttggagggagccatgactcccacctgtggtatctgcatagcagcacgtaccctgtgtcctgcctgctccctgttcttggctgggaccactgctgccctggctgcctcctcaggagccctgtggaaccctcgccatccctgcatgcccagcaggacctacattccatcggtgaagtcttgcctcctgttcatgagcccttcccagagacacctaccatgtcctttgaggcaagggttcaaatcccaactctgctccattttagttgccaagttcttcgctgctctgaggcgtggtttcctcagctgtgaaacagaacagcaagtcccctcttgcagggctgctgggaaccattcagagtatatgcacctggagttggccacccaggtcccaggcttgcattctgcaggcctcatggtgaggctgtgaccacagccacggcccatagtggcattgtcctttctcgccaggccttaggttggcacagacttccttctgagaggtggggacaatgagacccctcatgcgccctcttcccccatccccaggttgcaggtaaagggcagggagcctttgccaggagcccagagaccctaatctcagtaggcttcctggtggagagagctctcagggagccaggaatgacaacctgttcttcccaacactgggtcaagccagaagccaggagggacagtcatggtagggtggccctgaacagggtgtccctctgtgccggcatgcactgtggagattggtggggctccgtggcagcagccatgagagagacgccagtcatgcccctcccccaacctcctttcccttgtgtgaccttgaccttggggcgagtgactgcagtgataaaaatagacctggtatccggtgaggagggggacactggatcccgggaggcctcttgattgacgtcaatcaaggtggccccaatgtgacttcagcaaacactcagcagcactgccctggccctgtgctgtcctggggtgtgggagcttcccagggacctacggacagggtgtgtgagaaataggtatagtggggctggtgagtgactgcctggtctttagggcttagggggctctgtgagggcagacgtatgtagacacatgctcacacacaaacatgcacacttgtgctcaccctcgatgcttccagccaccagccctcggcctgtaccattgcccttactccttctaccaccctgggccctcccatctcacttttgctgacagtcctgcccaccaggccccaagcaaagccagcctgactggggcttgtggcttaaggtacatctgtccagaaccgggagcatcaggtaaggcccacgctggcctgaggccttgggcatgtggcctccctcctcactgctacccctgccagggtccaccgagcatcagggcctcggtgcacacagcctcaaggccttctggctggagaggtggaggggggcaaggaggcaggagggcgtcaagatggactgcaggaggtcctgggggtgcaggctgggatgctggaatgggacaggctgagacagttgacattctgggctggccaccgagtgcccaggaggaggtgtggccccaccttttaagccgggcatctgagtctttggggtctcttttcagattgagttcacacctgagcagattgaaggtgagcaggggtcttgaacccaggggttgcaggattgggctggggttccctggtctgagggtcctgccaggggtgtggggagtggggtaggctgaccctgggagtgtctgtggctcactgccctctcctggcagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaaggtagtgcacctgcccgagagcccccatagtgttagtaccggggagactggctgggtgggctgccatccatcctgcgggatagcacgagaatctttcctgacatctcgcattgtcccgatgagggcaccgaggccagtcacagggccatgccgaccaggtgacatgcagtaatggtttgctggagcatctggatccatgctgatttgccaggccccctggtggtaggcgctgacacctatggagaagtgagaaggtcgggcagtgacagcagtgggcagtgggatgctgtcatcccaatgctttgggaggatcacttgaggccaggagtgagaccagcctgggtaacatagtgagattctatctctacaaaaattaaaaatttagcttggcatggtgacatgcacctatggtcccagctactcaggaagctgagccaggaggatcccgtgagcccaggaatttgaggttgcagtgagctataatcacaccactgtactccagtctgtgtgacgtaacaagaagacctcgtgtctaaaaataaataaatgaatgaataaatacataaatgaataaaattttaaagctaaaaaaaaaaaaaggagtgaggcccaagcccccaccaagggttcaaaagtcccagggaaggtctctgattggcctagctgctcctgacccaatcacaggtggtggagggtgaggtctataagaaaatgccacgaggggaggactgtttcccaaaagtaggcaaggggttctggacagagccctccgtggtggctcagggcagcaaactccctttgtgaatagcaaagggctatggaaacagtgcattgctcagtagactgtaaagtgcctcgcgatggtagtttgcttttaaatggcaaactggtgtagactgctgtgagaactggtgtagactgttgtagaactgtgtgagaggtggggatagctcctcattatcaggcatgggggaggggtgtgcccaccccagccttagaccctggaacctgggaccatttctctgcagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagggcagcctcctcccctaccccaactccttccagggacatcctgggagaaaccactctgttgccccccaggcctgtgacccattggtgaaatggagagagttacataattagggagcctcaatggcagacaacagaaatgttacttaggaggagagtaaagcaagcatgctggtgcagctcacagaagggggatgacatcagctctggggacagagcagggcaggaaggagccgtcttgatatgctcccctccttcccacgactccaggccaccgtcctggtggtcattactccaaggtcaaattccagggccacagccctaagtggtcaagcaggtcaagtgcctgccgcctggggggatcctgacctctgtggagccctgtgtacctcccacttatacccctaccatcggctgcctgcagcagggggtccctcttcaaagtgattttttcctgcagcaaacatttgagtgtctactgtttcagctccgtgctggtctctctctcctctctctctctgtgtgtgcatgtgtgtctaaaggtgggggtaagaagggggagctgcggctggcattttgaaggggggccagcacagcacacagaagtacggaggcaggagaataccagacttggggagcagcgggtggtctcttggctccctccaccaccctctcccaagatccccaactccaccccatgggcccttcctctagcctcaaggggctgccccaagggactgcttctagggagccctggcttcgtcctggcggagggaccccctcccagcctagtgggacagaggacagcacgtactgcaccccaggccccttcttaacttgtcactgattctcctggcctcagaaatggggtgatggccaaggtcttgtgaacagtgctggttgtgggaatactggagaggttgagccaccatctagagggattcagtgggtgcccccaccccatcatgcctctgcacgcacggtgctgactcagcctcccactcctgccaggtgagaggctgacagaagacgaagtggagaagttgatggctgggcaagaggactccaatggctgcatcaactatgaaggtgggctcagcaggggcaggggtcttctgggaggggagtgctgggacccaggctcccagccatggcttccccatgttgcactcctgccactcactctcctcttctttccagcatttgtgaagcacatcatgtccagctaaacctcgtgcccaggtaggcacccactccctcctgaacccgctgctgccacctgcccacactccaccagctgcagtgctcacttgacatcctgctgcctccgtctccctcctcctctgtaatctgcactgcctttgctctcaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggccttcctttctgacttatttcccttcctccctctcttttttccttctctccttccttccctcccctcctcttttttcttccttttctccctccctcccttcctacccacctccctccctttcgtcctttcttctttcctgccttccctcccattttcctccccttcttccccttcttccctcctttcctttcttcctttcctcttttccttcttccttccccctttttttccttcctccctccttttctccctccctcccctccttccttccttcctttccctctttgtcccacatttctccttcccctcttccctttcctccttctttccctctctccttctttcctctctgtggcccttggcttgcctatgtgaattctgtggcccatggacgctgagctggaggaggccgagtgcttctctgttgcgcttgcccctcacctagccttctgcaggaggcagccatgctggggccgctaacacaggtatgcgggctgctgggagcctgagagcactgtctgagctgtctcactgcatgtccaccaattgggtgaccatggggcattggcccagagccaccctgtcacgggtgggaaagctgaggcccagcacagggaatggccttgcctgagtgacattgggaatgggtggcagggcaggagctaactttgtccccaggctgtcagagctgaccccttgccctgactccgatggtgaaactgagccactctgccagcagtgtggctctaggtcagaggtagaggctttgtggggatagccccgggctcctcagcagaagacagcgtgcaatccctgcgtggtggagggaggtgcacacacctgcagacccctgccccattctatcccctgctctggggccagggcccctcccctgagtcctggagcctgatgaggatagagaggggaggcttcctcgaggagatgattcacgcaggcttgatgtgaagagagagcaaagccctgcagagaggctgggggccccagatatagaaatgtgggggagatcaaaggctttgagtggggagtgggccacactggatgggaaacaccttgcaggccaggacccaggagtcagggcagctccagggggcgccttttcatgacctcgtgtggatgcgcgtgtctgcgtggcaggggggatgtggtggggtgagagcaacttggaaggcctgcgtggatcagactgtccaaggggctgtgttgtgtggggagtcctgagtgtgtgtgagagtgagtgtgtgtggatgggggctgctggcagtgtgtgggagagagtgcatgttaggggtgagtgtgtcgcaggagtctgttgcatcctcctttcattctctcagcatttactgagcaccgactgtgtgtcaggctctgttctaggtgctgggaacactgcagtggagaaggcagtggaaacctctgccctttgtgtagaactcacacaaaccagacaaatcctgacagtggagtatcgaatggtgctaaaggcagagaaggactgaaagcagggagggctgtggtgtgtgtgtgcatgtgtgtgtgtaagccgggaggtgggtgacatgttaaataatgaggtcaaggattatctgggcaggaaatagttgagcaaagatttaaaggagagaagataatatttagaatatataaagaacttctataactcaaaaaccaccccccaaacaacccaactaaaaaataggcaaaggacttgtatgtatacatttctctaaagaggatgtgcaggctgggcgtggtggctcacgcctgtaatcccagcactttgggaggctgaggcgggtggatcacatgaggccaggagttcaagaccagcctggccaacatggtgaaaccccacctctacaaaaatacaagaattagcccagcatgatggccggtgcctgtaatccaagctactcggaaggctgaggccaaagaatcatttgaacccgggaggcggaggttgcagtgagctgagattgcgccactgcactccag

SEQ ID NO: 17107 - DNA, 41454 bp, Human
gcaccaggggaaataaataaatactttttctaatgagctctgtatacaatgactataaaaaaaaaaaaaaggagagccctagaagataaattttataacttttcttttactttgagcagtttttccttataaatgtgtatgattaatattttggtcatattatattataggtatggctcatagagaagcaatttagaagcagattagggtttgaagttggaagcttaaacaaatccattcttaatcctgacaataaagtttactgtcaaaattgttggttacagatacttaaattgctatttatttttttaaagaaaatgttccaaaacataaaacagtaactagttttgagaccattgtcctctataagggaaaagaaaatatttcagacacatttaacagatgccaatttcagtttctcaattatgtcatcaaggtattcttcaaaccaaatataaaaatatatatataatttctaatcactcactttttatacatttataaacaggcagatacagatacagatacagacacaggcagttatttgggttaaagaagctggcattttcatggggtttagaaaggaccgtgtagtccatgacatttactaccaggtatcagaggaaaagcataagcagttccttttcttgaacatttgccttctaattgaataggcattggaatacacaaagtagagggtttttttaaaggatttgttctttcttttatctactacaaaatatgagtatttctcaatgatgacaataataattaccatttatcgaatgtttattgtattcctgtctttgtgccaaccacctgacctccgttatctgaaaaatctttccaacaaccctatgacatagatattgttattcttcatttacaggtgagtaaatggaggtttacatttgtatggaacatgttctgctacttgagataatgggaataggagcctaggagggctaaaagcaaggagccagcaagtctagacacattccagaggacattatgtcagtcatgcaagccctgcctcagctttcttcccaaccctcagccttttttcccaacagtatataaataatgtggtgttcctttcaatacaggtgtctctaatgctagtttgttccattcttggtgaagttaatttgaatcacatttggttagcatgtttatcagtttttttctactgagtttccttttgtgaagtaagaacaaatatgtttatgaatgtagagttagctgtgctaaaattaaatgaaaagtcaagcaaactacccagatagtttaagccaatcacccaggatttcatgaaccctttgagccatttatgtttcccttgagggatatttcacatcttttacctgagagttctacagggcatgcttttattagttgaaatgtcactgagggcgagagtaattgttcaacggatgtacttgaacttggacatttaagaattaacagaacgggctgggcgcagtggctcacgcctgtaatcccagcactttgggaggccgaggcgggaggatcacgaggtcaggagaccgagacctttctggctaacacggtgaaatcctgtctctactaaatcctgtgtcggattaattcgttctacttgctattaccaataaatagcatgggctcccagagctatgcctggctaactctatcaccttcaagggtttgctcaaactattcagcctactttaagtaaatcaatttccaaggttacaaaataaacttcacgtacatttttatggttaggtatttgcgcgtatttgggggctccatagctttcatccgttactcaaagcgcttcaggacgctaaaaaggctcagagctgcttcgataaacaagaaagaatgctgcaagcaaaggcagcagtttcgctgtaaaatcctattgctgacagccaagacgggcgtattccctcgcgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcggtgagtgccagccgggacttccgcggctgcaggccgggaggctgtggggtggggcagcgagtcactcctgtcgctggcttgaagcagggcggtgcgcgcgcggctgggagtgctccccaactccggcgccgggctagagctggcctcctttcctggatcccgcggactgggtgcaaccagcatctgggcggaggaaaaaggggtgtcagccgtgccgccccgagaacagaccgccgagcccacgtcggggaaagccgaaagatttctccagaagttcattccggagccccaatccaacccgtctagttcagcggcctgcagtgggacccgggagcctgcgttttgggaggaggtggtcaccccctgggcccggctgcaggagcgcgggctgcgatctgtgtcccagttcgagctgtgaacccggcgttccccacggcttagactcgccgcgcggtagtgaacttgggacccggactcagtgcccgggctgcggcgcggaccagaattgtccaggacaaactgggctagaaatgacctggcgagggttccatcaaacaaggaaattagctttagatatatcaacaaatctaactaaatacagaggattaatgaagacagagtctaagtagttcagtgactactaaggtggtgtttataatatgatcaaaagtttcagatactgtctgatgcataaaatctattcactgggtaaacaaattggaagcatggagaattcattatttaataagggtgaaggaactggcaaatttgcgaatgacagcattggtgtaagctactctaattttatttgagagctatgaaacaaaatgcctacttttcctggggagatttgggaagacgtcactgagaaggtgacttttctttaggatacatacttaactcttccttggaacattataagacagtgatcctcaaacttttttttttttttttttttttttgagacagagtctcactctgtcgcccaggctggagtgcagtggcgcgatcttggctcactgctgcaacctccgcctcccgtgttcaagcaattctcctgcctcagctttcctgagtagctgggactacaggcacgcaccaccacacccggctgatctttttagtagagacgggggtttcaccatattgaccaggctgggctcaaactcctgacctcgtgatctgcccgcctcggtctcccaaagtgctgcctcaaaactttttgataacagggctcccttatgctcttaaacaggacctcaaaggacttttgtttatgtaggttatatctatccgtctgtcgttatcgaaaggtatctacataactgagaaactttacagatatttagtttatttaaaagttacaataagaagctcattacatgttaacataaataacagtttttatgaaaaataacttttcctaaacagaaaaaaagtgaaaagagtgacattgttttacatttttacaactcccttaatgtctggcataatagaagataaccagataactatatctgcttctgttttatccattggcgtaagttagtttgattgaagcatggcaagaaaatctaccctcaaatagagaacactggaaaaagggagacctgagagaccctctgaatgggctggggggctacagttttgttgtaacagcttttttacctttaatgtgcaaaggaatcacctgggaatcttgttaaaatacagcttctgattcagtgggtctgggatggggcctgagattgtgtatttataaccagcttctaggtgtgtggaaggtgctggtggagattgtctcccttttaaaatgtaggagactttaaaaaaacaataatagcctagccaataagattagttgcagtttattgccttagagaaaaaaatgccaatttttccattacagatttcttcatctttagactgagaaatacatgttgcaataaacttgctgccaagtgttttgattttcttccctctgcatattctctcttgaccacctttgactgacctgaaagtctttattcgtttggcatttcttttgctttcctatgtctttatatattttacttaaaaatattgcagagatttccttaacacagtacaggctattcaattttaagatccagtaagactcgattttaaattctggctctattgtttactcattatgttgacaaatgattcggtgtcttacagccccagtttcctaatctcagcatatttttttcctgagggaaactctcaagtatggaaaatctatatggacaaatacgtgctttataattttatctctactagcaagaaaaaggagccgatcatttccattatagggataaagtagatgttagtttatttgatgcaacaggacaatggtcaaggtcccctgcatgtcctggtcccctgttatctcttcttcctagaatctctggcctcatctactcttctcagcccactctggctacaattgcctccttgctctttctagaacacatcagacaccattcagacatacagcctttgctctagttgttcttttgtcctaaaattcttttattctagaggtatgcctggctaactctatcaccttcaagggtttgctcaaatctcacctttctggtttaacctaccctgactgcagcacttttttttcttttccttttttttttttttttgtttgtttgtttgtttttagtgacaaggctcactatgttgcccagactggtttcaaactcctcagctcaagcaatcctcaggcctcggcctcccaaagtgctgggattacaggtgtgagccaccaagccccgcctactacattatttcatacggcaacctctgtctctgcctccccccaggcacatactcctgatcccttctctacttttctttctccataatacttaccaccttctaaggtattatacaatttgcatatttatagtttattgtttattcagtttccctttgttagaatgtaagcttaaaagccaagatctttgtcctcatcttagtcctttgttcgttattgtatcccaagttactagaacagtgcctggcacagaattggcactcagtaaatatttgctaactaaatgaatgaataagccacaaaaaaaatgatacttagggaaaacttagaaataggttgtaatagcgactgggcacaatagctcatgcctgtagtctcagccctttggaagctgagatgggtgtatcacttgaggtcaggagttcaaaaccaacctggtcaacatggtgaaaccccgtctctactaaaaatacaaaacttagctgggtatgtgtggcaggcgcctgcaatctcagctactacagaggctgaggcagaagaatggcttgaaccgggaaggcgaaggttgcagtgagccaagattgcatcactgcattccagcctgggcgacagagccagactccatctcaaacaaaaaaaaaaaaaaaggaaagaaacatgtaatagtaaaaagttatttttttaaaaaccctttaagtctactttgattaattacatgaaatagatcttttctggataaggactagaaaagaaaaggcagagtccaactaaggaagaaatacactaaattagaatttaatgcaaaatagaaaaagcatcctttggcaagatttgaatatatgataagttttttagatgtgaacttgaaaatgtacaaaatgatgcatagattttcaaaatttctttcaggggtacttcaagggtaaaaaaggctgaagaccactgaactaaaggagctacaaaactgtctcatttgaagcttggtgtgggagggatgggagtaggtcttaaataattccattttacagaatctttatcagagattgatgggtatttttatctccacccagattggctttgtaatgtggcgattacatcaacatggtttgcatcttatacacctgcaatttgaaattgtgtgattctggttaaaatactaattttggaggctttgcattattttaaacattgtatatgatatgaaaatttatcagtattactctaccgtactatttgaattttacataatgtgatccatatgtcacctgacaatactacatttcacctcaagtcagacctgtggttagttctaggcatcatcttctttaaggatttggagatggagaccgagttgaataatgataaggtacttcttaattccagctacatgaggtagatcccatcaaaagtggtggcgcccaaatttgaacccagctttgtcataattcaaactctttctacttgcctctcaagtttctctgtgaaagaaatccatgttgttcagtggcactaatttggatatgaagagtaacaattcacttacttttcctattgcatatatatatttttaagatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagagtaagtggcacattttcctctaatgtaatgtatactaggggtattataggaccatttcctagaatgccatatattgctatacagaaaacatagtatgttcagggctttattaacatttttactgctcttcactgtagtactataagatcccaggattcttagagctttttaaatgaattttaaaatgtactatacacaaataagaaaatttgaaaatttacaacttagtctaagagtagtgtttttgaaaaccatgggtaagtggtaacaaaatactagtcaatttcatagtctttctttttctgcttcatgaattaattaaactgtaaaaacccaaaaagtcagcacaatgcaaaccttggtaagcaattggttacctctggatagttcttgattaactaattattattattttattgaccagaaacttatctatttctattacaataagattttgcttcatttccaaaattcactcaatgctagtacagatgctcctcaatttagtatggggttacaagttgaaaatatcataagtcaaaaatgcattgttattatgttaacactgttactatgttattataaaaacaaaaaaattctcggcaccgttattatgttagaagcagaaattagaagattagtaaaatgaagagagaaatggttcaggaacatcataggtttgtgaggttttacacacctagcctactaaaccccatagtttaggccagcctacattaaacatgctcaaaacaattacataagcctacagttaggcaaaatcatctaacacaatgtctactttgtagtaaagtattaaataactcatgtaatatattaaatatatttaatatatgttaaagtgaaaaacaaaatggttatatggatacttgaagtaagcatgttttcgactgaatgtgtattgcttttgcaccatcataagtaaaaaaattgtaagttgaactgtcataaagtacagagacatccgtactttaaaacatttagaatggtttttaaatagcattaaaagtaacttccattaggtttttactaataccttcttggtaagaatgaccaaaataagctaaactcagaagccagaagccatgactagtcttcggtgaaaagcaactagcttctgttttttgaggacttgtttgtttgtttgtgtgtttgtgtgttttttaagacatggtctcactctgttgccaaggctggagtgcaggggcatgatcatagctcactgcagccttgaacttctgggctcaagcgatcctcctgccttagcctcccaaagtgctgggattacaggtgtgaaccaccacatcgggcttcaactagcttcttaaagacaaaagagacattgtacactttgctctggtaggatctcttgtttatttctcactgcttttaaattttattccagaaaaaatgttaagaaggctttgaaataaaataataggagctgacaaattttaagtcaataataaaaatatttccaaagctactttaagcaagaactgtattcaaaacacacatgataatccaagtcttaaaaatttttgtagtgtcagtatcttcaaataccccatatctcactataatccacttaaaaatacaaaaattctcagatattttttcactatctccaactagccatctgtttcctcattctgccattctcatttttaaagaagaaaagctgaggttgcctaccttacacaaatatctaattttttcagaagttaatttgatatagagccatggtgtaaggtgcttctgctctcctgttcttcctatttaaactgtaatgaggttccctactttgtcagcttttgtatgcttgtaccataagttcagcactttaaggaaatatgccaaggagaattgccttttacaatacaggttaggcaaattcccatgacaacatgccataactaagcttgtatgtaagagtacctgctgagcaaaactacatcaatgaatatcagtgggtataattttcaagtccaataaatagtcaagatgggggaagacaatggcaaatataaataagaggagagggctgggtgcagtggctcatacctgtaatcctagcgctttgggaggctaaggtttgaggactgcttgaggccaagagttcacgaccagcatgggcaacataataagaccccgtctctacaaaaaaaaatttttttttaattagcctggccttgtggcaggtacctgaagtcttagctgctcaagaggctgaggtgggaggattgcttgaacccaggattttgaggctgcagtgatccatgattgtgccactgcacaccagcctgggtgacagtcctgtctcaaaaaaaaaaaaaaaaaaaagcagaaaaaaggaggaacagaagtgataaaagagtcagaggcaaatagaagcatatggctaatgtaaataactaccttaagaatgcatttctacacaaaatcattcataagttcaaagttgtggccatttaaataatatttaaaaattatctgaatttaaaatatttgttatttgcagatgggagaaagctggagaagtaagtagggaggtttgggaaaaagctggaaaacaaggactgcttggtgtcaatattgcagagcatcttggtggaattggaggggatctgtactccgcagctattgtctgggaggagcagtaagtatggagacttttaaggttgagtcttgttttgtaaacacaccactcacctttctgaaatgaccaaacaaacaaacaaacaaacaaatgttttctaatcttggaagattgaaaattcagtgtaaaatgtaaaagattataccgctcatgcactcttgcacattttttgaatgtgggataataagaaaatccttttaagttgctgaaataggtgctattgaaaattaaagagatagtttttttttcctgtcaatgcttatggttacttttcccccttagaaaagatatttgaaagagaacagcagagtagaaatatacttccatcaaatatattagaaatttaatatacaagaacaaataaagattgcagttgaaaaatgggcaaagaatttgaagcaataattcatcaaaaaagaaatgcaaatatgtttttttaaatgagaaaagttcatccttagtaacaatcaaatgcaaattaaactgatctggaagtatcattttgagcatctataaaattagtgaaaatgaaaaatcctaatacccagtgctgacaagattgcagtgaaagtgacatacactattggtggcattataaattagaacaataaattttggggggattaaaaaggtgaaaacatattttaaaaaatatgttcctgctctttgacatagaatgccactttggggaatttatcctaaggaaataatttaataggaaaaatagatgctgtgttcagaaatcattgtcatgttaggtcacagttctccaaatgctgaagcaatctaaatgtccagcagtgggagaatggataagtaaattatggtacataaacaacttggaatattttgcagctatttaagattaaaatatatgtaaaaaaataggattttgttgtgtcatataatttatttttaaattttaaatttttatttgtgtgtgtgtatgtgtgtcataattttaaaagaaaatagcaaagtacaaaattcactccatgactccatgttttgttttgttttgttttttggtccttttttttctttttttctattttttgcttttttattttttatttttgttcttttgtttctttgttttaccaagactccgtcttattagaatatatccttatggcaaaggtaattagaggaatacagttattattccactgtgttagaggaatacaactgcaggtgattcatattttaaaatattttatctctcaattaaataagtgttcattgaactctggtagaccactgttattgtgttggaaccagaaattttaaaattagtaaaaacaaaaagagaaaacactcaggaatgtcataggtttgtgatgagataggccactaccaaacaatttgataggaccttaatacattgttgttataatagtcgttttttattgctattttatgctctaatttttcttcttttttcattctaagagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaaggtaagttaatatttagttggctttggattcttggaagcagtgccttaacattttcttagtacttggttaatacatagactgagctatatgctaggaggaaggcaaagatgaacacgggataattcatgacctcaagtcggaaaataacaataaagcggattataatgtaagctatgtttgagatattaacatagttttatgcaaagaaaatggtagtgtgtaagttgaattttcaccataatgaattttaggtgtaggatgagattcacatgtaaatgccaagcagtttgttacagaggtatatttggaattctggagacaaggatggagtagcaataggttttaaaagtctttcatttataagagttgatacaataggaatgaataagatcacatattcagttatttgctggttatttcataagtgtcttcagtgtgccaggtatacagtagtgaacaaaacagatgtggcctctgtgcttattgaggagaagggcaagggcaagaaataagcaagtatatatatttgtagctataaattatgataagtactgtgaaggaaatgaagtactgtgaaggaaacaaagtagtgtgctgtagactaatggtatgtttgtgtttggtgggatagggaaaaacgaatttagatgtgaatgctaacaaaggcctataaaaagtggttgtatttaaactgagatttgacaaatgagaagaaaccagttttataagaatgggagaaagagcttccacagagtgggacctgatcctcaagaggaaaaatgaaacacaaaaaagggaccaaggaggaaaatctgggcattatatttcatttggaactgtacaaaagaagatggagcaagagagacagaaggattgagagttttaaagaaatctagacatgagtaggaagagaagtcagttggaaaggctgtaggaaaggagaaagaagttagtaatgtcaaggccaccgtgatgttgagaatggagaagaggttttggcaggcctgatgatcctttgtgatttcagtggggtggaggggcagaagttaccttttatgggagtgaggtggttgttgagaaaacagaggcagagaacacaaagtaatctttctcagagctgagtggtaaaaggaaatgtagagagggggcagtggtttgaggctaactggtaagggaaattatttatgttaaagacagcagcaacttgtgggtcaacagaaagcaaatagtgcaaagaaagaacttaaagatgccaaagaagtgtaagtgaaaatccaggaattgtttttgcggaggtcaggccctccttttttattgtaagattttcttttctgacagtgttatttatttttaaatctcttaatattctatagcatgacttgcaatatgtttacattgtatttatctttttaagatataaatccctaattataggtcaatactaacaattttgtcaaagattaaaggtttctgttcacttctgttgcctacaagtgtgatctaaacaagtagaaatttaaccttgttccttaaaatttgcttttaatttcattctctaagataactacctgactgactgccaatattcagattgagttgtattagctctgtggttagcatgttccacttccagctcattgcatattagctctcaaaaagaggctatagaataaatgaaatcttgatttatctctaatttatacatgcaaacaaaggttcatgtgatttttgtttaaagtctctggccttatctgtggttaagtgtatataattaagaaggaaacctgagaatgaagatggagaaaataagcagatttctttctttctttctttctttttctttctttctttctttctttctttctttctttctttctttctttctttctttctttctttcttttttggaaggtcattgaaagtcatgagaggatatagtaaataagtcaggtatttagagagatgagcaaagagcccatgtgggtaagagaatataagaacagagaaaagccacagatgaagaagagtaatagagtgttgaggaattacggaattatggcatgaaattggcatgaaatagggaaaaacacgtgggaagaaaagaagatagaagatggaatatggttcattttgcctgccctcagagatggattgagcactgtctatatttttggtttgatttggcctccacagaaaaaaatgttgcaattgttgaaaaacatccagagtttcactggccctttccccttccatggaggaaagcttcattatatataattatgtatctttgtatgttgtattactttagcattttataaatgctttcatgtttattttattattttttaaagaaatagagatggggtctcgctatatttcccaggctggtctgaaactcatggactcaagcattcctcctgcctcagcctctcaacatgctaagattataggtgtgagccactgcacctgatctcatgttgattttattatatggctattataataagatatatggaatatagagatatgatttctgtataagaaggaaacagaaaataataaatgaagtattttgaccaagttcatagagcaaattgttgacatctttggagccagagtgttctgacaccagctgtgtgatcttgggtaaaaatctctgagcttcaatgtctcttatcaatgaaattgagaaaatgatactgaagaagattattgtgagggtctaacttgttggctttactaagtagtatactttttcatttttaatatttcatatataacattcaaaaatttaggaaaaatttacaaactgagctatgtcattacctttatttcctttgatatgtccctgtatagaagaattttttttttttaaacagtctcgctcttgtcacccaggctggagtgcaatggcgcgatctcggctcactgcaacctccacctcctaggctcaagctattctcctgcctcagcctcccaagtaactgggattacaggcgcccgccaccatgcccagctaatttttgtatttgtagtagagacagggattcagcaggttggccaggctggtcttggactcctgacctcaggtgatccgcctgtcttggcctcccaaagtgctgggattacaggcatgagccaccacacccagctatagaagaattgttttaataaactatgtacagacattagttaccgatactttatacatacttatgatgaaaaatatgatgttagaatacaatagcattcaggctgggcacagtctcttgtttatagtggaggtcggtcatataggcaccctctgcctggcatgtaccaaaagttcagatccctaaaaggaaagcaggtattcagcataagccaaattgtttgcgcaaacagttcagacagtaagccactcttatgagtactgggaatggtgggaactctcctgaaatccagattctcagatgttagccacggacaatgttgtaacaggcctttctaaggatagcagtctcaggcctgctatattaattcttttctgtatacttggcattttaataatataatttaacaaatgtttattgagtgcccgttatgtacaaagcagcatgctaggcaccaagcatataaatatgatcttgatacaccacatgttctcaaaaaacttgagtcagataagtgtggtaggtgggaaagataattcctttttattataattgaaattcaaagtaaatggctctaagagagtatatttgttgctttatggcgtctgtgacaaattagcagagacttggtggcttgagacacagaaatttattctcttacagttctgaaggctaaaagtccagaatcagtattgttgggcccaaatcaaggtatcaggagggccacactttctacagaggttataggggaggatccactcctttcctcttctatttcttggtggctgttggcgttccttgccttgttgcctcgtcactgcagtctttgcctttgtggtcacattgccttctcttctgtctatgaaatctctctttacctctcttttataaggacattcatgtttgcatttagggctcatccagataattcatgatagtctctctatcacaacatccttaaattaatcacatctgcaagattctttttccatgtaaggtacaacagcctctagggtataggacctgatatctttagggtcattattcagcctaatacagagagtgatttaaaaaaaaaaaaaatgcaaccaggtgcggtggctcacgcctgtaatcccaacactttcggaggccaaggtgtgcagatcaactgaggtcaggagttcaagaccagcctggccaacatggtgaaaccatgtctctactaataatacaaaaaacttagccaggcatggtggcatacgcctgtaatcccagatactggggaggctgaggcaggagaatcacttgaactggggaggcagaggttgcaatgaaccaagattgtgccattgcactccagcctgggcaacaagagaaaaactcggtctcaaaaaaaaaaaaaaaaatgctgaggggcataaaataaaaacaccactgtatttattactcagtttttgcattgctataaaaaatacctgaaactgggtaatttataaagaaaagaggtttaagtggttcacagttccaccagctgtataggaagcatggcttgggaggcctcaggaaacttacagtcatggcagaaggcagaggggaagcagtcatgtcctacatggccagagaaggaggaagagagagaagggagatgtgctacatacacacttttaaacaaccaaatctcatgataagtaactcactgtcacaagaacagcaaggggaaagtccttccccatgatccaatcagcccaccaggccccctcctccaacactgaagatcataattgaacatgagatttgggtagggacacagagccaaaccatatcacccacataaagaagacaaattggaaaaattacacaagtaatgtggactgtttatacactctgctgtttattataggatattaataaaaattgggacctaagtgttttaacaataggggattatttcttaaaattatggtaaatccatgatgatgctctattcagctaataagaagtcattagatattgttaacagatcaaaatcatattatatggttccagttttataaaaatgcatatatatgtatagttatgtccatagaaaaatattggaaagatatacctttaaaatgttcattccaggagataaaattatttttaaaattatttttctcctttggactgctgtgttcttaatattttatttactaatatttgtttctcttatatttagaaaaataatctattctacacttagagcaggtttgttagaaaaaaatggcatttgagacatactcttttttttttagacaaattctcactgtgttacccagactagagtgcagtggcctgatcatgcctcactgcagcttcaacctctcaggcccaagtgatcctctcacttctgcctcccaagtagctgagaccacaggcgtgtgccaccacacccaactaattttttaactttttgtagagatagagtctagctttgttgcccaggctggtctcaaactcccgggctcaagcagtcctccagcctcagtatcccaaggtgctgggattataggcatgagccaccatgccctgcctaatagctaaatttttgatcaatagagacaggggaaggaaccaaggtgtttaaaggcagcaaagtacatggtgacacgtaatctcagggatacagtgaggtttgaaatgttatgtgagtcccactggggtctcgaatgttagttgggctttgttatactactgtataaaacctggctaatttatataataaatcttaatcatatatttatttgtataagtgctttagaatataatagatcagcatggtttttcagtgcaattgtgtgaacattcttaatactcagcaattttataatggtgtagccagtttgaataatctaatttacatacatacttatatcatttgtataatttaatttttatcatttgatgaattttttatcttttctttcaattacagtgacttacagggaataaaaacaaatgctaaaaaggatggaagtgactggattctcaatggaagcaaggtgtgtaaaaaaggacttctatagcccttcttttcagagtcatgccatgggtaacaatgtctcaaagacaactcattaattctattaaatctagggactcaggcaggaattgaatttatctaagttgttttggagacagtaaatttacaacatatattacttaagatctgtggtagcttcttctatatttcattttgcatgccccctcactaatatggcaaaggttgttttagcttccaaacagcccttattaaaccagaaaaagacaaggtgaggctcacattgcccaaatgtgggacaaatattaataatacttaaactttatgttgataaaagattgggggaaaagctttctcatatagatcaagaagaatttcaaaagattctaggagaaggccaggcacagtggctcacacctgtaatcgcagcactttgggaggctgaagcaagagattgcttgagcccagaagtttgagaccaacctaggcaacaaagtgagaccctgtctctataaaagtaaaaactaaaaaaattagctgggcatggtggtgtgccctttggtcccagctactcactcaggaggctgaagagggagaatcacttgagccaaggaggttgagacagagtaagaccccctctcaaagaaaaaaaaaaaagatcctaggagaaaaagatatcagtgatacagtgatagaatttgagagccatttgagaaccattcagttctactaaattaatcaactcactggtagaattggagagcgcttccaattaaggttacaaatgggctcaggatctctgatatcaatgagggcaaatgcatttgatatcactgagggcaagtgatattgcccacctgaaatggtatctggtatatactcagtaaatatttgttgttgactgagtgttacgtgaaggaaagatgttcattttatttactgttctaaaacaatctttctgaaaatatgtgccaaggtctgttgaagaattagtttttataagtttgggctattatctctgtatttacaaaattgaatcactggtgttcttcaaatatactttaataaatatttgtttaaataatttctcctaagaattataattaaacggatgatagctccaacatataatcagttaactcctcacatatagaaggcttgttttgaaaggggagtgggatatttggtcagaagtgaaatgggaaccacattctcttatgcctctagctctctaagcagacctcgtctgctcagccatagggttttgtgggaaccacacaggaaaagtaccactgactctgtttcaaaaactctattagaaatagcaaaaaactgaaagcaagtaaaagtaaaggaatgggtaagcaaatacggtgcatctgaacgaatgtgcagccattaacactagcaacacaaagtttttaacagtacaggaaataattatacattaagtgaaaaaacaggatatagaatgcaagtataggaacatttttactatattaaaatttaaaaatatgagaaaggaaattatcaatgatagttgtattatgtacttatggagaattatattttcctttttcttttgaactttacattctctatacaatatctgcaatgattttctgttattttataagcatttaatatcctcctaccacccaaaaatgttggccctcattagggataatttcagccctattcaaactttggagtgtcataattaggaaacaaactgagaaagtccacttgcaaggaaaattctcatataactctattagaaagggggatccaccatggtgtttaaactcactttaggtcgcactgttgtagaaatggttcagattttattaatcctttgctataattacttccaataagaacttctggagaactccacttgatttaccaaattgagctcagcatattaaaatgaatagtttttgcccaatgaatttctcctcccttcctttctattccattgtttatttattatctgtagttaaaacatgtatgagaccatttgagagcatactgtagatactaattcctggatgctgtgtgatgcaaaacaaacaaaaaagcactcatagcatttcaactgtggcagctatacagacattaggaactagacagaaaggtaggagcttggtagacttataaggtttttgagcaagggagtcgtgtaatggagcaatactgttgaaaaaatatttttgccaagttgtatagaatttttttgaggaacatctttttcaaaatatatttttaaaacatcctttggcctcctctgtgccaaaaagaattctaagcacttaagatagatatatgaataggaaatggctatgagctcctagtaaggaggcacgttgatgatcttttattattgtgtcacctataaccatactgccaccactatattcatttgctgttgtgtagacaacactaacattatttgcccatttttcattatttgtatgtatcagtgctgtgcattttaggtgatgggagtaaccaacatcattttatacccctactatttcaaagagagagagataaaaacagatcattttggtaaatttgaggtgttgtaggaccgcttaacccagcctggagaatttgagaccttttggccaatctgatgtctaaaccacccaggatgagtacaattcattgcagcagagttgggaaagggcctttcccaagtagcagaaacaagattttcaaagactcataggtcaggaagacctcgcaacgtgatggacagcaagtagtttagtagagctgactgaagaagaggaaattggggaaagtgggacaagcaataagccaggtaaggagaggtaagctagtgccagtttgtgataagttttctatttcctgctaaaggttttgaatttatcctgaagcctattaggagctattcaaaaatttttaagtgtgaaggtgatatgatcagattgcatttagaaaaatctctttgacatcatgatgaatgatacagctgtagagagatcagttgtaggaacttaagaaatgatgagggctggaaataaggtaattacaatagacttgaaaggaagtgaataaattccaaaagtattaagatgggttagaaaaaactagatgctgaattgaatatgaagcaggatgataatgtaatttattgaagcattcattgagatagggaaataggttgataatcaggattggataggagtaggggtgggaaggaatatgtcctgcccatgagtcatcaggtggaactatccagaagcaagtacttattcaggtccaggtcctatcaagaaatgtggcttaccaggagtttgaggctgcaaagagctatggtcacaccactgcactccagcctgggtgagagagaccctgtctctaaaaaaaagaaaagaaacatggcttaaataaagatttggagacatcagcatgtagagggtgactcaagccgtgaaaatgattgagatgaaccaggaaagatgcagaatgagaagataattattaatatttgctctgagtatactgttttctgtatcaatatcatctgataatccctctcatttggcttgtcatttttccctccttaatcatagtttcctatttagaccattttaaaggaagcaggatatcaattacaaaaatcaaaaatagtccttttcaaaaactgataaatctgagaataaataatatagtgccatttacagcagattttctttctttttatttttcttttattttcttttctttttttctagagacagggtctcactctgtcacccaggttggggtgcagtggtacaatcataactcactgtaacctcaaactcctggactcaagcgatcctcctgcctcagcttcctgagtagcttggactatatataggtgcacactaccacatcagctaatttttaatttttttgtctctactattttggcaaggctggtcttgaactcctgagctcaaatgatcctcttgcctcggcctcccaaagtgctggggttacaggtgtgagccaccgggcccggccagattttcttttcttatcagtggcttccttctaaaatacaatttatcatcataatagacaatttggtttcatttttaaagaacataataatctctgtttattattattatgtataatattaatagtgaaaagaaaatctataggtttcattctttgaagcattaagtaatttttcccctgatccttgataacatcatgtgtgaataatcaactttgcagatatttgggtagggtacagagagaggtatcaagcatgtcttgtctgttttagttttctgtaatatactttctcccaatcataacttgcacatagaattgaattatcatggtgcattaataatgtacttggggttttgcaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggtgagtgataatgtaaatcatattcagatactaattgagtttactgttaatcagataggagacttacatagaggattacatgtggcacaattttatttcctatgctgaattcctaaaatatgcttttctgatgtggtaatgagatttattctcatttataccactctatctttctgatggtcagcaatagaaatgaatcaaggtattttgaatatctgttttagaaatggcaaaattaactgcatggtaacaagccatctatttgtaaaatgcattaaagaaaaatatgaaataaaaataaagtgtggccaggcacagtggctcacacctgtaatcccagcactttgggaggctgaggccagcggatcacctgaggtcaggagttcaagaccagcctggtcaatatggtgaaaccccatctctactaataataaaaaattagctgggtgtggtggcaggcacctgtagtctcagctactcgggaggctgaggcaggagaatcacttgaacccaggaggcagaggttgcagtgagccaagatcacgccactgcactccagcctgggcaacagaatgagactctgtctcaaaaaaaataaaacaaacaaacaaaaaaaacccagaaaatgttctttctatacattaccaaaaatgcatgttttgcttaatatgtattagaaatccttagttccaagtaccttgagaactggacagtattagagctggaatgatagtgtattgcagtaggaaagccacaaggtttagaatcagatggctgtgggttcaaatccctggtttaccacttactagttatgttcattaactactccaacttggcttccaatttgtgttttgtttttttggaaaaaataatattcacttcaatattcactgggttattggaagatttaaatgagatcattctctacattttttgtatggtctcttaggataccgcagaactattctttgaagatatacggttgccagctagtgccctacttggagaagagaataaaggcttctattacatcatgaaagagcttccacaggtcagaagtgtttaaagattccatcttttgactgaataatgaattggaatagaataatatagaaacatgttatttctatattatgcattcaaatttatacatgcaaaacttgtgaaatagctaatcatttgagtattaaagttgtaataaaagtatgagttttatagggtagttaagtaaataactgaactcagtaatatccaatcaaagcttataaagtaagtaggaaaaacagatatttcagttctgtgattccttcttagaatgattttagcttcttaactacaattcaaaaacttttagctctttgtaaggaaatgtcttgcaaaacatttgatagtttgccagtttttaaataataactgtgaatcaaagggaaaagtataaaattcagactgaaaagttttagccacatagggtcagtccctaaacagctatggttttaaagtatggttgacaagtgattattgagcctcagatgccagtgtaagggggtactcctgcctagtgactgccatgaaaaacaccagcatgatggaatcaaactgactaaggctacttttacattaataggtagaatttaacttatgtgctttaagatgtttatttccacagatatattgagtcatacagtgtgcagagattaataaattgaaataagcaactggggattgtttttaactcacatgtgagtaaagagaagaaaaattaaattgcatatatataatgaagacagtcattcatgggcatggtgttatgtgactgttgtcccagctactcggaaggctgaggtgggaggatcacttgagccctggaattccaggatgtaatgaactatgattgtgcaactgtactccatttttggcaacagagtgagactttgtctcttaaaaatttaaaaagattataaaaaaataaaggtagtcattcataaaaataaaggatttgctttagaaagtgattagagatatgtcaaaagaatctcataaatctgttttcttataaggagttaagatataaattaatctttatgagtttattataaagataatttataggatttatcgtaattgaaattgtgtgaaaatcacttgcataattagagtaatgtttaagacctaatttttgtgttataggaaaggctgttaattgctgatgtggcaatttcagctagtgaattcatgtttgaagaaaccaggaactatgttaaacaaagaaaagcttttggcaaaacagttgctcacctacaggtaagcttgtcactgtggtttagtattagatggtatcagtttactaatctgaaatggcctggggtaaatagaagtttggagttattttcatgtaaggtgatattagaaaccatggaagtggatgagatcactaaggagagatagtagagagtaagacaggagtggtcttaggacacagtccttgaggaagactacaagatttaaaggtagaattcatatttggaattcatattgtctgaaaaggaggagcctgtaagatgactgagaatgaataaacagaaaggagaaagcaaatcaggagagctttgtcacagaagctggaaggaaagagggcttcatggagtagggagtgggatcaattgctgcttaggggaaaaataagacgaagggcaaagagtgttcattgaatacaatgatatggagattatttagtaagagccattaatggaggcggagggtgacacacccgatgagtagatagaaatgaggacgtaaaacaatactgatggtaggcaactctttcctgagtttggctgtgaatggtagttgagagaaagggtggtaagggaagaggggaggggaaggagatttgagattcaagggagatatttgggagttattaattttttgtcgttatttttaggatgggaatgtgggtgcatattttaatacctgtatataaagaaaggatttaataaagagggaaaggttgtagataggaaggaaataatcaactgcgtaaggtctttgagaaagggtgagtttgtggatgctgacacatggaaagataggccttcccatcaacaggagagggattccttcatttgcacaggaagaaaggagcaaaggacatctatgagttcagacagatacatcactctgttggtagaaaactacaaaagttctttatagaagacttctatttctttaaataacgtggccaggcacactgactcacgcctgtaatctcagcactttgggaagttgaggcaggcagatcacttgaggtcaggagttcgagactagcgtggccaacatggtgaaaccctgtctctactaaaaatacaaaaattagccaggcatggtggtgcacacctctaatcccagctactcgggaggctgaggcaggagaatcacttgaacccaggaggtagaggttgcagtgagccaagatcgcaccactgcactccatccagcctgggctacagaacaagactccatctcaaaaataaacaaataaataaataaataacaatagagaaagtccttgaaagacaggtgagtgaaggaggcatggaggtgttgcagaagggtgagggaggtatgaaatatcttcttcagaatgagaaactaaactactttctgctttttgtgtatcaatcagctttatgataagagtttagcttcccaggtacaaacatagagaaaagacagatgattgtgtttacctaggattgagttttcccaggaacttgagggtttttgcaaaagaactcagtatatagtggccgcagtcactaaatatgctaattaaattttagaccctatagtttctttttaaatgaaggaatagtttataattccttcatgtggtcatcaaattggcaaaacatctcaccagcaaaaaacctggagttgggatttgacttaaaaatttttaagtagaatgactggctgaaaggctttgtgaagggaaaggtagaaatgaaacaacttggtggcttttcagaaccagcattctagaaattatgttcaagtgtggtttatgtcctaacacagctacttgaatctccgtagtctagtcgtgttctctctctcaaaaatagtttcctatttgtaaatatataaaatgtatttgatttgcaaaattgtaaaattttgactataaatctttaaaatttataacgtttgtaaatatttataaaatattttcctacttgtgaatatcagagactgcctcatagcgttgttgtgaggattatgttgtagaaaaaactgggttcttgtcacaggaccaggataatttgggcacgcagacacattgtagattgagtagggcagggtttattaaatgaaaaggagaaaggaactctcagcaaagtgaaagaaagtcctgcgagcagttctcctgcctcacagattgaatcctaggtcatcacacaggaacaggagaggctaggctcctctcctctgcaaacagtgtgaacttcccgaggctccaccccgtcctcccagtgcacaggtgggcattattcagaaaggatcagttgggaaagggcaggcttcatctgggaccagcagtcgggtttttcagcctttaggctgtttaggcttgaaggcagggtttcaccagagaccctcggctgtctcctgtctctatcaattagatggggtaatatacataaagcgcttggaatattgcctggcaaagtaagcccacattaaaattagctgttatccttattttattccttacataatgccttgctccattttgtttcaatatgggagacctttttaccatctacttcctcttgctcttgatctagaccctctctttgtcgttttgggaactgtttgctaccggtattgtcatcaaattaactttttccatcctgaaaaaaagtctttacatcctaacttttcttattgacataacaaacctaaaacagttgttctgaatctctaaaaatgaggtacactcaatcaagaaaacatttaacaaaacagtatgacttgacttgattaaattctgatttccttaagagcaaggatgttatactttatattccctttcatttatggatcactgatttacacgtatcagaggttctcagtgaatgccctttcactcaggtgtttagaaatgtcaggaatgaggtggaggtgggtgtgcacagttgactggaggtataacttgtatagtgccctggaggacagtgttgttaaatgtcctgtaattcacatttggattacaactaattgtgtcactcaaaatatcaataatttcccattgagaaaaactgacatatatgattttttcctttttggttcactgaacaaatatatattgattgcctcctaagggtaatgtgttcaactgtaatttgatgggtgtaactctagaaacacatactacgctcctggcaatatgaaggaagtgttaccacttgatatcactctgattttctcaactgtacccaaagtggaatgagtatcatttgcttctgaaatccaaccaccaccacttaaacatcaaaaatgtttactaaaacacttataccaaggccaggcatagtggctcacacctgtaatcccagcacgttgggaggcctaggcaggcagattgcttgagcccaggactttgagaccaacctggacaacgtggcaaaacctcatctctacaaaaaatacaaaaattagccaggtgtggtggtgtgtgtctgtagtctcagctactcaagaggctaaggtgggaggatcgcttgagccctggaggcagatgttgcagtgagctgagatctcactattgtactctagcctgagtgacatagcaagaccctgtctccctgctccccacaaaaatgaatacaaaaacaaaaatatacctttagccttattttggctaaaggtataacagttgaaccaaaagacatgtttccattcctttggaaatctacatttcctgtgtttatgaacttaatactagattacaacaaggatgactatattattacccagattgcctgaatggctcagaaggcatgtaatttgacatttaaccatgaaggaaataggaaagtggtccatattgttttctcataggggaaaaatattcttttaaaatatatatttattgtattttaatagcaaaaaataaataactttaatcattcctttttaaagaagtatcattttattgttgccttctttcaaagttagttccctaaactttcagtaggtggcagtagcattctacttccacaggtcacattattgatagctagtagtattgttttccaagtaagtttatatgttctgagatttctgagatatgtcttctgatcttcctattttatctaaataaatatatttgaataatattttcatatttcaagctaggagtatattcagagatgatgaataaccgatactgtacatacctataccttgtattcaagagctgggtacactatggatctagttattcaattgaaatagaagagctttaaatgttacaatatacttggccacatgtcattttataactatataactattcagtttccattctctttgttatccttgaattttggacattttggggctttctgaccagttgaaatgcatgtcacaaaatttattttctttttagaatagaaacctacgtatggatgtagcaataattattaggatttttaaaatctatgctctccatagtttatgtcgatcttatggttttttgcggaatagacaataaaacagtaaaatccagatgttaaataataatggatattattgcttgactgctccctatctgccagacactgctaagtgaatggtctcattctttttcttcacaaatctatataagtattttaattatttttattttacagttaaggaaattaaggtatagagaggttaagtaacttgccccaaattacacatatattctaattccagaacctacactctttacgtatatactgttattactgcccagaagtgcaaagcagatgggccttttttcttttcctatttccttcactcagtgggcaacgaagtgaaaatggaatgttttttctaatctaatgagagctcttggttagtcatttcctgtgtggtatgtgttcttaattctaagggcataaagaattagggagaggaatagagaggaaaaaaataatacttcttcttgacatgtgtctaaaatgggaatatccagtttttaagaccttgagcatgggactaattaactatcaaatagcaaacctagtgtgtttcattttatattttaaccataatatgtgagagcaactgatgctgttgtttaaatgaatactgggctagataacctctccaaggtgttctccatttccataattctaagaattctgtcattcagaactctgaaaaagactccatccagcccacttagtaacttcagaataatttttaatgctagctgcagtattatttattaacaaatataaatgacttaaaaatactgctatgaccttgtcgatcattcactaagagcacttgactagtaatgtgtggtctaatttttagttgcctttgattagaggatgatttcagaaagcataatgcagtgtctgcagtgaaaagcaaagaccaaatctgtttagtaacgctcaacccaatggcaagaatatgtaaatatttaatctttttatcctcagagagtaaattatgtactcttggagacattattctctcagacctctggacttcactgaatgcactgatgcaagaattctaaatcattccattctggtttgaagttttacttcagcttctagaagtttccagcatttacaaaggaatgactcttgtatgagagaatcaggcttagatatctttactctttcatattgtaaagacagtgcataaattcccaaatgtggcatcatgtaggcaaaaaaatatcttgagacttgttggatccacccttattttccaaataaagtgtcatacatagtgtcattgaactaaactaggagtaggcttagaaaccatcttcagggattttcatggaatactcatctgttttcgatatatagattatttgcctatttttttctttttttgttccatctttatattgtctaagagtaaacttcaatgtgtgggttgggagtgggaaactttgtgctgattaaagggtagatatttgacctaattaaatatatgatgaatagaaatggagatagaaaaaattaagggaaacaataagcggggaagaaagttttgatgtgacccagcatgttcagaactagaggccagaatacagagatggaaggagtggggtgccaaccttctcattgcttagttttggaatcattcgatgccagttacattctctgtttctagaacagggtgaaataaaaccaggggaaagacagtcagttggagttttcatcagcacagtagttatgttgatatacctgtaaggaatctgcccctcagagctttactccacctgatacaccctggtcttgcttggtcctgggtctttttacactcccattctactcttttccagaaatggtaagtatcaaaactgtcccaaccaacaatgacagtgaaagaatcagttttataacttgagaattgctgtagccagcattaaaagcagaccatgtatcttctgagaatgtgtcccaccaccctcctttgagaacacagctgtggctttggacttggtagtacctaggtgggatgtgtttaatttctagtttgagtttcactgcaccacctttgcctgtaactttccatgtatatgctattagccacagtgaagttcttactcatttcacagcagaatgatcagaactgtttctatctgaattttcacaaagaagataggccagctgaccatatctgggccttggacctaagaaatcaactagaatggagtatacttttggagctacccaaagtgggaacccagtatttcaagttcaagccaatttcctgagggaggctcaagagtcagtgccaaagagaacagatatacactccaagttcagagtgtgagagcctagagtcaggaatgaaataaagcttgattgaagcaaggacagtcagcaacaattgagaatggtctaaatagaatgatttccaaaaatgctaatgggttgtccatggccagtaggaggaggtaggtacatagctatattaacattgataatcccagaccattcagtccaagctagagactgctaaacaagctattgagaggtacgggaggtgtattcatccattttcatactgctatgaagaaatacctgagactgggtaatttattaaaaaaaaaaaagaggtttaatggactcacagttccacatggctggggaggcctcataatcatggcggaaggtgaaggaggaacaacagcacatcttacatggtagcaggcaaaacagcgtgtgcaggggaaccactctttataaaaccatcagatctcatgagacttactcactatcacaagaacatcatgggacaaacccacccccatgattcaattatctcccaccacgtccctcccacaacatgtggggattatgggagctacaattcaagataagatttgggtagggacagagccaaaccatatcagaagggataatgtgaagggatgaaagaggatgagggtactggattttgatctctttagtactctgattttattctattgctttctacagatctagattaaatactgtgcaatattaaataataccttatattttgatgtttatgaacatatatagaaaccccttgtccctccagatgttagaagcagagtagcaaaatctgtatacttaatttcattaataaagaaaaaaatcttcaaggatttaatctctggaggaaaaagcaacaggtgttttcaacggctgtacctaaataactgtaccacaagatggtgctcacacattaaagtcatgctgtttttcaagaattttgcctcgtctaaattttacaatctgaaacaagacattgtttatgttttaaactatttttgcatcttttagtacaaatttccttagcactgaaatatagtgagttttaaatttaagctgatttggtaacaaatgccatttttatggaggaaaaaaccaacaattccacttttgtttgccctaaagatcttttattgtataatttctgatatgttaagtgggttgaagtttatatttctaccatgctcacttttttcttttatttcctttaaattcaagacagtgcaacataaattagcagaattaaaaacacatatatgtgtaacccgagcatttgtggacaactgtctccagctgcatgaagcgaaacgtttggactccgccactgcttgcatggcgaaatattggtatgcatgctacagtaattagagtgcggtgtgtgctcagactgatatggaattctgccaattttaagctcagccttgagggtcttaaaggaagaaatctgtgaaatgaaaaataaaagtgagactccactttaaaaaaaaaatgctaaaaagttccattaagcatatgtataatgtgctaaaaatgtttcaagttggtatttaatttttttatcctaataggcaagcaaagttagtatttaattcttaacttgctattgaaaataaaatattaagagtgggaaaatgaagagtgatattgataggatgactgattcattcattcaagtaatagtttaatttcaaattatctgaagagtggcagtatagtgaggctgaaagggaacagtaaaacttaggagtcttgagatagagtccgaattcttttattaaataactataattaaacttaattccatccaggaaaatgtttttgttatctgtgaaatgactaagttggacaggatttttctatttaaggtgctttccaattttaagaaaaaattcaggaagaactggctgtccaatcaaagtttcacaggctctattaagtgaaaggagaataaaaatcctattaagtttagaaagacttcgatttgaattaaagattattagcaatggtgttaaagatgagttgaatgaaaaaacatccctgtatgtcagacttttgtatattttaagattttagaatatacagtctaaatcagattctggaagtagatttggtttcctctttttaaaaacaaacattctcccatatcattagcccaagagtaacttagaataaattcctgtcattattcattaacttgtgttcagttcaatcacaggtagaacaggggaaatattttgtgctttatataatgatcccataataacaaaattgccaggttgaaaaataatgtggaattacttttcagaaacttgcacttttgaggagactttttatatttacatttacaagaagttctttgactagtggcaaaaagtgtaaaaaaaatttacatatttttggaaaaagagaagtttggatagccattgaccttgttatttgaaaacctcaggtttatacacatgctcatatttcacactgaaacacaggaggcaactagttatagcccagtaaatatttcactaaaatacttgccaaatataaaaaattagagaaatccaaatattattgtccccaaagtcttgtctattaataattatattgttaatatattgcttagaaatatcctcacctgtcgtatggtctgagttttaaattattttaaataaaaagaagtatctacccttatttttgctttatgcttcccactattgaaaaataagtagtggggtgctgtagcttgccactgtagtaactcctacttgagaagctgaggtgagaggatcctttgagccctggagttcaagactgtaatgagctatgattgtgccactgtatcccaacctaggccctagagtgggtgagactccatcactaaaacagactcacaaacaaaaagaaagaaagaaaagaaaaataagtagaaaagaattttgaactaatgtatttttatgttaaggtgaataaaatctctatcatgaattttaatgatagaattgtgatattatcagaaaagaatttttctcaagcactgcatgtttatgtatacaaacattatatataatactaatacatacacttcaggaataataatctctatataattttctaatgtttcctatatgatagcatatactttgttagtctgccctcttaggttttcacttttatcttcaatttatttctgaaaagtcagaaccctaaaaaattgcttttttatactgaaattcagaatcgtgatcttcaagtagaaagtgacatcattggagaaaaaatgcatattacaagggcaaaaagaactaggtggctgagtaatttagatcatatagagaatccaaataaattagaacatattcaagtctttactgcatgtttttctagcctcaaatagccaaaatctaatcatctgagttttctaccttttgtttctagcctaacaaaaacctagcaagaaatataattaatgaaaaaggtactcttatatgaaaattctcttgaaatatatttcatatgtaatttttatcttctttgcttagctaatatgccgttctaattgcttaataaatgtgcacatttaaacaattgtaaataattagttttctggttttgaagcacctcatgaaaatccatttcaaacatttcttttctgccttttattttggtcatttagggcatctgagttacaaaatagtgtagcttacgactgtgtacagctccatggaggttggggatacatgtgggagtacccaattgcaaagtaagtatagttttctgatacactcttctttatgatgtgaagaaaaaggaaaatttctttactttgtacatcaaatgtagagggaaaggaggtgtgcaatcttttgaatttttcagctgaatacagacaaaatgtattcaagcaaatggaaacagctttttttttatcaactccctactaggattttatttttcttaaataaagtaaagagaccaataaacaaaagcttgatccttggctttatttgaatccttatgtagaaggacaaatagtattttcaaaaattttttaatttttttattttttattttattttgagacagtctcgctctgtcacccaggttggagtacagtggcatgatctgggttcactgcaacctccaccttccaggttcaaataattcttgtgcctcagtctccagagtaggtggaattaacaggtgcgtgccatgacacctggctaatttttttgtatttttagtagaggtgtggttttgccatgttggccaggctggtctcaaacccctggcctcaagtgatctgcctgccttggcatcccaaagtactgggattacaggcgtgagccactgcatccggccaaatactactttttttttaaaaccaaaaaaaaaaaaaagcaatacagaaaaattaactggcatatgaaaaggatctaagttgtcacatatcttaaatatctgattatttgttttgttctaaaaaaattaaaaatcttctttctaaatagatttatttccttcaaattgaaagaaatcaaatatatctttttatcatatatgaatattcttatcagtttgaagcagtactaatttgtaaataggcagtgtccccattcatatttcttcctcaatctccagaatttccttttctcctaacagtcttttgcctcagaagtctccccatagctttttttcctcatcaccctagaaaatatatttttctgattatttagcaatgattttggtttagaaaattttcccaaggaaattttttatttatacagaaaagttcagtttgttctgaatctgagagtaagaatgctataggcttctaaaaatgttttaagattatcttaatataaagtatctaaagggaaaaattatgaaacctacattcaaactggcagcctaatgatttcaaatttatctttttggtaagtataattggaaacatttaatatgcttatagtccttagaaaaaatattttactaaaattacattaagaacagaagctatgtagtggctcaatgtttgtgtggtttagttcacatttaagaaaggcctattaggtggggagaaggcaatcatctaaatggcttaagattagagcgtggcataagccttggtctctgttttctcggagtcaactccttcaagttggtaccaagcaaacaatgtagattgatggcttatttgaaatctctggtttcagtttgagagacttatattctctttaagaaacaataatcacctttcttggccagtttgttagttcaaagattgtatcaatttttaaactagactgctatttctcttcccatatatcgcctaatatcaaaaaagccactgaggccacgtgcggtggctcactcctgtaatcccagcactttgggatgccaaagcgggtggatcacctgaggtcaagagttcaagaccagcctgggcaaaatggcgaaacaccatttctactaaaaatacaaaaaaattagctaggcgtggttgcaggtgcctgtagtcccagctactccagaggcatgagaatcgctctaacccgagaggcggaggttgcagtgagtcgagattgcgccactgcactccagcctgggcgacagagtgagactgtctcaaaaaaaaaaaaacaaacaacaacaacaacaacaaaaaagccacatagacacattggcaatatgtggatgtaatgtatagattttgatttgataaaaaaagaaaaatcttctaattgtgtttcttatatcccccagactaaactacattagtttatatatatgttgctgagggttggtttcatagataagaggtgttttctctgcttttttattttgtttttttgtttttgtcttctttaataactggtcttcagcatgtgggtttatttaataagtcttactcattaggctcgagcccgtgaggagtgagatttaagccttgtcattttaagatttctctgccatgctgggaagagctgccttagatgtagaacttcactgcagtgtggttaaacatttctgctgccgcctttcactgttaattttagttgatgactaaatttaattagtaacatataaaaggtctactaatctctgctttactccattggaacttctttaatgtaaaaagaagcctagcccatttacaaatatatatatatatatctaaacgcattgggactgctgaagtaggcttacagtaggtaagtgctcaaaatgcaggtgctagattttgtagagaatagcaaaatccgttcagaaaaaaatgtttgaaaacataaatatctcaagcttttaaagctttcagcagaaagttctgagattgtaaatttcctttgtaacaccgtaaatcatatcagtaaatatttactgagtgtccatttctttgtaaggaaccctgatgaatatggagaagaataagtccaaaagtggtatgttcctagagagctggcacatttaatttgtcttaaaaatcaaatttaaacaaaacaaaacaccaagattatacttgagaaaaaaaaaagaaaagcctttgagtgtgtctaccaggaaagtccaaagttcaataactagctctaagtgctttggccaatgaaagtgttgcaatatacaaaaaagatatttgaaaaagaggcagaatacctacatcctcattccagtctgccaatgatgtgttgttggtgaccattaaatagcaaccattaattaggaaatatattaacttctctctactttagttcctttaccagggaaacagtattaacatttatccctccccaatcccagagctgagaggataaaatgagatgagaaaagataaaaacaactgtacagtggtacggttgttatcatgactatcaaaagtgaacttatgatatttgggttttttttttctttggtgtgggtatagcaatggactcagccacttagtattttaactccacacattgctgaagtgactattaaccatttccaaaaaacaagttacttgttaactttctgggaaataatatttgctaaagcattagtttatattcctgatagtgatagtggttgtgggaatgctagaaaatatgtatcttttttcttttgttttctataaaaccagtggatttcaactttttaggaaacattaaagataaaaagaaactaagacatcctgtgcatttcctaatctaaaacagactttttaagagtgttatcatatgtgctgaattttacaaaattaaatcagatgaaacatactcattatttttattttgaatttgtaatctctttaatcaaattaatacaaagctatacagattattaacatcttaatagttttttttactattattccaatttaggatgaatgccatattgaaaaaataagtaatttatgaaggacttttattgtttgtacttcactaattgaatagtttatgagttacctggtaagacaaaatttacagtttctaatatattttatttattcattcaatcatctgatttatccagagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaaccattaatttaaagtagctttaacatggaaacagatgtattcttactcaacttagaacacaaacattttatttggtattgttgatattaaacattgttttttaatacaaccattacaactggagagaggagagggaagaaaaaatattttgataccagtctttttaaaattttttttattgtactttattttttaagatggagtctcgctctgtcattcaaggagtgcaatggcgtgatctctgctcacagcaacctccgcctcccaggttcaagcaattctcctgtctcagcctcctgagtagctgggattacaggcacgcaccaccacacctggctaatttttgtatttttagtagagatggggtttcgccatgttggtcaggctggtctcgaactcttggcctcgtgttctgcccacctcggcctcccaaagtgctgtgattacaggtgtgagccactgcacccggcctttttattatactttaagctctgggatatatgtgcagaacatgcaggtttgttacataggtatacacatgccatggtggtttgctgcacccatcaacccgtcatctacattgggtattttctcctaatgctatccctcccctacccccctaccctccacaggccctggtgtgtgatgttcccttccccgtatccatgtgttctcatttttcaactctcacttatgaatgagaacatgcagtgtttggttttctgttcctgtgttagtttgctgagaatgatggtttccagcttcatccatatccccacaaagaacatgaacgcatcctttttatggctgcatagtattccatggtgtatatgtgccacattttctttatccagtctatcattaatgggcatttgtgttggttccaagtctttgctattgtgaacagtgctgcaataaacatacgtgtgcatgtgtctttatagtagagtgatttataatcctttgggtatatacccagtaatgagattgctgggtcaaatggtatttctggttctagatccttgaggaatcgccacaatggttgaactaatttacacccccaccaacagtgtaaaagcgttcctatttctcaacatcttctccagcatctgttgttttctgacgttttaatgattggtattctaactggcgtgagatggtatcttattgtggtttagatttgcatttctctaatgaccagtgatgatgagctttttttcatatgtttgttggccacataaatgtcttcttttgagaagtgtctgttcatctccctcacccactttttgttggagttgttttttatcttctaaatttgtttaaattccttgtatactctggatattagcccttcatcagatggatagattgcaaaaatattctcccattctgttggttgcctgttcacgctgatgatagtttcttttgatgtgcagaagctctttagcttaattagatcccatttgtcaattttggctttgttgcagttgcttttggtgttttagtcatgaagtcttggcccatgcctatgtcctgaatggtattgcctaggttttcttctagggtttttatggtttttagatcttacatttacatctttaatccatcttgagttaatttttgtataagtcataaggaaggggtgcagtttcaattttctgcatatggctagccagttttcccaacactattaaatagggaatcatttccccattgcttgtttttgtcaggtttgtcaaagatcatatggtagtagatgtgtggggtaatttctgaggcctctgttctgttccattggtctatatatctgttttggtaccagtatcatgctgttttggttactgtagccttgtagtatagtttgaagtcaggtagcatgatgcctctagctttgctcttttagcttaagatttaattggctatattgtctcttttgtggttccatatgaaatttaaagtagttttttctaattctgtgaagaaagtcaatggtagcttaa

SEQ ID NO: 17108 - DNA, 44999 bp, Human; identical to SEQ ID NO: 14832

SEQ ID NO: 17109 - DNA, 44999 bp, Human; identical to SEQ ID NO: 14832
